United States Patent 7,868,149 (PLANT GENOME SEQUENCE AND USES THEREOF) - sequence listing, part 104

SEQ ID NO: 56098 - DNA, 25827 bp, Oryza sativa
  unsure (1)..(25827): unsure at all n locations
attctgtaagatgaatcaccttgtattctgttacgagtgacatcctggacagaaaccaccgcaatttagacagaaggaatcgacgcggtttgtggatcatatgtaagcataccctgcgtcatcaatgcgaatcataccaatccacttgacgcatcagccagttattctagaatactatcatcatcattccctgcgatgcaaatggaatctagacagagcactagatcctagagaacaacaaattcctagcaggttacacaaagaatatatgattccaagtttcagctcccatcgcaatccggtgaacactaggcacaaactttttctgtctttcgcgagcacagctgcaccaataacacataatccctcgcactcaaggactcaaccagttcaacgattattccagcacaatataatgtgcgctaagcatctctaaacccgcagcaaaaccaaaaacttcacgccaccgctccgtttcacggaataatcatccatctatcgttctaccatggagttgacctaattcgtccaaaactaccgcaacctagatcggagcccatccaaaaattccaaaacaacggaagcgcctcactgcatcatagaatccgaagcgagagacggctagaaatgtggggaattaccttgacggcgatggtggggtgggaggaggggtgggactcgtacatgagggcgtagtcggcgagcaccaccacgttggactggatctcctcggacacgcacttggtccccgactgcggcaagtccagccacaccgcctccgcgcagaggaggaggcacgcggccgctatcaccgcggccgcgacagcgagggttagcgccggagatgtagccgccaccgccgccatcccccgacgaccttgggatctccgccgccttgcggggagggggagctggagcagtggcggagtgggagagagcgtgaggaaggcgacggcttgagggactattttgaaattatttacttctgtttaggggtgcccgtgaggtgggctttgtcgggtggtatttggatttagggacttaaactttagggcacccacaatggttatctataagctatctacaagagatccatgtcagcatatttttctacttggaagatattaaatgaagagagagagcaaagctatctactagcttagagatagtctatagagaaaaacgaagcaatgcatgagagagctatagatacctatgtagacatactattgaggtggtttactattaatctagtctattgctgagatgtacatgttttatagagagcaccctactttaccattgcgggtgctcttagtctctgtatttaaacactaatttagagtattaaatatagactacttacgtacataaatgaaagctaatttatctgacaaattttttaagcctaattaatccataattagagaatgtttattgtagtatcacataggctaatcatggattaattaggctcaacagattcgtctcgcgaattagtttaagattatgtatgggttttattaatagactatgtttaacatttataattagtgtccaaacatccgatgtaatagggacttaaaagttttagtcccatctaaacagggtctgacagtactactcactactgtagtgtactactgtggtgggtctatggtaagtgggaccggttcttccatggtgaagacaaatgaaatactccctccgtaaaaaaacgaatttaggactaaatatgacacattataatacaacgaatagagatatatccagtactagcttgttttttagatggatggagtaaggttgagtttcagcggctgcagattctcacacagtggttgttctctttggttgtcatttttagccttattaaagtttgatactccctccatttcaggttataagacttataggttaacatctatataaatgtgggcaatagtagaaagtcttataatatgaaatggatagagtaatgttaaattttggtatattttagcattatcgaaaaagaatagcgttagatatatttggtgccttgtcaaatattgatgatgtttttatgagaggaaacatctagaattatcaaattttggtggagtgataatggtaaggttgtgtttagtttactatcctattaaaatttggtagggtaaaatgacaagcaagtaaacatgcatttaacttagaatctagacaatgagatagtagaagctatctttgtcccacaaaaagaaactcatgcgttcaaatctagatatagcctacctttaaatggtttttttacgaaactggagagtaggaattgacaaacttatattttctaaattcttataaaccagcttcgcatcggctctctaaataagcctgggaattctatcgtcacacctcgtcataccagtaaatattggtgcgttacaataggcattgtaaaaatattgaaatttacaggaattatacttttttcctacagaaaactatataatttctctcgaattatcacagacttataggttctagactccacagtcacactgtactgtgaactaacttatatcatcgcacaaactaatagaacacgtactacgcgcacactttgattcagttgtacacacacactaactttagttaataaagataaacaaattgtcattaataagacaatgaacgagcactaaaagatacggcagaatttggttcatatcccctgctctttaccgtaaagaaatcccaaatatctcccgtgatcccggggatttttttaattagtgctgatgttagtgactaccgatcgatctgccatttccatcatatggtatatgcgacgcacgcacgtcagcatgcgtgtacacccaacacggcctgtcgctcatctacaaaatgatcatcttacgtcgtcatgtcgatccggccccaatgcagctcatatccatatgatgtccaatcaaaatccaaattagttattctctgttttttcagacaattagcaagagatagctaaactatctgctcctagctaggtagctaggtttacgtgtttgattccatagagataattaagataagattgatgaagaagttgagtacagaaggtgactgtttaaaggggccaatccaaaccagttgaactatgtctagctaggatttcaccagtttcagaggacatgttctgttcctatataccagagatagcaatagtcagtcactcactgtgcaaaagtagagatgagaagagaatgtttaggcctgttgatctattgttaaatcaatcgatgtcattcagcacctaatgactttgattagaaaatgtcattcagtaccaaagccaaacatattaaagctagctaaaacggcaggcagagatcacgacatgcacagatcaatcaatgcatgccgttgcatcgatcaaagctataccagcttgcatgtacatttggattccatttcgagtcaattaattagtcgcaaaaagcctgtaattagtggagacacacgccaagagcaaataacggagatggcagtatagcagattagcagtactgtctcgttgacaacacatgcattaagcaaaggcatttgcactatagttaattgacaagtaaattaattgcagctccggccacgtaagacagcagagctagagagaataatatgtgattcattacttaagcaagcacttccggacacgtcctggccttatccattacattgcattatgtgaaaattttaatacctcacaagaattcttaggagaaatcaagaaggaaaagaagaagaagaagaagacgacgaagaagaagaaatcgtgtcacgctctcgatcgatcgatggtcgatcgaaccacaactagcttacaatggactgccgaggatgacggactgctgctgcatgtgcttaggctagtagtgcccgttcgccgccggcggcgtctcgacgtcgtagacatggccgccgttgccgtgcttgctgccgtggccgttgggcaccgccgtcaatggcagctcgccgccgcccttgttgctgcccgccgccgccgcgccggcgtctgtctgctcgactttgtcggcgcccttgccccagatcagcgcgtacagccctatcacgatgatcaccgcgccgatcacgctgcaataattaattaacaaacaaacaaacaaatcaattaattaattaaccaatcgaccgttaattaattattcactctaatcatgattaattactatatatagtataatggggtcgtgtacgaggtagagtagtaccttccaaggttgatttcttccttgagaatgatggagcccatgatggcggtgatgatcatgcagagcgggttgaatgctgtcacgaacactgggcccctctgcctcgacacgatcccctgcacgtagtacgccacgccggagcacacgataccctgcatatccattcacctcatcgtgtcagcgcgcgacagctcgccggcggcgaacaccgccatggctgatcgatcgagcaagagatcgagcttacggcgtagacgcaggtgaagaggcgggtgtcgaagccgatgagccaggcgtgggtgttgtggcgctcggcgacgagggcgacggtgccgctgaggacggagcccatgaggcagatgagcgtggtgagcgacagctcggccgggtaactctgcagggtgttggactggaggacgaagaagcccgaccagcacacgcaggcgacgacgatgaagatggtgccctggaggaacccgccgcccgccgcgccgccggcgccggagccgccgtcgtggtgctgccccttggtccacgggaactgcaccaccgggccgtggtacagcaccatcagcaccgctccggccaccgtgaacagtgtcccggcgatcttcgcctggctgtgcacgctcttcagcttcaccttctccatcctaattaattaattaatcaaccgattcaccattaatctctcgcattccatgctgattaaacgattaatccacatgctaattatatgctaattattgattacctgaggacgagggccatgacgaaggtgacggcggggaggacgttgatgagagcggaggcgaagccggcggatgtcaggttggcccccatgtagtacaggttctgatcaagcacaggcctgacaagtacgtacacgtgtcaggactagagctgaattgcatgtacggtataatcgtattagtattatttgacttgtaattaacttactcaagtatggcgagccccatgatcttcaggaagatgatgagggtcaaccttggtcttactcgcctgtatcaagtaggagcaaataatcagttattaaagccaaccactgattaattaattagctcagttaattaggttattaagctgagattactgaagaaaatgctcatgcagcagttgctagttgcaactctaggagggccctaagaacatgattcaactagctaagtgaacacatatatagctaggccgtcactaaattgatggtgataaaattcggttgattatggtacggttaatatgtaaggtgtcattttctgctttctgtaccgctgctgttcttgtctgggatctatagattctagttggaatatatatgtgcataagctgatttaacgcgtgacattcaagggattaaaagctagctgggaaaagaaagcatacgcgcgcataaatatatacttttcgaatttcgatcggcatatgttaaatttgcagatacataatggaattgacaagctgctttttcatattaggatctggagaagtgcctatcgtggagcatgcatatcatgcaccatcaactctgaaagggactaattaaaacgctacgtcacccggcttatgaacgaacgaacgaacgaacagcagtgctagctatagctagaaatggactactcccatctcttgtgaaaatagaaaaacacgcaagactagctattttcattattcatgcttgttcagagttcagacttcaggcaaacatgtaagctcatgcgtgtgttgtacaaaccacaaacaatgcatggtctatgcttttgcatgcatgcgttctaattaacgatgaaaggaagtttaattaattaaatctagcttgacttagagaaagagattatattagttgatgagctaactaattagctaacagcgctctagtactagttaattaattacctctcgaaccagagggcgaagggcgccatgacggcggtggcgaagaggttacggtagacgacgaggacgaagtggctcatgccgcgcttgagcgaggcgacggccaccacgtacatcccggcgaaccccacctgcagcagtatcatcgccaggtacggcttcgcatcgttcataacccttcctacacccattctctcgaacgatctgatcgacgtctcacacagttaatttctgttgctggtaatctttggctgtagctagtagctagctgcaggagtagctcgcacacaagctgcagctagctaggtgttgtggctgtgatgaggagaggcaatgagttttgagggatatatataggcatatagctgcacgacgctgcactgttcagcacagcagctagcagcaaccgttgctatcgaagttggattagtcgtctcgtctcgcccagatgcccaagtgtggactgtgtggtgccattgatggatcatggatctgactcatgctcccctctctctctctatacttctctctcttctgaatgttgttgttgcgagcagtgctggcttgtatgtttccagcttgtttaatattccacttccggctaaaggagagagagaaagaaagggctatatgtctgcgtcgtctttttaattttctctctgctttgccgggaaaatgcagtgagcacatactgccgatgggttttgcaactttgtcatgtctctttttggctacctgaggagaagaggatgcatgatcagagccgtccaagtcaaggtttgtgggagtcagctggaacttctctgatctgcagctcctaggcttttactacttgtgttaacccctgtctagcagagctagtgcttgtgtaccgacaacaatcgatgtgcatgcatgcatgcattgtacatggatgtgtagagactagagaccagtagggagaatactgtcaatgggttattcgactgataagatgtggcatcaatgctgactagctagttggttgctgctagctactcttatcttcagtttaacttggagtgctaattaattaactgaagattctcagaaaaaccatatataattgttatcttcatttcgtttatataaagagttacactatgctatcacttctgggagatgtgcgacagtgtaatataaaggcatatatatttatatatgggtgtaaccgtgtaacattacaaggagaatggacaatatattcatgataatttaagccacaaattttggtttaaccatacacttatgctcagcttggcctttatgtatcaggtcttacttactacttcctctgtttcatattataattactcattttgaatttggtcaaggtcaaactactttaagattgattaagtttatagataaatatagtaatatttacaacaccaaattagtctcattaaatcaataattgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattgcaaaagggaagtggaagccaagacttggaccaaacatcacaggcgtgacttgggaactaggccgaaactctaaaactcatcgtagccggcttgctcctggaagaactcctcgtcagcgggatccgcttcatcttcttcagcaactgggggggagatatttatatagagcaagggtgagtacaggagtactcagcaagccatgggaaataagtgtttaatgcaggcttcaaggaaaggctgttgtttttgcaattgattttatttgaactcttttctgaaatcaactaagtgagtgcttctcaaacgacacggatgagacagtgcgtctcgtccggtcggagtatgtgcaaagtatcagtcttttgaattgattcaaggttggcacccggccaacaactttcaaacggccacccgggccaacaactttcaaacggccacccgggcctagctgatcccatcagctgcagattttccaaacatcgatcccatttccacaacagcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgagagacctccaagctttcatgacaaggcatttcgaaagctgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagtcaggggtgtcccattccacccatgtggtcgtacttgtcttatgttcggatgaaattccaaggaaacggtccttaagtgcaagagcgggaaaccgtacacccggtacgttccccggtccgcggttttagaaattcatttagttcgcaagcaccgacccaggtgtcgggttttccaagtcttctgtaaaacccaagttttacccaagaagttactcagattttaagtttgaaggcgaccgtcgatactcgcacagagtgcacgaatatcgaggcgcagctagatggttacaagggaacatgatataacaattaacaatggaaggatcagatgcaacaagttgggtaggcccaccggtctgccttgcagacggtgcaaacagattaagtgcaatcctatcaatgcataatattttgcgagcaatataattaagttcaaatataggctcaatatgttcaaaggtggcttgccttgctcgagatcttgagcttgatcctcgaaatcctcgcactgcgggtcttcgggctccgaaactacacgcaaaacgggacgactcaacaaacggcgaaaataaagccctattaatgacctctaagcgtgccattagatagatctcgagatttgaggaattttggaagttgaacggagtcaaacggatttacggttgggaagatatcgaatttctaagatttttggatttttggtctaaaggaaaaaggatttaattaaatcctttttgaaaaagaaaagaaaagaaaagggaaagggggagggaaattagacttctctcgggcggctagggcgcggcccgagagaaagggcggctcggccgagcttaatgggccggccggcccaagaaggcggctcagagcgcgcgcgcgggaggggaggagagagggagccggtggaccgggctcacctcgcgtggtcccgagtgggacccgcttgtcggtgacacggttcaccgtgcggaacacgcacgcggcgcgtgctagggtttgggggagggacgcggtgcacgcgcgcggttcgcggaggacgcggatgtggcgggcccacgtgcagcctcacggctcgcggtggaccgcgcgcacgggaagggcctgatcggggtcggctcgacccggtcttggccgagctagcgccgacgtggcgcctacgtggctgccacgcgggccggcgggaggtagacgacgatgccagccggaacggacggcggacgacagcggtgagcggcggagcgaaccacggcgataccggcgaaagcgagcacaccgggtggctgcacaggacgaggggagacgagccaacggctcggattcgccggagggagcttgtcggcggcgaattgcggcggcggcaaccggcggagagaaaaggggaaaacggcgatgaggtcacgaggggccgattcccggcggcgagagcatccacgcggctacgggaatccgtcccttgcgccggattaggaggaaacgcatcgagggaggccggcgacgagaggcgcttccgagctcgggcggcgacggcggcgagcacacggcgagcgacggcaacggtcggggcggcgccggctaactacggggaggctactcgtgctactacccgagtctaaggggaggagatggaacgaggaggaagaacggagggaggcactaccgtgcgggcgggcgcagtgacgagaggccgacggcgcgggagtgatctctccggcctcgggccggggaagaggaagaagacgagcgcccggagtccccttccgcgtccacgaacgcaccggctctcccggtgcttggcgatgaacggcggaggcgagacaaaggggcggcaatggcgtggtggcggcgagcgaaacgggaggaggaatcgatgggagggcgccttggtttataggacgacgatgtcggtttggaaaccgaccttgagcggtcaaggcgcgagctggcgctcggcgctcgcggccaaaacggcgacagaggcggaggatgacgccggcgggaggaaaaaggggaaaaggagggagagaaagggggcttgccccctagcctttttgggaaaaggaggaggggagcgggggcgacgcggcagagggaggaggggctctgcctccgtcccttggcagcttgcgcgcggagtggcgggggccgggcgatgatgacggcgatgacggcggggcggtttggagcggggcgacgacacgggtggcaggcgcggacaggcgcggcagaggctgacggcggcggcgaccaggcggtcggccaccacggcacgtgcgcgcgggaagcaacgggcggcgcggtgatttgagcggcgctgctcgggcacgcggggctggatgacgcagacggcgcaggcgcggcacgggcggcgaccgcgcgggcgcgcgcacgcgaacaacggcgcgcgggaagtggcagcgtgggagcggagagggagggctcggctcggcgcggctcacgcgcacgcgcgcgcggcgcgcgggcagagcggagaagagggagagagagatagcgagagcgagagagagagagagatagccggggagggagggggagatgggccgagagagattcggcccatcgaacctgagggaggcgaaacagacttttgcggagggattgatttgggaaggatttggattcgggattgaactcgacgatagatcggggatttgagatctgagatggcacggacactagacagcaagcaaagaaacagatttcgcaaatagggtttttaagagatagttttcccgctatgtgccacgacggaacgggcgctacaataattgaatatatttttataatatatttgtcttgggttaaaaatgttactacttttttctacaaaattgatcaaacttgaagtagttgactttaaccaaagtcaaaacgacttgaggggtatacaacatggatttttattctatgctatgcccgactatccgtacattgcaatgggctcatgcagggatggattacgcatgctcatggtatccaaccatttgttttaaccaaccatttttctctgattttctttttaaccaaccatttttttcctagttttaagggtagggcggtcgtgtgtgcaacgtaaggggaggaaggagggcgactacgttttatagtagtagaaaccatgccaaatatatcaaataagagaaaagattacaaccgtgttttacaacatcagaaaatataaaacctagcaaatagagcatcttagattgccaaaagacatgtaagtagacgagcacatccataacgttgaccaaccccggtacgtgcaaaagcatatgaacgagcattggtcgccatcttcattcttttgacaggtcaataaaccagtatcaccaaaggagtctacaactcgaaccttgaatcaagtgtcgctagttggatcaccagcagacacctagattttcatcaaggttcacacaaacaaataaggcatcaacaaagagagataacaaaaaccaagatactctaaacgtatctaaaccgtagacgaaagacacctaaattgtctaatagatttaaacctcatccactttgttttaaaaaaccctaaaatcatagttactccataaggacaagagacatatacctttctaacatatttgcttgcctctcgacgccattgagaatgccgcaaaggagaaaggggatagtagagatggtgcatgaagagatcctcgagagtcgttagatgcaggagactcgccacatgaaagacttatgttttctattttgtgagcatatagcatgatgttttgcttgtcatattacatcaaattaatgatcttagccattagactacttatatcttggtcatttttctcaagcgtaaccatatgcgcacaacatactcacggacaccaaccacactctcccacatctaaacaagattagaggccttgcctctcataacgcaagaacaccactttaccactgaacataatcatgtgtgtatgtagccatgcatactttacgagattagattaattataaaaaatacgagcattgtatgcaagtttaagtttgagatttgaattcacgtggataggttccactatatagaccctaatcgatcgagctatcttcactcctcgctcggtcattctttttaattaaaagagtgcaagacacatcacttaggaaaccacgatagacctgcaccctgtttcaacaagtgaaccctatcaaaaccataaataaaaaggcacgtatttttttttgaagatatgtagttccgacacataggagcgagtaactatccatggtgcatacatcattcatgcacagctcccctctaaccccctttctcttctccctcattttaacccaaagatacgatcgatcaagcaacaagcaatcagggctctgagatttgcattggatcgcgagtgtgatgatctcagcgcatgagaggggcaccaaacctaatggaagcaatcagggcgtctctccggccggcccatgcaagctagcatagcagctagtgcttgctgatgtgccaagtgcttccatgccggcatggtgcgctccaaacaggatttgcatccatccatccgtgcgtgcgtgcgtgcatgcatccatcgcctctcttctcacctcgcgacccacggaaaatagtaccgctaggctttaagcctttaacttcatctgttgatctcgtagagtccgaaagttatacttttcttactagtgttttgagctctaccgtgtttacagcagcatatcgactgcaaccaaagttgaaatattaaatattaaaatatagagctaattttatttttttatcgtagtttattttttacatcggcttttaagtcgttagaataatatattttctctgttttttaattagatgacgccattaatttttaacacatgtttaaccatttatcttattaaaaaattttatacaaatatataataaataaatcatgattaaaatactctgagtgataaaaacaactcatancaaaataaattataattacataatttttttaataaaacgaatggttaaacgtgtgacaaaaagatcgttatctattaaaaacagaggtagtatgtaaacaatttcactcataattttcttaatagatattataaaatattgtcgtctttgtctctctctctctcatcagctgcatgcaactgaatgtatcctttcctggaaagtaatttggttgcttaccctagtcatcacaaaagcacctggttaattacgtagcatccggtttggtaataaaaaccaatgactcaatgaggaatccgtaagtggtacagtacaagattacgaggtggttaaagggacgggagtgtttaattaggttgacacacgattagtgagtggcctccagcgtccactacgtacgtgtttctgcatatctgcacgaaaagctaggcacaaagaaccttctgatcggtcgatcgatgagctctgcgtcagaattctatctaatccctcttgcgctcgcggcttcggttctctctgtctttcagcctgtcatccaattcgatcgcaacctaggctagctgctactggttgctgctgcctggtaggcacaagccaagatgaacttgtacacccactactataaaaatttacaacatgaaagttgccatgtccagtggtatatacactggacaatgtcttttgttcctggttgggatgagcagggttccaataactgttgggtaaaagaccagtttggccccagaaatatattcatatattcattgtctgaaaatgagataattgctttaaaaaaattccataatccagtactctatataagatggactgcttgttaatatatatactttccacacttgaggatctgatagagggagacagcccaaatacattgtaaaaacttgaattggaaaaaaaggtacaaatagataatacaaacttgacccctgatctttttgttaccatcttccaattgaaaaagggtacaaatggatgatgcaatttaaaatttgtgtgagtcgatggtaaaagactccaatcttccaagtttatcctcaaaactgacttccaaacaggtattcaaaaccaagattatcttcacttgaacaacaagaactagggagctgcctagctctgactcactgccactttgtggagtcattagacatagtttgatccagtgatgagcatatgctctcctttttttggccgcggcggccagccggcgagacgcggcgcctgacaaaagcaaaaggagatgaatatggacatgggcgtatcttcccagcaatccgatcctcctgccgtgcgtggcacatcatcatacattccacaacgacctccgctgcacctctgatgagctgattcggccatgaatcagacgcactgaaatgtttatctctctctctgaaggtcaggtcaatatccaggagaaattaagggaaagggaaataattacatacccaagccaagttagtgccatggtgcgcatgcagctagtttcatccaaagcagtgggctgatgaagccattagagctgagtagtttattagtcagctactgatatagccaagttgccatcgttgtgtgatgctccctgtagaacgacagtgtcttctctcttctttatgcagctgcagttccaatacatggacatcactgaaacaacaatttttttttgcgaacgccactgaaacaacaataacaagttaacaaccacaactgaagaacagaaacactatgaattgttaaatatgcatgggatggtttctgttggccggcattgtatattagaatgtttaatggaggtaatgctgttgttaaccttcattcttgcaaaagaaaagggttaatgctaaccttgtcacatgaggttaacagagagccaacaaatattcaattgaaatccaatgcttacatgcagaaggtgatgtcatttgcagcaatgatttgaggcttttgagatgctatattagattaagctattgcgtacattcttgcacatttcgagttcttggccacttctatcatgcgttctagaatatctgcgtttgctttgccttcacgaaaatgccccttttgttggaaaggagaaaaggattcatccttctttgctgcatcttatccgttggacatacaattagcttatctaagcagatacgctgcttaattcattattgtaatttataaatgaatgataaagtacatcaggtttggttctttacctgaaatcagctctctaatattttcagttcagaaggctgcacactttgaaatttactaatacatcccaactgtttatttttttttaaaaaaaagcaatagttcaatttagtggcttatttagttatagttgatactctgttgtcgcaatttatattctcttactgattaggcattagagttaagaaaaatactactccaaattttcttcgctgattgctccgaaaaacaatttcctgacttcagagtcaaccagcaccgagactaatgcactttgccaaaattcttcaagagtcggttgatagtggaaaccatactgcaaaaagattaaaaaaggtaatatttatagtatttcatctttttgaacaaagtactagaacaatattatgggagtgaagctatccactagtatagaatctcaaaaaatcataaattgagacttagcccatgatgtcatctactattatctgtctgtttcatcattgtaattgtacagtacagtctagataagatgccatcatcataattaagcatcagttctgtattacttacaaaaaaatggtacgaagttgcatgtgaataagttcagaatatcattgttgtatttttagttgagactatgacaatcttcaaaaaagaaaaaaaaaagactatgggctgtaatattcattaatcaatattacagtttaggcataaagattttcagcgtcaagttttgtccccaggccactgaggccagcagatggggccctttttcgtcaaggaaatccagttctacagaatttcagggtggagagatcaaggagcctcattatttgaaatcataaagatattccaagcgattcagtagtataatgcagaagcttctttagggaaacaccaatcaaactgccaaaaaaaataaaaataaataaatcacaaatcatgtattcatgttccagctgaaacctctctaaggctgtgtttgaggagaatgagatagagaagattgggaagatacgcaaaacgaggtgagcccttagcgtgtgattaattgattattaactattttaaacttaaaaaatagattaatatgattttttaaagcaactttcctatagaaaatttttacaaaaaacaaaaggtttagtagttcgggaagtgtgcgcgcggaatatgaaacaaactcactccctttattctccaaacgaacgcagcctaagaaaagtacttaataagtcgttcacatgttctgatcaagcacatatcaaactaaagactgattttgccagtccacctactgcgcttaaaaagttggttttgttgctaactgttcagctgaaaataggatgataaatgattgctggtaaccatatcaagcatttcccaagaaaccaatcatgccatgtcaaacagacacagaaaaggtctcatcatgtgcttcccctctatcatctggaagtcgtttggcatagtaattgggacatggaatagactggcctagctgcttaccatcttcttcatagggaagacctacatgctgaccatgccctacacaagtttcagacaagcctccctctgcggcgcacatccaagctctctacatgcttgcgaaacagcgaaaggcaatcaccaactcacaagatccgatcttacggtggccggacattgatggacacatgaagaacacgatgcgtccttgccagctaggggtccattccaattggctctggtgacactgacagtgacaccaaaacgcccttctgctttagcaagtagccacaaatccacgatgttttgccatctgagtgaggtacattagttcctccatcttccaccatggttggaaatctacccattctatggaggcatcattctattctataataattcttctaaatcagttcaaatccaacctcgaaaacatcataagaactagaatagggctagtaataatttagatcccagagaaggcaagcacgattgcacgaatacaagtaggtaattaagcaacagaggagcaatttggataagcagtagaaaaaaaaacaggattatatttttgggtacctgaggcgccaaaagaagaatcggcggcggcggcggcgcttgcatctcctgcatcgccgtcgccggcaaggctttggctgcgagttgcggcttctccgatccccatattcccgagaaatttcagtattaaccatccaatacgataacctttaaagaattgccacccaatacgttggcctttcaagatctaccaccagacacgcgaaattcttcatttcgtgccattccgtctgcttgtccgcgtcgtccgtctttgtcttcgtctccgagctcgtcggccgtcgtctcaaggcttgaccatcatccctgagctcactcccgtcgcggttgccagcgagagacattgcaccttcgacagggacgaaagagcacatggttttgtcgacgtctagatggtagacggggacggagtttgcggacatggcggttcaacagcagaacacgaactcaggggcgacggcgacaatgatcggatgagagcttgggcatggcggcaacagcggaaagctcgggggcgacggcggcgacagcggaacgtgagctctggggcgacgacggcggcaacagaacgcgagcttgggggtgactacggcggcgaccggacgcgagctcaggcatggcggcaacggcggaacggaatgcgagctcgacgacagtggcagacgagctcagggacggcggcgatagggcgcgagcatagcaacagcgctgaacgagcttggggatgggaatggtggcgatggaggttgggaacggcggtggcgacggtgccgaacgagcttggggatggggacggcggcgggggcgggatgcgaggtgacgatgaccgtgcctgggcgacgacgccacctagctcggagacagtcgcgcggatggacggcggggcaggcggacggagtggctccaaataaagaatttcgcgtgcctggtggtaaattttgaaaggccaacgtattgagtggcagctccttaaaggtcatcgtattggatgataaatactgaaatttctcccatattcccagttggaacggtaaattctacaaagtacgaggactaatatgcaaagagttatctttttctccttccaagccgatctgtaccgtccgccaacacaacggtaatacgagatcatacgagggcttttctgcaaaaactccacaatggcccgagggaaaccctccatctggtcgtttattttcgatcgaacggtgtacatcgccaccgggagccccatttggatcgccagaattggtagtgatcgtgtcaagaggtgggccggagtaattcacacatggtccgggccttatccttcacgaagagaaccgggtgatctggcccggcccaaacaccactcgcgatctatccgcacttgtctgcgactgcgaccacatcacgggggtgggcccacctggtcaggctagctaccacgcgagccgcaagtacccatcgcctcgtcatccggagagactagctcccactttccagtctcccgccgccgccgccgctgttcactccgcaccaactccgacgatcccccggcgagctctcgacgatggcgacggcggcgacggcgtcggctacggcggccacccgcttcacgcggctggcgggggtcgggctccggcgcacggcccgcctccccacggccgtgcggttccagcgccgggtgctcgccaccaccgcgctcctcaggaccgccgagctccggcccaaggagcagggcctgcccgagacgctcgactaccgcgtgttcctcgtcgacggcgggggccgcaaggtgtcgccgtggcacgacgtgcccctgcgcgcaggcgacggggtgttccacttcgtcgtggagatccccaaggagagcagcgccaagatggaggtcgccaccgacgagtcattcacccccatcaagcaggacaccaagaagggcaacctccgatactacccgtaaggactagaaactgaggaaattcgtattctgaatgtctaagtttatgttcgtttctgctgaaaatattgcgtcttttgtgttaaaattggacgagcgacttgcaaatcgaggatataacggccgtttaatttaactgggaattccttctgagatcttcactccacaagtggatgccatgattagtttgcaaatgtaacattttcttttgtgtccatgcttgttcgtgtttgagaattctagaaatccttaatgttgttgcatgagttttgtttatttaatcctatcctgtttgtttaggatgtcgcatcttcttttattaataattttagtgtattagtgagttttttttttttgccgggtcggccgaaagattcggtcgaccaaatttcattaagaatgggggaagttgtattagagagtttaattggtctgtttcaattgttgtatcaattgttgataggttggtctttaaggatagaatagcaactcttttcataccagaaattcatgctttacaatatttgttgtgggctggggaaataatgtaggagattgtgttttttatgtggtgctctttcgtgggaccttacttcagtgtgaaaaagatgggctgcttgaattttgtcaatatcagactgtagctgccaccaccttgtgcacttttgggattccataaaagaacattttgttctcccatgtttggcggtggaatcacacaaggtataatgtggccatcttagatatagcagatctttacaaagatgtgatgttaattgaactagctggatttccacacagttttgcacagagctaggctaaagtttattcgaaagcagagttggattttatgtataactgttgtttctgtttctatacattcaattttattttgtatacaactatatcaatcaatctacactttataatttggacaaaccatgataaacaactgcgtagatcttactctttttattcagttaatatggtaattttctaggaccttggagcgaatgcggtgactcttgttagccttctctttatcatataatagatttagctgacctgctcttgtcatcaaaactgtgctacaagaaggtttgaatttcgtctgctttcaagttcaaccttgcagtcatggttctgtataatttttcttaatcaaaacaatgctaggctgttctgttacttccatttcagtccttttgaaaaggattagtgtacatattttgtggacaggttccttttccgccttatagctggtatcaaccttgcagtgtgaaacttgcttgttggcaagcaattgattttatgctgttactggccttgttgatgaacattgtgcatcttgtccttgctgaccctgtttatgaactttgtgcatgacccatcatggaattatctggtatatcaggtacaacattaattggaattatggattatttccccaaacatgggaggacccaactcttgcaaacaccgatgtcgaaggagcatttggggataatgatcctggtaataaacatttcggtgtcattgtatttggtagatatggctcatatatcatcttcagccactctgaccaatcttgctgatggccttctttccagttgatgttgttgagattggtgaaagacgtgctaacattggagatgttcttaaggtaaaaccgttggcagctttagcaatgattgatgagggtgagcttgactggaaaattgtggctatttctttggatgatcctaaagcatctcttgtgaatgatgtggatgatgttgagaagcattttccggtatgactgatgcctgcctttatttttagtgtttgtccttgttctccactgattggcattgcctatctcgttgatagaatgtaggctttttttcccttagattatgacaaatgttttctgttttgaattctgaccttggctaagcattttttaaaagcaaaacatattttagcaaacttaccttttattcataacatgagaaaaagacagatgtgttactcttgccataattattatcctagattcctagttgcgcacatccttttctaaatgactactgcattaccctgaagctttttttttgctgaggttattaggttttttcgcttggaagttttgattagttttgcatttaaaatatgttacatgggcagggttaaaaatgttgctaatgcagttagttttcaccccctctatattttacaattgctttgtccgacattttacattacctattcagggaacattgactgccatcagagactggttcagggactacaagataccagacggtaagcctgcaaacagatttggtctgggcaacaaacccacaagcaaggtaagcctggactccttcagttatatttaaacatagaggatatttttgcattctgattgtataattctctctcctaggaatatgctctgaaggtcatagaagaaaccaacgaatcatgggagaaattggtgaaaaggaatatccctgctggagagctctcactagcctaatcttgtccatgagaagccatcagattcttttggtcatttacctaagcatgttgttttcataagctataagcatgctgcttcttgcgaactctttggtgacctgtgtgcaacaggaacagcttgtggagtgaataaggctttctgagctagtttttctaagggaattgggtgttcttgagcagcgattgtgtttggaacaagctttacaaagtgaacaatcagtttagaagttgaatgataagcaaatatagtttcaacattgtaatcattaaccaagatggcctaattgttttttaccacaccatgtagtaaatatcgaaatgctgaccccttacacttgaaaatgcactaatatgacagatacagaagttagcatacgatttacaaacaggttaagccactaaatcattttcacatctaaatctgacgggagaacggccaaagcaaccgttatgaacctaaattatttgatacagtcgaaaatgagttccacttgattcttggcctcgtcaatcatcaaccgagtacaatgcttcgaccagccaatacaaaaggcattgcagatatatgtaccctggcctcgtcaatcatcaaccgagtacaatgcttcgaccagccaatacaaaaggcattgcagatatatgtaccctggcctcgtcaatcatcaaccgagtacaatgcttcgaccagccaatacaaaaggcattgcagatatatgtacccagacccagctctatctaaaccaccatcttgtacctgcaaaacggacgttggtaagtgtcagttcagtttgtgaacaatgtgactgactgcaaggtaagtgtcagttcagtttgtgaacaatgtgactgactgcaaataaggtaaattgagatcctgagagcaatgaagtttgataagattcttttcaacggtagtgcaccaaacatagaaaagctgcattgagctgctgagctcaacaaatttgactaccgcagtaatacccttatacccagcaagcaccaggtacttcgctatataaaagatacccaacagatatgcctaaacatcaaacattctataattctatcaaataagaacaaaaattcagcaaaaaagggaaacacagtacatcctatgaatgaagatatatgtagatatagtcatatagatataatgcatcacgtctccatgatgttaaacaaagctgatcagatcgttaataaagtttggcaatgaggctggcaaaaatcaatagccggttcttccattaaaaagaaaactgaggtagtgctctaacgctctgaagagacgaaataataatcaactttgctataggtgtcaaacgaagcattcagctgcatgcagcatgcctattaaaggaccttggtgctcagtacttaaatgttcctttcaacaccctgttatgtactactccactaattagtatatgaccttcctcatctaattctcgatcactataggttacttcaaatatgttatctcttagtcatcaatctcatatgtaatagctcgtgtctaatatttcgtagatgtatctctctgataattttgtttccctaaccaagcagaattcaaaatttcaggtgcacatatctatatctggtctttcaggtgcccatgagatagccaagtagcagagccagaaaatatatcctgtggccctgtggggtcaattattgctagtccatatcttagtggggtcatttcttcttctctctttttacccttttttttttggacaactgtacggcttatgtgtttactcctgccaaagccaagagaccaacataagaaaatacatggcagaattctctatgccatggacttgatttggcaatcacatactttattggagaagttttttctaaattcaaacagttttatttgaagtagcttaaaaacctgggtttgtgacctctcacaaattcattttctgatacacctcaaggaaaaaagtattagcaaagatactctgttggcttggttgttggttttgacaacttaattgagatcatcatcatcatatggcttatagcatgtgctgtatttggttattagatgtgtatgaagttatgcataatttattgtgtgtcatctccaaattctcctttcacgctactattccatctccaaaatccaaactatccagtcagagacacaatatacatactagtagtgcataaaaactggggtgttgcagccatttaggattggcatggttgatttctggctttgctcaaggttgatgcaaagaatatgtaaagcaagtatgaaacatgaaattctctaggcttttttgaccacagaaaccaaaatcaagctgatattgcttgcttcctgattataagactgttacttccatcatgctatgggaagcataattgcttaatacttcgatctgtggtgtgctgatggagaaaaatagcttctttgctactttgtgaacagacgacagaccacacaatcgtgttatcctttttggtaaaataccccaacagtcagcaagaacaatcaattgccgagtaatagattgtataagttctactgtaattgaacgaacgagcaatgcgttaacgaattctccagcgagaagttggactagggaaggaaatggcagagtttggataaattactcgtgtagatgacagtcatacccgagctaaggcccgagggccttgatggcgtccatgagcaaggcgtagacctccttggccagatcatgtcgccgcatctgcgtttgtatctctgaatcaagctgcctcctccacttgccctcgatgaatcttgcttcctctgtccctagcagtgacaaccccttcgccagggacacactggacagcgctcgcccatccgtcttccagtactcatcaagcatctcagtcagcacaggcagcatggcggcggcgtccgggacagtgcgcggctggtcggcggcggcggcggcggcggcggcggcggccctttcgtcgtcgccctcagcaaggggctcgaggtcggcgccccagacgctcgcgcagaggtcgcgcacgcggcgttcgtgcggtcccgcggacgcgccgggcgccgcgtgcaggtacttgcccttgagccgcttcagcttgtagtacaccttggcctggtcgatgtgcggggagagggagcccctgatggagtcgaagagcgcgcccatgtccgggaggcgcgggacgtggccggcgcgcgcgcggaaggcggcggcgccggcgaggagcgcgacctcgtcggcgtcgccccagagcttctggacggcgcccccgtgctgccccccggcggcgggcgcggtcaccgcggcggggtccgcgaacgcgccgcgctgtctgcgcttgcgctcgcgctcgcggctgctggaggaggccggcgcggcggcggcggggggcgggctatggttgggggcccggtggcgcg

SEQ ID NO: 56099 - DNA, 6026 bp, Oryza sativa
tgtgcgctctgtatacggatgcctgatggttttcaggccttcgggggagagtgtgtgtgcgccgtgcgcgtcaacccgatttggccgtggccgtcgtctctgatgatctgatctgcatctactagtatattcgccgtgctgtgagtcgctttttctgctggctgtccttttgaaataaggccttgcatagataaaaaaaaattagcaaaaaacgtcacattaaatatttggccacatatatgaggcattaaatgtataaaaaaaccaattgtacggtttacatgtaaattgcgagacaaatcttttaagtctaattacgtcatgatttgacaatgtggtgctacagtaaacatttgctaatgatagattaattaggcttaataaatttgtctcacattttacaggcggaatctgtaatttgttttgttattagtctacgtttaatactttaaatgtgcatccgtatacttcaaaaactttacgcctaaagaactaaacgcaccctaaaaactatttgacagcactgtgtagtttgtagcttgggcctctttattctccaatctccatcctctttgtaatggtgaatggtgtgtatatttcaccatttctgttaggtgtgcattagtacattgaaaaggctagatacattggaggaagtgaatctggtatacacatgactttatacctctcatcatctatactactactagaacacttgattttagaaagtaatgagtataattttccttgatatccctacgactaggctggaagctaagatatcggtacaattttcctcaggtcacaagatagcgtacggataacactgcgtgaaagggtgactagaaaactagttggtaggttggactggctaggaaatgacgtgtggttgtcgacccgctagaggctagccatgggaaggttgctcgggtctagtatgtggcaacgcgcctagctcgagaccattcacgggaagattgctcggaggcgacagttcaggggccaatgcgtccatctcatggtcattcgcgggaggattgctcgaggacgcgaatggttggtcgcgtgggcgccctcggtgggggatcacatgaccacgctctaacaacaggtacaaatgaagcgtgcaatagctcgctcccatcattccacattaattaggcatgctcaccgcaagtcaaaggtatttaatgtagggatttggtgtatcacgcctcacccctcatgtctcctttctctccatctgaccaagctataccgtcagggggaggcctagtcacttctatggtagacctgtggaaggtggcatcttgtagcatggaagaattataagtggtggatggtatgatagcgggtacggtgtaggtaatgatgtatgactatagtacctttgtcagttatcccatggtgattaggtagattgtgggagagtatataacttataagcaccagatagatcaccgagtgaaaggttcaactctcctagatacacaagaacacaacacgtagaagttgtacgagctctggacttagccagttctaacacacctccggtgcaaaaagttgtccagatattaatcaagaaagcaagaatataactatcatctctcgagaggcgcgaaaacctgggtaaatcaagtgtgtatgagcttgtttagtgctaaaatatgcgatcatagcttttgaccccatctccgaacaccaagtttttcggatcctatttgcccacactaggacacttagaaactagttttataaaggtaaggttttcttactaggacacttgattttattcaagttacaatatgttttatcaagtgcaaacttatcaaattacgtgttttataaatgttttcttacttaggacacttgattttcttcaaattacaatgccacataaatcagggataaatgagaaaaacacatcaattatcgtgggtgaaaaagcaaacccttatatggtccatagccaaggcatgtctatgccatgttgggttatctttgtgtttttttaggtgaaagtgaatggaacttagtgggccttagcatcaagcttaatgccattatttttgtgacctaaggtcaaattcacttataaccatgggcccataactttacaatatggtaacattataatatttaccataatatgaagttggtatatacacctacagctgtaggtcaataatatccggtaaatgcagaaatatttgtctatgctctattgtatcgacaaacaatctccttagtgagcatagcaggaaaggtagaaacgacaagaatgtccaaatatccagtaaatgtagtacgtgaattattgtcgtttactaagactggtacgataaacgctatgttgcatgcatgtatgcttgcacgctggaaaacaaaatggcatgcaagagagtgtgagtgattttggagcttatctcgtaatgttatatgataaatttgataaagatcggataaaaatacatgtcatgtttattttggcatatttgtgaaggtgtccatttaaaaagttataattgactcgcaaagtttcatctattttttttgtcaaaactatatacggtcaagtggaaaagaaactatattccaaattaaatgttacctaacccaatcatcttcatcctttaccaactcccttataaaatcgttatcttaaccatgcatagttcattaaaccgtcaacttcattgaaacttctccgctaaaaaaactctgtagattcttgaaactcattcattaccgcaacgtatttattactgtttttaaaccaaatatcaccacaatgtaaatttcattttacttgcaccgcactctatttcgaagttacttcgatacctcacgttattgctagcgtgaagaggacggtgagtaaaggtgcctgccggtagtagtagtataacaaacccaacgagaagagcagcagagcatatgctgcgtgcctcccgtgcaaaaccgaacccgtgtcctgacgccgcgagcctctcccagccccgcccctctctcccatcggatccgagcgagactgacgcggaaaaatcgggccggaaaggagtcgaaggaagaacagacgcgaaggagacactcttcaatactcgggctcgcggaacgaagccctagcgccctagccctagccctagctccgccccccggtcctccgccgccgtccctcctcgccggaggccctacccccgacccccgccgtgttccgcgggggcctcggcggcgatgcccccttccctggccgaggctttatgagcggcggccgccgcggggagatggcccgcgccgagggcttgccggagggggccgccccgggcgtcggggtggacctgtacgcgcaggccaggaaggccctgtcggtgcggacgccgttcgagggcgaggggacggcgcctagggttcccacgctgcccgcgcggctcgtgaactggtcggggcagagcgacgcgcggaagaagcacaagaagattcagccccaggacgtggctgatgtggagctcccgccgcagccagccacggagccctctgcgaagactggcgtgtgggagcagttcgaggcgtatttccggccggtgaatttggatgatattgatatgttaatgccaaagtttccgttcggctatggcgggctcgattcgtgcatcctcataccatttgtgggcagtggcaaggaattgatggacacagctgagacatttgatgtggctgtggctgaaacaagctcgtacttgggtctgggtggtgaagaaagagtcagtaacaaggagcatagcgaacggagtgagcgaagtgagcaaagtgttgagcaaggcatacatgaggtgattgtgcgacagttcgttggtaacaaggaacgcggtgagcagagtgtagagcagggcatacatgaggtggttgtgcaacaggagaattggccattggaagtggagcaagctactagcagtgctggcattgtatcatcaaaatgtgaagaagagggagaatcatcactgaattggttgctaggatcaaaggaacggtttgtgctcacttcagaacggcccaacaagaagaggaagcttttaggtgtggatgcagggttagagcagcttgttctgctaccgcgctcgggagctgaggctagttctgtatgtgatgtttgttgtttgggggagagtagtacggtgtccaatagcatgctcaattgcaaccgctgtaaggtaactgtgcaccagaagtgttatggtttgcatgttgtgcctgatggccagtggttgtgcacttggtgtaaggatttggagtcactgcagtcgttgaagaaagatgcggacaacaccttgtcgatgccttgtgttctatgcccaaaagagaaaggcgctctaaaacctgtcaaaggggagcctggtcaaacagcgcatggggggaaccttaaatttgtgcacttgttttgtagcctttggacaccgggagctcttgtggaagacatggaatcaatggaacctgttactaatgttggaagtgtccaggagaatcagtggaaattggtgtgcagcatttgcaaggttaagcatggtgtatgtgtccgatgtagtcatggtatgtattttaccctatgtctccattttactattttagttagatgaactatatgtatatatacatttaagttatttagaatcagtgttttgcagataatttttcttgcacacttccattttgtaccaccgcatagaatttccctgcatcatgcttctactgcggtctcgagtttcttaagaccgagtcattgcttatttttttttcctttcttcaatgtgggccttcaaaagcaacctttaaatttgcctttgaactggaagatatgtagcaactttatcggtctattcaatgaaaaaccgcaaatatgctgtcactcaggtttacctgaggaggtaattctaaatcaggtgttgcacggtagcacaaaattcttgctaaaatagctgggcagtaggtgtgtttggttccttggctacccttgctaatgcacaatgaaatcattgctaggagaggagagctgaattgtcttttcatcaaaaaatggggaacactgacttgtgtgtccattaccaaaccaagcaaggcaacccagtttccttgtccactgaccttgctagataaggatgagcaaagctaccaaacatgccatttatctcatttctggtgataactttccaaaggaagtaatcctcatctgaatggatgactttgctcaactcattaactcaacgtagtttgtggcagaagtattgctacaccatacaatgatggaatattgctggcaaagataattctatgtttggcatgcgggaatttggtagaatggtactttttcatgcaataaataatgggtttacattgttacctttgttggctttatttaaatatttttcgtatatatagtaaaaagaaatgtgtatacagatatccattttagttctctacatgccaggttatcttgtaagttgtaactgcattttacatgacagcatatcaaaatgataactgggttctagtccaaccagttactatgctgctgttaatgatggataactgcatattagttagttatacctatacccttgtataacttttttgcaattaataactgaaccaacttttggggccacacacattttgtggctggttcactgaaaaactgtccactttggccagggttttacttgttcaagtcaggctaactgcttgaatgatccaacagcgtgccagactggctgggatctggtccctttttttcctttttggactgccaggccggtctggttctgataagtgtggtttacattatgtattttttgcgaacagatacataaaaccatacatttctcaatgtatgcgaacatccataatatccatttttgaagagaaattggaaaacgccatcgtaaagatatgcaaatagcaaaataccatcacatgtgagaatgacacatagggcatgggcctatatatattattgccacatatgataatatttt

SEQ ID NO: 56100 - DNA, 898 bp, Oryza sativa
ttgtaaatttgcaagtgttgatttaacactatttatatgtttattgctaaccatttaaaatattgccactctttagtggttagttaagagtcaaggtatgtgtgctgttattattattggtaatactgaatttgttgacttgtgagatgtgatagggctggtctgttcctctatatctatctgttttgtcgcaggcatttaagggccatagtgtatgccttctcaatttcttctgtttatgttctggtttatgggcatttacggctatttggatgtcttctcaatttcgtctcacttggatagctgttgctgcaatgctatctggcaatgcatttgccctttcttcagatatcattccctttcttccattatccggtcatttgtttgcctttttttagttcttacaatatgttattacaggtacatctcctggaaagaaaagatataacttaactgaggctgaacctggctcggagctggagggtgtctcttcattgaatcaatattttcctccaggtgataatgtaaaacatgagttaaacttggttgaaaatggtgttgggaataaccatgattgcaacgcagatcatgttcctggacagcccttttccaagtaagacgaaagaaatttcaaccaattgaattatagttgttcttctatggttttacttcccttctttgtttaatgtgacccccttccttattttctttttctgcatgctctctggaagatcttaactgctgttttgctgtgtgcagcttcaatgattcacactattatatccatccactcatcaaggaaaagatgactcagctttgggacaacacgttcaagcaagataagctggcaccatgtcaccctggtaaagttttaagggcttgtcctagctaactactt

SEQ ID NO: 56101 - DNA, 2772 bp, Oryza sativa
actaaccaaaaacatttggctaccaacatgagataaagccatgatagctcactgctgcctatggccacaaatataaggaaaccaaaatgacctatcaactagagattgtcacagaatgatttgtatatatattcctttaaaaaaactcaagtggtggtggtgaatggtgaatctgccttaacctaccactatgatatctcctgacatgtgggaccatcaaatagtgatatgaacaagtaggtatactgtgttaggtatcaaaacaataataagagaattttatacaaagtatttaaggggaagatatcaaattccaacagcaatatgaattcttggattaatatttgaaatggtaatgatatgattttttttcttttaattccattaaaatgcaagggcattcagctagcaatagtcaaaatcagctgattccaacctgatgaggcaactctaaaccagtgtcatctggaaataagttgcataggatatcatggtccagcccctttgaatcttcaattccaacacaaacaacgttcaactttgccaagtagtcgaatctcaggaccatgagcttacgacgctttgctccagactcttcagtgtcgtatacatggagaataactttaaggggatgaagttgatatgccactactgaattactagcttccttcacaacactttttcttgaccttgaccttcttctttgagcatcttcttcatcatcaattgcatcgtcatccactctattatcaccatttgacaaagtgccagctattgcagatacaaaagacacgctttatcagaaatatttcctagtctaccacctttacagattataacaagtggaagagaaccattagcaatctgattctaaccattatacaagtattgaagcaagcatgcattatttacatgcagcttcaatttgtaatgaggaactaaaatataacagcttccataaaagaccggggcttctatactgctatatgagaacgaactgtttatgctagacacaagtatctactaggaaattgcatctggtcatttaatatgtggctacgctacattgcttttctaaaagtagtaaaaaggatcccttacatatcatacggtacatgagaagagatagaataaatgtcattaattattgcgagtattgcacttctgtaataggaaatcaaataaactatattccaatgagatatgattatatgaaccaaccattttcctgcttagcttgctgttgagcaaacatctgagcatcctttgtgcttccagtgatctccacttcaatattctctccgaatgcttctttctgtcctaaaaactgcgtgtaaactatatatagaggagttggaagcagttcagctgcatgatgctgctttagtttcttggtatgttgcatccccagctgctgctgcactggcaatgatgctttcttcagtgatttcaaatgggttgggaggctcgaaaggaactttttctgatttgcaattgtgtccaacaaactgctcttccgctgctccaatttctcatgtagcttgcatagctctttccgctgtttcagatttcaaacttactttagatatcagaacaaatattgggacccaaacaaatcaagaccacactagcacaaagggagtaagggacttttgtcctagcaagcaaacacatattcaaacaactagaggtgataaacaaattaagcagatcaaatcatatccaaaaacatactacaaaccttgatcactagtcacacaaagaattatcagatttaagaagaattatgcaactgactaaaatcaatatacataaaaagagtttccataacaacaaagcgttctacttaagaacagtttgatatatgagcactctaaactacaaaaataacggtgaatttataaaacattttctatatatacatttgaatttttggagaaccaatcctgcaagccaagctaaatatttacgttaaatttactagcaggtcaacccagctacgatgtgattctttctttcgattattaccctgatccttcagaacaaacccccaatctaaatgctcatacaatcctgtacactctctatgatgctttaatcatttagacgaacaatgaacaaagcacaagaatttatcccatgacaagtaaatctcctatttgtgtaggaactgaatcaactgatcacggtacacaacctggactagctcgaaattgaggcgcttgagcatgaggtcgtgggacgcgtcagcagcgagcgtcttatcgcggatgtccgccggcgcggcgcggtggaactcctccgtcggcacgagctctatgcccgggtacttggtctggaagtcgaggcacgccctaatggccttcacgtagtggttcttctcgtacagaaggttgtgcagctgcagcgtcgtggagtccacgggcgccttcgccgcctccgtctccgccttcaccctgtcctcctccatcagtatctccctgttcgcctgcgcaaatccaaaccctcgagtgagcaaacagcagatctaacgcgaggggttcccggcgaagaggcgttgcggattcgggagcggcacggacctggcgaagcgtgatgaggaggagggacatctgggcgacgagctcccggagctcggttctgggggcgtcgtccttcttgatggcgaggatccgggcggcgacctcctccacggaggcgcgggtctccgcgaggaggtcgtggggggacttgcccttcgaggtggatacagtgctggtggtggtggttggt

SEQ ID NO: 56102 - DNA, 912 bp, Oryza sativa
  unsure (1)..(912): unsure at all n locations
atacatgagaaaagagaaggaacccttgtcttatatgagacttggtttctacacaacatccaagacatcatatgagataaatagcattaaatttaaatatatatagtgatgtttgtattggaatagtagtgtctagtaccagttttttaatgatgtagagtttatggaaactatgtgtagtgttttgagttaggaataccctaatatatcaaaatttacagcgtgttcgctgcaacgaacctggggaagaggcggagccggtcgacgtggagggcacgtgcgggtagccatggaggccaacaacggtagcagggcggtgaataagtagtaccgtgattcttggtcaggctgaatcttgggtgtgtgtatttattgagtaatcagctaatcttgatcggtaagcataacacgaacaaattgcgagtgaaagccatgacttcgtgatgtttccctgcaatcatctaaaagaaaacttacaatatgatatctcacttgcggcggcctatctctagtggattcaccccaatgataagggcggagtcgagattgtgcattgtggagaagaagacgaacataaacactccgtgattgtatcagtaaactttctttgccatgtatgatcatcgatcactctctggacgtccgactatcacgagcggttcgtccgtgatctgttgagtttattatacgactacgagcgtacaacggacaggctggtccgtgatgatccagcgcaatcatgtgtaccaatcggccctactacaaaagcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56103 - DNA, 6411 bp, Oryza sativa
  unsure (1)..(6411): unsure at all n locations
atggcacaacgtagaaagtaagtatttgtgtagtacaattaagtggtcctttgaacaagatattgcctagaactcccatatttttctaatgagcaaacacttaaaagttggaaaccatttctacagtggaagaccaaaatcccctagtaacaaatggcagtagaaaataatctccatctaatctgtcataagttctgaaccttaatactagtagaattctgtttctactgataacagaactcgtaaatcaaccgttggtatcacttcaattcatgataatattggcaacaaaatactaacagtaatgactaccgtaaagttactcaaaattcttatctgctacgaaatcctaatgtcttcaggatcacactacagttattaggctttatttaacgcttcacctaattgaataatgttttttcagatgtactaaaattaagtgggacttaacatgtgtttttttaaaaaaaacacttaggctgagtttgaacctgtaggttcggaacctctatttggcacgaaaaacagagtacctcattaacaaatgattaattaaatactacaataaaaaagtaaaaatagattaatatattttttgaagcaaatttcatatataatttttttcagaaacgtactctntagcagttcgggaagcatgcgtgtgaaaaagagagagtagaagattagaaccatcagtttcgaacgcgcccttagaccataaaggttgtggttatacgacacaagtcataatacaataatacattgatttttttacgaactttgactatgtttaaacatagtgtaaatttgttcggagttgaaaacccatttcaacaccctagaacccgtagttacacattgcagtagaaaatgatccccacctaatttgtggatcctctaatctgctacaaaatcggaatgtcttcagaatcacactacagttattaggcaagcaaagtttatttcccagcagaggcataaactctgccttttccaaagccaggttaacatcaccttcaccccctccctcacatgcaaaacagaaaaaccacagcactcaaaagcgatcgaagttgagccgagagcggctgagcccccgcccccatcacgctaataatcacgcacgcaagaggaagcttccctccccatccactgtcccctgctcctaatgcattccagctctttgccgcgaggatgaaagatcttcccctctttctctctctctctctctgggagataatttattcgagctgtccttctcgctttgacgatccgacgaaccagaaggaaaagaggggaaggagatgacaaaaaacgatcatccctgcccctgtgtgtagcgatcggattgcatcatggggttttttttttttcttgtgcgagctaggctgttaaaccgcgtcgccgtgggggcggcaagacggcagctagtttgttgtcttgctcactcgctgtcttgctgacctctgagagaccggttcttctctcgtttgtctgatgaggtagacgcctgcctgcctgcctgctactgctggtgcattcatgtacatgctgtgagagggacaagagttccaaaatgcgacgataaccgctcggttctcgggtttattggtgttgatgtgttgtgaagttgatccatatttcaaaattatccaaacaaatgttcaattttttgataaaatttgtctaagttccatcgtgtttttatcggtttatcgtggttgtcaatgaaaccggtagggggtagtattggactacctgtcgtatttgtaaattatagggagagatattcctagcaaagtgtgagatttgaaggcgtctttttaatgaaacgtctctctgcacatcgcaatcgactaatcgagcgatgtctaaacgaggtgacgttagtctgcttgaaaaatgaggctggtcatttttggtcgctatctcctctttgatcttggccttttgaccctcctggatttcaggcttgtctacgtagagggttacagaagaccagctgtcactacctcttttgtattgttggtatacgtggcaaattgctagggtgtgttttacttacctgtgtgattatactagggattggtcgtgatcaggttgtgtcatgagaacaatatgttcataccaattctttttctttctttctgatttttttgtcttgcactggcattggtatggaggctatacctactcgtcggcaggttggcttttttacagaccaagttatttaggagatactcccaccgtttcaggttactagatgtttttactttcattatagttaaactatttcaagtttaactaaatttataataaatatagtaatatttatcatgctaaattagttttatcaaatcaataattgaatatattttcataataaatttatcttgtgttgaaaatgttattatttttttctacaaacttggtcaaacttaaagcagtttgactttgaccaaagtcaaaacatcttataacctgaaacggatgaagtacaatagtggacatctgttggtgatgcttttagatactctttgtgtatttttcttttcacattatatttagatagagattatctagttatcaatcacctgaaaacaacagaaatttcactcaattttttttgggtggataggattgcaaataaaccctcaactctaacctcgtcaccgtcgctgtgcatttattgaagaagagtttgtcgtcgctattgccgtcgcagttgatttaccccttctccctcccaaaatccagtgctcgattgaaggtgagtgaaattcatagtaatttcagtcactttaaatctcgcaaatcccatttaaataatatgcaaataacttgtataatttttggccaaaagataactcgtaatcccatttacataatatgcaaaaaacaaaaagttgtacagttttttaccaaaagataactcgtacaatttatttttaacaatgcagaaaatgtaatattgtctataaaaacgggtacatcgttttattgttcatgcatttaacagtttattgtatgctacgtgtcttcaattttttttcatgcgccaaaatgtgagatcggtgatatgaccatgtgtagttgtgtactcatgtatctgtgacatanaagaaggggtttggcaatatctgttacagattgctcggaaattcaccgagattccggcatttccaaacatgcctgactgaactgcataccaatcatgtgagggtaacacagtcaaggcaaaagaaaaaatagaagtcctatgttgatatgtgttcctactttgaccagtgatatcctgcgtaagcagataacgctatactctccttgaacacacacatcctagccaatagccaccatacagaagaaccccagctagcagtgatccatatgctctgcttacctgcctcccggaccagcagagccccttgtccaaatcaacaattccacacccccaaacacacaagaatcaccgtgactgataaaacaagtacagagccgagctgcgaggtatcttctctgaccgagcagatccatctcaccgttctgtcataaaactaatccctttctctaatccctttcacactactaaattttatgcattcccttatatatccctgaattttaatttggatttcttccatacccctttttgtttagttatcgtgagttgactgttgtattcctatcaaaaagtccatttttttcctttggtacgaagaaacatataagattatgaaatacttcatccgtttcatattataagactttctagcattgcccacatttacccacatttatatatatgttaatgaatatagacatatatgtgttcctagatacattaacatctatatgaatgtggacaatgctaaaaaatcttataacctgaaatggaggtagtatattgttggaggatagaaatttgttatttgagactattatatctataagtttattatgcaagatattatttatcacaaaatttacttgtagatatggcaaaactaatatttatttattatagttattaaaaattatttatgtagcatataaatagatttgtttatatagcaaacatgttgtactactatccacaaaataaactacatatacatttttaataattaaaaaataaataatatttttatgtcatatctaagaataaattgtcataaataatatcttgtattataaactcataactataaaagtctcaaataataaattcttatattttacaaatttagagtatttgtttttcataccatagggtaaattagacttcttcataagagtttaactgtcactgacgtaaaaggtatggaaggaatccaaactaaaattcagagatatataagaagatgagcaaaattcaggaacatataaatgggcaaattttcaaagacacgctagaaattttctaaaaaactaatcaacacacctcaacctttaaaaaacaatccaagcacccatcccagaacaagttactgttctttagtcttcatgaccaatcatgtgacatgcgcacacgtactctgtaccacgcatgcacgctgctggcacgatgatatcgtgtgccgcctgcacctgtttggtcagtactgtacgcggtccgagcatgaacaatgtatagtggcctcgaggtttagcttcgaagagagtgtgcaacatagattagagcaaggctaatacagccgacctgttggctataaggttctttgtagccttctcttagcctacccatataatagttagcactttattgttaatacagggcccacttgtctctctcacagagtttcttggtccttgtgtccaagccggctataagtttacagcccgcttcttctctcttctctcctccacccttagcatttagccagcttatagtttaccattatacttgctcttaaagataaaatcacaactgaggatacctcattcccaatgcccggtgatttgaatgggtctagaaaaggatttgcttctcagccttacttttttttaagcaagaactagctctatctattactatattatctataaacaacttaatagtcttcacatataatagttagatacatatttattgcattattgataattggtcacaccttattcttacaaaatttcttagtgtccctgctggaactgattacaaatctatcgcttgtttttttttctcttctcttttctctcctccaactcagtacgaatttgaggtggcaacttctatagctcatctatatcaatttattgtacatgctcttacagtctataaaataatttaactttgatacaaatatgcacattaatcccttatatcataaatcattttataacaatgcactggccctcgtgtcaggtgaacaaatactcctctgtccttcccctagctccattcctttcttttttgttcttcgatatatgcatgttgccgaccttctcaactctttgttgctgttgtcctttttggctctcgatggcaccgtagctctgtgctctagatttggtcactgcccttctgtgctttgggatctgtcctccaccgtcgtcaccagtggtggagctacatgttacctatggggtcagggtttttacaaaatagccaaaagctattgatatttgggttgcaacaacagaaaacttgccatccatccctcgtgacttcaaccagccaccatagtgtctttgtgctccaaacgtggccgccccgccactatgctcaccgagtatcgattcaccttccaggcatagttattaggaccggaccggacatcgaaccggtcgtagcctcggttcgcggtttgattggtttgattggttgaaccactggcccaacacggtttaaataaattgaggtatatagcctaactgcacaagtatgcatagctcagtggtggggttgcttgagtctaaaggggagattgagtgtttgaacccctcaacccacctttttctcctattttcttccctctcccccacgtttcagcctgcgctgggccctttctcacccaatttccccacatgcacccggttctttagcggtttacttgcccggttctttccaaaaactggtggttcaatcgatttttcctgggttgattgcacgttcgatctttaaattggacctgacctgctaagcccctggttctggtttttttgggtcagaccgtcgatccggtcctaatagctatgcttccaggttgctaaagtcaaccgcaagggtaccctgatctaggagaagcgcggcggttgtggttgcgagagtggtgtatcaccgccctcttgctcgactccatgagagatactcgatcagatgaccttagcgtccacctccttcccctttcaagcaacagttgaatgttctctcaccataaatcacatcatttttgtcaacccaaccacgct

SEQ ID NO: 56104 - DNA, 7721 bp, Oryza sativa
ctgagtgcagagctagggtacatgtggttgtacggctggggatacacccaaagtcaagatcgtgcaggtggtgggttccggcgtggggtggggggccgagcagcacgtacagctagctggcctggaaaccggctggccgccggcggcggctgccggccgggaccggacggacgcggaccacggtacttgttcgatctggactataatggccgccagtttgtccccgtggtacggaggcgctgtggctatagcgctggtttaagagcaaggtcaataatgcagctaacaacaggcggtaaaacggcccatgtcagatagtgcagctaatattaaaagctagtatgtacagcagtaggctgcactccattttccggtgttagtttttcattttctaatcgtactttactagatcagtccatcacgtgattaggtggtgttaggttggccccacaaaatgtgtgaaaagctgcgctgtagccgggcggtaaaataagcgtcggcttatttctctctcctgagttctctctcctctacataggaattaaatgatgtggcatattttggagcctgtctagtcagcttattgtacctgctctaagggagaaattacatgatgtacatctctcgagtgtgagtttgcgatcactaaattaatagtttgatgcagtaattaactcggactcaatttaattaccagtgaagctagtacttaatgaatatgttgctcgttgttaggcctggtttagtttccaactttttctttaaatttccaactttaccatcacatcaaaactttcatacacacatgaacttccaactttttcgtcacatcgttccaatttcaatcaaacttaaacttttaattttggtgtggactaaccacactcttagtttgcctaagattatggctatcgttggcgcacaaagacagcacacatcagacaaacctatatgcctggtacaacgacagactctaaccaggcaagagcaaccatatacagttacgcacgccctcatgttgaacacaaatgtctgccacttttgactgaaagcacatgtgacagattaagattggtgtgaatgtgtaaatgtaatgatgattttctatatggacaaagcatgtgagcatgtatgctatcttcagataccctccgatacccttaatgccttgctccggagctgttcttctttttccgtgaaggaaaatgagtcttctcctgaaacatatagcgatttcgtatcaaaagtcgtagttttcaaccttttcagttgctgacagcacgagcgaatgtgatgtagttttcaatcacccaggtagaagcacgtatgtactttccagccatccgttcgcaccagtattgtacgctggctactataataaatacatacgatccaccaaccattacaatcttcctcgactttggccttgtacttttctagatttttttattagattaccgaaacggagtatttaattcatgctttagaaaaatacgttttactcaagaaaaattcttctaccttaagtaattagatcacgcattttaagttaattggtaagcttatttcagtaaatatttagcttatccttatgatcaagctgataattcacaacaatcatatgcagtaatctactacaaattaaataagacctttggcgatgaaggtcatgtacaccattgcatttttttagataatgaaaaaacctactattacacccgggacatggcatatgcatgtatacacgcatgccgtcatagtatagggcatgtttggtttgaaactctaccaaaacattggtagtaccaaaccttgggcaaattttggcactaccaaatttttgatagtatagatttggctccactctattgatttggcaaaaattggttccaatccaaaatgctaacatgcactattcaaaactactaaagaattgttagggcaagaattggtaccaaaccaaaatggcccatattgccatagcgttattaacgggcagtagtaccagtgtacaagtaatcactatggacaaatagatgtggctacagtcctacgcaaggcaacgtcagcgtgaggcagccatcgctatccgggaatctgcttgcagctgctaaggtcatcggctagctaggatagatggatcggagtgcgacattgacgtgctcaatctgatcctcttcctctcgatcgccatcgatcggtatcaactccacgcggtttgcggtcggtcgcaaccctgcctgcctgccagtgcagctccagctagctctcgctatagcatcttctcatcttctctcctctcccctcccccctccctgccgccgcgacatcgacgactgcatgccacgcgcgcgcaccgaattcaaagcgccggttggttgttgtcttttgtctcccctcccctcgcgcccgcgcagcggtgtgtctcgtctcacttttaaaaaatgagttaaatttgataagtgcaattgtaaatttgtcgttacaattcctctctttataaccatgccacttaaattctataaaattagaaccatgctacgaattctggtcaaacttttccttaaaaaaaataactgacacggttacgagtaggcgaattgtaatagcatttatttgaattggtgcatttgcaatgacacatactccctccgtaacaaaatataagtgattttaggtggacatgacacatcctaatactacatatctagacatgagttatgtacaaatttgtagtagtagtatatgtcacatccacccaaaatcctttatattttgggatggatggagtatcaagttaacccttaaaaaaatatagggttcgttcgcacagtttcagctctagttacatcttttttttagccgaagaccaaccagatttagcttcacccaaaaaaggagtggagttgactaaactgctctcacaaattaaactagggaggtgaagctagacttaggcagctccacaatttcaatacagacccaactcctgaagttaaatttagaaattgaaacactaccaaacagactcatagtaccccatttttttaaataatgaactccttcacatgatgaatgttgagtttttggaaatacaccatgttacttattagagaacaagcgcaaaaccatcccggggaaaatgaagttatttgaactaagggagtttttgaggtaaaaccataaatcggtaatagacagggtcggtcaacgaggagcaacggcattgtcgcaatgatttcatccacatgcctctactagcatgcatattgtttgaaaaaatggcgatcctttcagttgccttcgtaaaccgcacaaattgaggtttatagttgactcatagttttttctctcaccggactcactcaaatgttgccatggttttcgctgtcaaaattgagaagcactagcaacaaacttgtcgtccagtgttttcataggcaattgacacccaacctgaattgcacatggttacaactataattaaagtactgagaacccgcctccgatcctcctccccatcttaatccaatatacatggttcgtgcaaggttttggatggtaaccgtgaaatatgtttcaactggaaatcaacaaactgcaacagaaggcaaaaataacatcaaaggagtcggcatgaccactctcttttctacaagaagtcggcgatggccttcacagagatagcaatattgaagtcgtcttacattgtccacaacttgatgtcggagcacttcaccacctggtattgccccatatggtttaaagaccggtgtcactttgtctgcttcctttcaactggatatgatggtttcaagcatacccctccctaccccttgaatctactgattgtttgccggaaccagcaaccacatggaacttcgccacccgggctgcctctaggcgacaagatccagcaactgcaagctacgcatccacttcaattgcctacttcaagttttctttgagttttgccttctgttgacacaaaatatgtcgtgacacacgaaggccttggagatctgcttaactccagtgcaaatcctaattttagggttcaagacgtattagttagtttgatcctacaactaacaaggatgatataaagaattgaaccaatgaaccaatcgaccaatactgatataatgtggtagatgcaggtccgatggttaatgctagcgtacatcggctggagatcttatgcaagtagattcgcatgtatatcggctagctagctgatacgtatgatagttgaagcccaaaattatgataacacatcagctagaactctaatggccattgcataaaaacctatcgccttacaagaatcaaacttattaacaacaataatctaatagatcagacctaaccgagacagtataagatcgaagatgataagaaaaacctatttagccaatagatctacacaaacatgatggatatcgaatcaatcaaaaacaacaatgtgattagagaaataccagcttagtcggaatatcggacctaatcgaggaagtactaagccgatacgactctaaacaacgatacagtcaaaaatagaaccaatatattagatagacatccttttgcatcaacttggttagaatattgtacctatcagagaaagttctaggcacactgatatagacgaagatgatggaaattacttcctcgctgaagatccaaacgatgtagcccaactcgaaactaagaacttgccggaataaaaggtggcaatgcaccgaaagtaattgtattgatgtgtggagatgtctcgtaaagccctagggtgtaaaaatttataccctcagattgatacaagtcttgatcaaacacgatacaagatttcttaataacaagaaaaggaaaataaataacctgtctattcaagatatatgtactaaaaatacaaaaattgcctcgttgtggtcttcacaattccttcttgaactcggtttgatctagataaacatccatctaccaattagttaatttctttaaccaaatccactaaagaaccgtaccaaatttcattaaccaccatggttaatgctgtggtgtttttgggcacaccatagcatagcctcaacgtttcttccactatcctcgagatgaggagaccggatgctagcaaacttgatcacaaaatgagaacaacctgattatgggagatatccgaccagcctacgctcactactaatagtggagatgagcctaatctggcctctccttcccttcacccacgtgaatcgccgagcccgagaggaaaatgggtcataaatgggagttttttttttctacattactttttgcggaagtcagggagggatcgagcaagagaacaaatgtccctcactatctcagaagcaacattatactactcctcttatctaaaaatataagagattttgacggaatataacacatcctaacacttattcagattcacagtactaatgtgtcatatccggttaaaattacttagactttgggatagagagagtacgttatttaaggactggcaagtgcttaaaatgcgatggtaatagttggtacaaacacagaaattgttttataagaattcgggctatttcttagtttttttaaagaaaagcttattccgggtttcaccggtttttaccggtaatatatcgagcggtaatcacagtggaaacgccgttcaggaactgtattcggtaaccgaacggttttaaacaagtggccgtggcgccgcgtccccagttccccacggcacacacatctctctgggtcgctgcaaccgccgccccgccccgcgcgcgaagctgcctacgaagccgcgggtggcccctggcccttctccgtgcgtgcgtgcgtgcgtacggccgcgggggaatcaacagatctgcacaagggttcaatacacaccagcacacacgcatatatgcacgtactcctacgtttcgccgccccgtactaggtactactgttccggcaacgacgacgagccggtgtgcatggtttcccactactgtgcatgcaagctgtctgtcttgcagacgcgccacgccacgccacacgcgacagtggtccatgatcgcgcgtacgtgtgtgcctgcgttttctcggcttaatttgcaactactaatcatgcttacttactgtctcgctaattaagcatgtggctgtgctgacatgtcgagctaggatggagcgggcggtgcactgcggcactgcacacagctgtgcgtatatgctactgtgggtagtcaacacggcggctgtttgatgatcacggttcagtgtaattagcacgagggttaaatttaactaacaacccgaggtcgtcgtcgccgcaggcacgtgtgtcttgtagactttttttcacggcctttttcgctggcctgctggctggctggctgcaggccatgtacacagccgtcgacgatgtgtcggaacaccaccagtactacgtacatgaaatatgcaataatggtttctcccaaaccatttgcttgttgtactaggtacgaacaggttgtgattcgaaacgtgtctaattaatcagaccgtgcagattctgcagaagtacacgggtcgagttattaattacttcctccatttcatattatataagactgtttagcattgtctatatttatatatatatactaataaatctagatatatatatatatatatgtccctagattcattaacatatatatgaatatatattggtaatgttagaaagtcttataacctgaaacggaaacggagctaatacaaattaatcaattactccacaataattaggacgctactactgtcaacacaccctgtcacgactctggatagacgtcggtcgtcagttccaggtcgatgtactggcccaaacccagccatgtacaagcacgacgaccggaccggttttgttggacacctgtacagctcaaaatgatggtagattccacaggagcgatcgatcgaaccaccatttcacgccaatgctcctcatactactaatcatatacgcatgcatgcacactgtgcttataactcatccacactcgaggagtaaactttaaggaaaaaacgtgttgctgttcggatcatgcatatgcttgctggttaattagctagctgttctgtggctgacatgctgcgtacgtgcacgtatgaagcagttgtactactactggccaatcgatcgaatcagtagaatccttccttcttattccctttgtctcctaattaatccgatcggttttcttagtatttcctctccattattgctaatgtagctgcacggtactgtgtacaaattgcccaaaaacaaatgacattatcagcatgacgctatcaaaaatggttacaatactcacaaccagttcagtctagacaagaataagcaaataaataagataagtcatggagttaattatacacagtctgatgctgctcagctgctgtgccctataaataagccatgagatgcagcacatcacaccagccggtagccacacacacgcattacacctacacctacctactactctcagttgttgcagccgtcttctttgcagtttggtccgaaccatcgccatctccatctccatcgaacgatcacacgtcggagtatcagaggtgagcggcggcggcgtcggaggaggaggaggagcaatggtgaagagtgggcaggaggcggcgccggggagcggcgacaaaacgccggcggctgc

SEQ ID NO: 56105 - DNA, 6078 bp, Oryza sativa
cttctcctccctcaactgatcgatcgaaccggagatcgatggagaccaaatccatggaggtgatcgatcgatcgaagcctccacactctccagtgatcaccattaagcgcaaattcaattactgactgatatatcagtacgtgaccaagaattggccacggtacaataataatcatataatcattcaattcataactattatctacatatatatatgtagtatatacttaatcaatgtactagtgctactgcttcttgattattttaggctaattctgaattgcgtgggagctctgatgaagctacatgttttaaggcagctttccatggagcaaaactcccctcaattccatgtcataccatgtgtaaaagtggtgttcctgcaattgcaagtaatgaagtataatcaattactatgatgttaattatactcctctcaacttatgtccaaagcataatggtcctttttactagtgcagttatggcatgattggtatctagtcgacgcagaatttccgggatccttacgactgaaattaaattaacttctgtgcgtgtgtctgtggggcccttgtcagtcgtatgcgtctgtcgtatttcagtacccagctttgatccatcgccgtcctctgctgaaaatgctacacttgtcccgcttctctaattgtcaaatccaaaacgttttatttactaatcgagctgatgcggtcaatatttatttttatactgtcacgtatcaactgcagtatgcatctgtatatgtttgcaagaaaagggtatgggcgttgtgagctgtggtcaaaagcaacagagaatttcctttccctatcatgtaaaacagctggatttcgtagcggatcatggcgcgccgcttagattaatcgcagtgtccgtcggagaagaaagcgaccggccaaatctcaaaaaaaaaaagagagggtaaaaacgagaggaggcacgtatcggtctcgtcacgctcgagcccgaatccgcatttcgcggggtaatgcgagttcggatctgaggaaacgagcccgacccgttaaaggcgcgtcgtccagccgcccgaatgcccgatccacctcgtccatagcagcctcgcatccgaacccgagaggccgagacagcctcgcctttgccctactcgtctccttccttccttccgccgccgccgccgccgccgcgagggccatggggtacaccaaggagcagctcctcgcgcgactccaggttggtgccgccgccgccgcccactgggcgccactgctctctacctcccaactcctcgactgttcgctttgcgtcgtttcctggtagtggggatcggctggattggtggtcgtggatgcgccggtgctacggattgtagcgtcggcgagatgcttcccgttccgttctagcttgatttggttttggttagcatagttataaatggaagcgcgatagggcgtttttgctgccgaatttagttgggttgtgctgcggatagtttttttttttttttttaaccccggatgtgcgcatgaatcgaaggccggaattgcccagttatattgtgcgattatcgagaattgtcacatcctatgtgtggcaaactagaattgcttgccttctggcatcacagtggaccgcgactcaatttagtggtattgtcttgtgcaggagctcaacattgaattctcgtgctacgatcacccggttgtgttgacggtggaggaacaggtttgcaaaccgtgaagttcacacttcgttctacaatacttttgatggatttactgtaagtgctaattgaacttccgcaatgttaggccaaacatgttgggcatttaggaggtgctttgagtaaaaatttgctactgaaggtatgtgtcttaccaagtgatggacagttaatttcttggaacctattttcatgtattgatatttttaaattctgagtttcaggacaaaaagcataggctgtacgttgtttctgcccttgctggcaccaaagttgacatgaaaagtaggtgcatttcttgaaaactatatcctctttgttacttatttgaatgtatgccaactaattttctgttttccttaaacccattagttttatcacagcgtcttggtttgggaaaaggtggtctgcggatggctcctgaggaaaatttgcttgaagtgcttcaggtcagccattattcatgtttatctaaaactgcatactgtttgaaagcaacgaagagcgaaatatagtgcatctttcagtttcatatattacgtgaaaatttcacaaaagttaaaaaaaaaattctgcctgtgatgaatattgttggttgtgaaaaaacaaatatcccttcatgtattgtcttgccctttttctgtttcatctttaatgagtacttgaattttggtgcttcctggctctaccagcattttagctggatagcttattgttatagtttcaccctatataattttcttcacatgttaatgtattttgtccttgattatgtccaggtacccttaggctgtgttactccatttgcactacttaatgagtctgcaaggtatgggtgcttgctttcacatgttaattaaatatgattggaatgggaattcggtccattgttgtggaatttgtatttctaatagcttgaagcctttaaacttgaaaaaaaaaaactttgtgagctctgttcactttaccttaaacggtgaagagctatttactagtgtgatgtgctcattttatatccgagcgtcgttgttttcattccacttgatggtttccacttttaggatagaaattagaaatgcaaatgctatggttgtgactgatggaaccacatgcctcttgttttataatgcttagcttttaatgtgtcctattatattatacttatatatcagtttttttcatggttatgctattgcctttttaactgattcatataactgtgtatttgcaagcagtgctgtctcactactactggaccaaggtttcaagtcaaaacagagctgctacttccatccactgacaaatgatgtgacaatcggtatggttgatactatcatcacttccgtaaccaacactgtttcatcacaccatgtgtaatgtcattagttagtcattactgtgatactagaatgcacaccattccgttagttagttatcatggcacagtttcatgtaggttgcacaaggccttggtctggctactgttatattatttttataaggagggagacctccgttcaactttctttacctttttcaaaagaagaatagattagtaaaatggctttcttttcctgatttactccatttcagctctcagctcaagcaatctggacaagtttctcatgtccattgggaggcaaccagcttatgtagacttagaggtaatctttggatcaccggaatatgtgcatatgatttcattcggtccttccgtcccaaattataaggccctcaatatcatactttgatcattaatttcttccataatgttattaacaactacaaaattagtatcatatgaaagtactttcatacacaagtctaaatgttatgaatgcgtaacactaaacatagatattattagcttaattattagttaaaagttaccaatattgatttttcctagaaataagggtgccttatatttttgggatggagggagtatgtgctgggaagggattgtgaaattattggttttgtgcaggcttcaccagttgtaggcaaggataatcctcctgatctagcagattttgtaccatcaggtgtcccaaattctgcagaaccaattgagaaggtcacacctacaaatgttcctcgtcaaaatgatgtgcccaaagagaaaacatgtcttcctggtaagctgttatctactgatatatatattgtcccttgttatttcttctgtatatgcaatctatagtccttacatttgggcagtacatgagcgtagtagtagtgctactataaggaggtactactgtattataacaactattgttaattaaacaagcaggaatagatgacagtgtgaggatgaaacatgtgaacttgttcatgttgtcttttactcattaacctccatttcttttacatttttcttgtgtttttttttattacactttcaagttacaataaccagacatggcatactttgttcttgtatcagaagtgaaggctaagcctaaagttcagaacaagggtgcagaaaagacgcagagcaagatacctacaaacggagctaatgttgagaaatttgtaaatgatgtatttgacatcatgtccccgttgttcctttctgaggtaataagattgtgcatgatgaccctcatgaataatgtccactctttttgttgataaatttcttttgcaggtatcaaagaaactgaatgttaagcaggaagaactttcttctatatttgatggctttaaagaacaagccactattgatttggagagtgtaacggttagttctcttctgctatatgttagcactgattgctcatttgtgttcatgataggcaaccgtggtaaataccctagcttccactaatatgtgtcgaacaagcatctgtggtaaaaattaaccaaacaaaaaaaaaaagccatgggcctaagtaaatgttgcaagtcacaatttctttgtgaaggccttcataagaaactttcgttgtggtaaaatcaggcatcaaactgcccacgtttggagtttggtgtggtgatgtacttcagtttgaacttcaataaatttctacctcgttaagttgtgaagcatgtaacggacgcggctgtgtttcactgcagacgagtctgaagaatgcagcatacaccgctggatttgaggctggcttcgagactatgctcaattcaggtttaaaaggacaggcttctcggaagtaaattgtttcttttaatacaatggacataagtcgattcagtgaattttgtatgacatttagtgtaaaatcgatcaaattataaattatgctttcctttgacctgttgtctacttcatgtttgctcaatttttcaagaaggttgagagatcaaccttgtcagttgaggtaaaattagatctcttataagctctctaaatgaaaaacaccgttgaacggacaagcgttggaaaacaccggttaaatttattctccgtgtttgataaactttaaaacgttgcattgagcattacataatttcattgtctgctcaaataggaacattctgcactgccatgtctatcatttacatggtcaacttttacagcagatgttcttcagccatccatcattgtcaccaactttcggaaatttccatggtcgttacacattctacctgccattgccaacaaaacattagttaatcagagcaactttactaatcaggtagtaacaaaaagagaagaatggtagctatcaggttacttaactgatcaaacaggtatttctctttgattgctatttggcgatgatcttcaaatttagaaaagaaacagagagcgccaccaagcgtagaatgctgaaatgagaattgaagaacagcaaaaacttcaaaacaatagcataaaatcaatcaaatcagcaagtgaagccaattcccggaagcccttttcccccttttgttcttccatagtagattcattgtacataatcatgtatgatctcatgggaagagtggcagatgagatcaagagtggctgttgccttttgagtgtttggtcggaggttcaagacttcaagtaaggaaggagaagaagaaaacgcaagtagcgacgagaacaaaagactggagggccgtcatgtcattaccgccggcgtcgcccgcctctggccttcctcgccgtccgtactcccacccgtcgtcggggtcttcgagcccccgcggcggccacatccacgagaagggcccccacctcacgatcgtctgctccctgtcccggccatcgccgccgccgccgccgccaccgttgttggcgctgccgcggcgagctcggctgttggcgttggacccggcggcggcggaggacagcagctggtaccggcagacggggcaggagttgtggaggcggagccacggcacga

SEQ ID NO: 56106 - DNA, 1384 bp, Oryza sativa
cggggggcgcctcgccaccgtatatgagccagcggcgcgggtggccgtcgtagtgcgggtggtaaggctgcgggaagaagtgtggcgggggcggcgcggggcgcggcggcgggtcgatctcgtggaggaacctgccgaagcagcgcgggcagaagacgtcggtggacgggtaggagatgatgcggatggcgcggccgcactggtagcaccagtacatgcggcacgtccggtggtgccgcacgccgccctgcgccggcatcgtcgacgacatggcgtggatcgatcgatcacacagctaagctataaccacttggatcgctcgaattctgtacgggaaaatcttgcgtggggtatgcatcttgcatgggcacggcgccggttttaagggcacgcgcgctattgcgccatggagagggagagctcgacggttgattgggtcggcgcgcgcgcggggaaattaagcgagtgcacgggtgggaagggatggctttgcgaggtggacgaaagcgattccgcggtcgcggcggcgtgtggcgtggtgaggcgacggcgtacgtagtagagaagggcgcgtgcagtgttgggcgcgggtgacttgtgcgtggtgcaaaagcgcgcggcttgcttgccggccaggaggaagaggaggacattggcgctcgcgggaagtaactgtgtcggttgggccatgcgggcagcaaggcccataggatcggcatgtgaatgtgggcctattctggagagaatcaggcaggattcgaataaccgtggacctggaatgctgtcgggcccaaagaggtcaggctggtgactggtcccgtcccgtcgggtggagcggatgggcgggcggaataatgctgcccgtgccggtcacgaatattcacctgcatattcttgccactgtctccgccagtcgttgtgaacgttacgctatgaactggtcgccgccgccgacgacgacgcgaggcatctgctcggagaaatatactcctaccatgagtccatgactttacagtactcgtagagtctcataaacctttcagccaaatataaagtcgacgtattaattggtcggtattttcatatcgaaaatagtagctcttgacccccaaaaaaaggaactgctgggtagctcttggccaataattatttctcataacaaaaaggagatgactaagaaaaaaataagaggtagtgcttgatcgtattcaaaagagtgtacaatacacgagaaaattttggcaccgctaccattctctagccataaagtagtccctccacagcccagattccaggcaccaacaacaaccccaacagacgctgacacatcgggcccacatattaacgggccccacacgcagcgaccctccggttcatctccacc

SEQ ID NO: 56107 - DNA, 1458 bp, Oryza sativa
ctgccggtgggatcgccagctgcgggctcacccacatggccgtcacgccgctcgacctcgtcaagtgcaacatgcaggtgagttgggggaacgcctggatctgtgaccctgctggctttggcgcttctgggagccctgctccttcgtagatctggtgatatttagttttgttcgatggttagaggaacgtgtggttgcgaacttgtgatatccatctaggaatctaggcatgtcgccatccgtttgcgtaaatccagccgcgcgcgctttgctgtgcatacagctttgactgtcgttaaaatctgtagtttttatttgtcccgtcaatgttcttcgtcggttccaatgtgcttgcttctcattatttagttggcgtagggattgatgaggagtagatactagagtagctatcgatgttaaacatgttcagtactagtgtttctgcagttgaactggcgtatgtagaaactggagagttgattcacctgccctcttatttaagttacactactaatccttcttctttacttggttgcaaattattccgctaccagcaattatatttatctactgttaagttccaagctttttgttagtgttagtgtcgtggagcaaaatgcttgtgtatcttttggtgaagatactttatatttctcactttgataatactttatgtttctcactttgataagtcgattggtgcatctcccttttgccggtctctactttgtttattggaatgtagtttgattctttgagatggttgggtaggcaggtaaaatgatcggtgaatgtgcgatgtccagtcaatgtttgttttaagttgtaattgaaatgtttctattatggattttggactgacaagttttggttgatttttttcagattgatccagcaaaatacaagagcataacatctgggtttggcgtcctcttaaaggagcaaggacctagaggcttcttcaggggatgggtgcctaccttgcttggttacagtgctcagggcgcatgcaagtttgggttttatgagttctttaagaagtactactcagatattgctgggcctgagtatgctcagaagtacaagaccctaatttacctcgctggatcagcttctgctgaggtgattgcagatgtggctctctgcccatttgaagctgtgaaggttcgtgtgcaaacccaacctggattcgctcgtggactgagtgatgggctccccaagttcgtcagatctgaaggcgctcttgggtaagtataaataacatgtttttatcttagaatctgatatgtggcaactctttctctagttttatgcgccttgacaaatctcattccttgataatgacaggctttacaagggaattgttcctctgtggggtcgccaaatcccttgtaagtattagtcactttgctacattgatattatttttaatgttttcatttatgtaactgctacacg

SEQ ID NO: 56108 - DNA, 1769 bp, Oryza sativa
ccaattgggtatcagtttcgctggtggttacattgctggagtcttctgtgccattgtctctcatccagctgacaacttggtctctttcttgaacaacgccaagggagctacagtgggtgatgtaagcatgtcttctactaataaaacccattatgtgcaagttttatttcttatcttgatgttactttcatgttggttgactgcatatgaaagttgcatttctgtatgttcctttcatcagagtccatcaaagttgtagttaatgttacataactgctcccatcaaatcttcgtaaacactagaaaagttatagcacaagagaggtttatttctataggcggattattaaaaatagtctgccagtaatgatgatgaacttgtgtggttaaatgagctgtcagtatcctaataaatatgggatatccgatatatttatgtactaagctcgacaggaccaccatataccaagttctatatggaatcaagtttcatacatatggcgaaagtcctgcatatatatggaatcaagtctcatgtattctattcatgttcttatcatgttaattgaatgtacatgtttgttgtattatcacaggctgttaaaaagcttggtctttggggccttttcactagaggactgccccttcgtattgttatgattggaactcttactggtgctcaatggggtatttatgatgcttttaaagtcatggttggactgtaagtattccttttgcttgctaattaatttaattgttagaacattaaaaggcttttgaggaatcaaggacttatggcccatttatatattttcagtccaacaaccggtggtgttacgcccgcgcccggtgcagcagagaaagcattgcaagccagtgcttgattcttatgcagagataatggcgatgtattcctgaagatccatctttgttgtggctggaattgtatcaattacttgagtttagcacctaaatcttaattttagtggatgattcttgtgtcatccttttgatgagaggaactcattaatcaggtgaagtaggtcttttttgcccccgggaaagtttgatgcttgatacataataaatttttggacagcaaggctgttagagctcaggttttggcatcacctgtactgaggaatactcacatctttgtgttccttaaaagcatacataccttgaatcaatgctaccctattttttttgttgcaagtcagatatatgtgtgtgaaactgtcaataccaggaatctcttgcttccggtggtgtttcatttctacacgagggctgtgttcgcatgtggatgatgggaacatagtgcctccacacggaaaacggagcattccattagcacatgattaattaagtattagctattttttttaaaaaaaaatagattaatttgatttttttaagcaacttttatatagaaacttttttttaaaaaaaaacgcaccgtttagcagtttgcggaaaaggagggatttaggttgggagaggtccgaacacacccgaggttggtatctaaacaccagttgaatctaaactctaaaggcatttttctgccaagtcggctgccgtagcttgatgtgcttattttgaccaggtggcagaacttcattctatttcctttcttagccttcaggattttcgttttgcaactgtctttctaatctgaccactgtttgcatcgggggcaaaatggaacatgccatactaaaatcctcttgatctcggcggcaaagccctctgaagtctcttgtcca

SEQ ID NO: 56109 - DNA, 19603 bp, Oryza sativa
agttgattcggaaaacaattgcaacttgcttcaaactcggcgaaaaacaattgcatcgaaacatgtctactacttaacatcaaattgacggtttgagtgtacaagctcaatgtctagttaacagcaacttgccggttgattgtacatcgacattctggatgaggtcgttgtttagatcatatgtgttactctcactttctcaaaataatcatcataaatgtttatgcaccaagaccaatgataatttaaatcacatcaattaagacaccatacacacattttcctacatatcgagaagaaaagagaacagagaaaagaaagtgggctatagatttgtagccggctgcaacacgtactccaagacgttatatgtgtataagaggtgggaccgggtattagtggtgtagtatatttttatagttaactattgtataaatgtgctattagattagctatagataatttggagccagtagttggctatactattaaactttctcttagcatgcacatattctcctatgctgtattaattgtattttgataaaattcgtgttcatgcgattatatgatgatcaatttaagaaatttaaattttattatatgattatcaatttgggaagggagggagtattaatactgcttctgatcatagatgatgccttgagaagcctcagttacaggagaaaaaaaaattgcttatctgagcgatgccatgtgatttgtttgtgctcatgattaagaaagtaaatcagccgggtttaaaaccaagtgcggttttcctatcacgtccacttgcacgcctgcacgttggttgctaactaatcaaccaaatctgcacgcatgtgatgagctgcggatcatgtgccgatctccacgcaagcactacgctacagcgagcggcgccggagaaggaagctgctgccgtcgtgctccggctggccggccggtcggccgcgacgccgcgtacatcacgcgtgacgtcttcacgtatcacaccacgttaaacaagctctcgcacactcattccagagacgagtaaacaacagagaaataaatggagatcagcatggtgcccctaccttgcctagcctccaacggacaaccatataatttgtagttaagtacctccctgaacaagagatacatttgttaactagagttagagcaggtacaatagcagactattagtcagctgtaaacatattttaatgagataaaagatgagagagaagagcagtggactccaagacgcaatatgtgtatgataggtgggactatattaatagtatagtaagcaactattgtatgaattagctataaataaattggagctagtagtgggctatactattaaacttgctcttagacgaagtacaggcgtactgatgacgatgatgatgttgatcgtgcagttctctcgatctataccactgtaacctgcccacaaaaagggtcaggttcatatgaccaacccttcatatattttggtttatcccccctttcaaaagacgctagctctcctcactgcttgtgatctattttgtcaggacccaggattgattccaccttataatcaccataaaatatgtgatcatgtactaataatactactcctcctaagtctaaaatatccaccaaactcttaactaatcagcaaagataaccaacacactggctggccagtagacatgcatatgaaaaaaataatatgattgcttcgaatcgaaccgctccccgcgttgccggcagccgattcgatggatcgccacgttcaaacgccgccgttggctcgcacaaagaatcaaggctttcccttcgaacttccaaaaattcggtcacaatatgcatgtagcattaggggttggtttgttttgaggcctatattggccttaccaatatttagcaatttcaatagtgtttattgtctatttggtgtggagctaaattttgacatgcctaagaaaataggccatttcaaccgttaatttaggctattttggcttcaatccaaacacaatttttcctttgccaaaattagccatgccaaaagttaccaaaatttgacattgacaaaaattggtaaggccaatttaggccacaaaccaaaccagccctagatatagacaaaaaaaactaattgcacaatttgcatgtaaattgcgagacgaatcttttgagcttaattacgccatgatttaacaatgtagtgctacagtaaacatttactaatgataaattaattaggcttaatagattcgtctcgtagttgacagacgaaatctgtaatttattttattattagtcaatgtttaatattttaaatgtgtatccgtacacttaaattttttttttgaaaaacaggcggcagcgacaccaactctctagccgcacgctgcactcgcgagtcgtcgtctcgccgcattattattttttttcttcgtctcttgcacacgcagatcccagcgcggccaatggcgccacccgagtcaaccccctctcgcggcacaaacccacccaccccgcaatcgcaatgccatcgcgtcacgccgcctgccgctcccgcctcccccatgagatgacccctcccccgccgccgtcccatgtgctcgccaccgtcgatgcggcggcatccgctgctccctctcctcgccgccgtccttgtcggcgccgccgtccgcgccgggaagatcgccacggaggtggtcgtgccggacttcgtggcgtcgtacctgctgttcattgacacctacggcgtgttcctccagtccggcggcggcggcgcgttccaggccgtcgtgtacaacccggcggggcagcaggaccggtactacctcgccgtggtgcacgcgccgtccaagacctgcgtctgggtcgccaaccgcgacgcgcccatcaccgaccgcgccgcgccgctgcggctcacggcgagggggatctccgccgaggatcccaacgggaccgtcgtgtggtcgacgccggcgttcgcgtcccccgtggcggcgctccggctcgacgaatccggcaacctcgcgctgctcgatgggaggaaccgcacgctctggcagtcgttcgaccggcccaccgacgtgctcgtgtcgccgcagcggctccccgtcgggggcttcttggcgtcggccgtgtcggactcggactacacggtgggcggctaccggctcgacgtgacggcggccgatgcggcgctgacatggaacgggtcactgtactggctcctgtccatcgacgtcaaatccaccagagatcgcgacggcgccgtggcgtctatggcggtgaacggcaccggcctgtaccttctcgccgcggacgacaccgtcctcatccagctccccttgccggacgccaagctgcgtatcgtcaagctgggcgtggaagggaagctggtcatcacaagctacgcttcggcgaacgccacgtcgccgtcgccgacggacgctgggttcgtcgcgccgaacagcgggtgcgacctgccgctctcctgcggcgcgctcgggttctgcgcgcccaacgggaacgcctccagctgcacgtgcccgccgctgttcgcgtcgtcgcatgacggtggctgcacaccggccgacggctccaaggcgatgaccgtcgcctcctgcggcggcgccggtggtgatgccgccccgacctcgtacatcagtctcggcaatggtgtcgcgtactacgccaataggttctcacggccagacatggtcggctccaacgggtcgtcgtgccaagcactctgctccggcaactgctcctgcctcggttacttctacgacgagtcgtccttgtcttgcttcttggtgcagcaccagatcggctccctggttaacgccaactcgaggcgaggcgacatggtcggtttcatcaaggtccagagctcgcagtcaccggggtcgccgagcggttcatcttccaacaacagcacgctcatcgccatcctcctgccgacgatcgtcgcgttcgtgctcgtcgtcgtcgtcggcgccgtcatcgtcgtgtcgtggcgcaagcaagagcggcgcgcggggaggcgggcctcgcgatccagggacgtgcagctccggcgccaccgctcgccggcgtccgactcggcgcaccttgtctacggcaacgacgacgacggcaacgacattgtgatccctggactcccgacccggttcacgcacgaggagatcgaggacatgaccaacagcttccgcatcaagatcggcgccggcgggttcggcgccgtgtacaaaggcgagctccccgacagctccgccgtggccgtgaagaagatcgaaggcgtcgggatgcagggcaagcgcgagttctgcacggagatcgccgtcatcggcaacatccgccacgtcaacctcgtccgcctccgcggcttctgcgtcgagggccagcgccgcctgctcgtgtacgagtacatgaaccgcggctcgctcgaccggacgctgttccggccggccgccggccagccgctcgagtggaaggagaggatggaggtggcgatcggcgcggcgagggggctcgcgtacctccacttcggctgcgaccagaggatcatccactgcgacgtcaagccggagaacatcctcctcgccgacggcggccaggtgaagattgccgacttcgggctcgcgaagctcctcacgccggagcagtcggggctcttcacgacgatgcgcggcacccgcgggtacctcgcgccggagtggctcaccaacacggcgatcaccgaccgcaccgacgtgtacagcttcgggatggtgctcctcgagctcgtgcgcggccgcaagaaccgcagcgagcacgtgagcgacggcgccggcgccgccaccggagacgactccaactcctcgaacgggacgacgggcagctcgtcgcgcggcgcccggagcgattacttcccgctcatggcgctggaggggcacgaggcggggcagtacgccgcgctggccgacccgcggctggaggggaaggtggtcgccggcgaggtggagagggtggtaaaggtggggctctgctgcctccacgaggacccgcagctgcggccgagcatggcgatggtggccggcatgctcgagggcaccatggaactgtgggagccacgcgtgcagtcgctcgggttcctccggctctacggccgggggttcgccggaccggccgacggctcgggcggcagcggcggcggcatcaagcaagccatggcgggttccaatggggaccacacaaggtcggggacgacgacggtgacgacgatgagcgggtggccgtcgtacatgtcgtcgtcgcagctctccggtccaagatagggcggcgcacaccggcgagaagattgtgttgttagagatagattatacggttgcattgatcattttggttgatttgtaaacagagggattaatttgtgcattcgtgaggtctatacaaattttgtcctgttttcccatctgcttttctcaagaaaaatggaaggataagtgagtttttttttctttttgggttgaagccgatgaaatcgaactgcctggttggtggaaatggttgaccaagtgaatcagtgatcaaaaaattctaaaggagttcgtaaatgttttgactttcccacatctctcatttcaaatggattataaaactcaacatatatgggacgggattttcatccctccaaaagatgttgtctcgttacatacatgttatttaaatagttataaaatttttttaaaaaaattgccatcacagattaatatgaaatgtatcactccataaacatttgtggagtgatatattacatattaatatatcttataatttttttaaaaaaaattataattatttagttgatatgcacgaaaggaggggatatgcatgtgtatgcctttgtaagtttatcgtgtgccatgcaaatacgccattcgcgtcgattggtactcattggtactatttacgagacctatttagttgatatgcaagaaaggaggggatatgcacgtgtatgcctttgttagtttatcgtgtgccatgaaagtacgccatttgcgtcgattgttactcgttggtactatttacgagatctgaacaagcaactgaattgcatgcgcgatgcgtgcgaaatgaaggacgaaacggaaaaaggcaagttttccgcctagtctccctctcgtcctctcgttgccgtccccgtcgccgtgcatcagatcatttcatcaccggcaagtgcagtcgcccctttaaatctcagctccacttgtctcgttgccgacgcgtgtgtttgctgagacgccattgtcacatcggttgctgcttccttctcggaagatagcaccaccagaggtcgtcgttgggttgtaatggcggaggtgcagagcgtgcaggcgctggcgtcgtcgctggcggcgctgccgccggagttcgtgcgttccgagcacgagcggccgggggcgaccacgttccgcggcggcgacgcgccggagatcccggtgatcgacatggcggcgcccgagtccgccgcgcgcgtggcggaggcggcggcggagtgggggctcttccaggtggtgaaccacggcgtgcccgccgcggcggtggcggagctgcagcgcgttgggcgcgagttcttcgcgctgccgcaggaggagaaggcgcggtacgccatggacgcgtcctccggcaagatggagggctacggcagcaagctgcagaaggacctcgagggcaagaaggcgtgggccgacttcttcttccacaacgtcgcgccgccggccatggtcaaccacgacatctggcccagccatccggctggctacaggtacgcgtctccatccatacatagctcgccatgcgcgccggaagcggaagctaatggcgaccgggcgcggcagggaggcgaacgaggagtactgcaagcacatgcagcggctggcgcggaagctgttcgagcacctgtcgacggcgctgggactggatggcggcgccatgtgggaggcgttcggcggcgacgagctggtgttcctgcataagatcaacttctacccgccgtgcccggagccggagctaaccctcggcgtcgcgccgcacaccgacatgagcacgttcaccgtcctcgtccccaacgacgtccagggcctccaggtattcaaggatggccactggtacgacgtcaagtacgtccccgacgccctcatcatccacatcggcgaccagatcgaggtacgaagctctcttcttcctcctcatcttcgcctcccgcgcattgcgtcgaacacctgacatgcatggagctgccatgtgatgcgatacagattctgagcaacgggaggtacaaggcggtgctgcatcggacgacggtggacaaggacaggacgcggatgtcgtggccggtgttcgtcgagccgccgccggagcacgtcgtcgggccgcacccgcagctcgtcaccgacgggagcccggccaagtacaaggccaagaagttcaaagattaccggcactgcaagatcaataagctccccatgtaaatttgtaattgggccatggaaacatcgcccccatgacacccaagtaccaagagtgctattgctggatgtggacgctgctcaatgtgatgctagttaagttgctctgattgctaatctgctgctttctgattcgtaatcaccttcggagcatctaaattcagattttaaacaaactctttctgaattgccttccatgccgacaccggcatgtaggccatttgatgcgatgggagcatggagtaatgtttttccatctcttgaacagtacacccgaaagttgacggagaatgggtcgcttgatggtgataaaatcggacgattcattccaccggcctacaaccaccatcaaatgatttgtcgatcaccgccttctctccctgcatgattcccttctttctctctctccagtctctcttatgcatataactagttttatgtttttctttcaaattatttattcgatctataatatgatatagtcactgtaactatatttttataacaaaatatgacatgactatattctgatgataaaaatatacatgtttcaactgtttagatatgaggtttcactttcacatgaaagaagttaatgtttcaattgtaaatcaaccatgtttagatatgaggtttcactttcacatgaaagaagttaatgtttcaattgtaaatcaaccatgttgcgcattttaagtttttggattacaatggatccgtgcttaatgttgcataatagttattgagatgtttcactagtttgtttgcaaatgttgcacgtaatgttcttagagtgtttcagcgacactagttcatttgcacatattgcatgtagtgttctttgaatgtttcagcatgcatttcgttatgtttcagcatttacaattccatgtcgcatgtatgatatgttttaattaggagtataatcataaatttttaatctaaaatataatcacttgagattctgttccagagattcagttgcaataaatataatagtgtaattagattttaaattggataagtaatttaagagagaaatggtttagttgaaaagttacttggagagagcatggaggaagagagctatagcactatagattttttttaattgaaaatataagcatgcagaggcaaaggaaacatgcatgcgacaagacaggcatcaagcatccattggagaagaggagggcgtccgattttgtcggagaaaatttgggcgcccgatccatagtttcttcaaatattgtcgtagaaaatcaagagcttttaattatctatgtgatttcaatatgtcaacgcattatattatagtcttgccaaaaaaagaatcatctaaattagagccaaatgtgtctcgattctgtttttgaagctaatgatcaagtaaatcgattgtctggtagtcttctgattggcaaatttacagttttttagcttgcctcggacgttagtgtaccagtttgcccaattttcaaattcttacattaaaatgcgtctacctactaaattcttgtatcttgtacaagtacaatctggcaataatttcaatcccttcctcccttgccactggtgaggtcgaaggggcgccatggcaggtcctaggatgatgaggcaaccgtagatctataggggacgcaactcctgagggaccctgacaaatggggtccagcatcatgagtccacatggcctaactcaatgctttctaagagcaggtacaatagcagactatttaccagctataaacatatttttaataagataaaatatgagagagaagagcagcgggctacagatctgtagccagctgcagcacggacttcaagacgcaatgtgtgtatgacaggtgagaccatatattaataatatagtaagcaactattgtatgaattggctattagatcggctatagatgaattggagctagtagtgggctatactattaaacttgagttgggatcctctcctgtaatgcatgtgcagtaagtgccattgacatgtgggcccggaataggtgggacccatatgtcagtgacacgtactgcaggtgcagtataacagtggatttgcattgctctaagatggagtcagggatctgacgagttgatgactccgacggcagccatcggagacggaagggacggaaggagagctggaggctggagatagtgtagtaggcttcttttctcagtaggtctttgaggcccaacaactaatggcctctgatttcgttaccgctgggccgtttccttgagcaccggaggcccacatcgagttgttatggaccttttcaggcccatagtcttcgcgttttggatcgaggaaaggcccgtatcagaacgttcagccatttcggcccaccccaatatgggtcgcaaccactggtaggcggtagcgatccaaatctggcaatccctggccccatggacatcagattccacggcggcaggcggcagaatggacattccaatatgccatcgtcttcgtctctcgtagtctcgtgaagaaaagatcacgtttataattgtacatacatgttactatttacttactgtgttaactccgaattggatcgacatgtcataccaaagttaggttcttgacgcagacggtttcagtgaccaaactggacaagcagaggtgtcctggttatctgatacgtacaggccagattagcattgacttggcatactctggagcaggcaaaattcacagaatcgcttttactgaccagattacaccatcattaacataataaagatgcttgtacagtcaggggcgaagctatagcaagttattggggtcagtagaccccgatgatttcttctgagtcccttatactcctttttattttacagctatgaccccggtcaaagaaaacactagaccctggtgattgtttcgttaaagctcaactggtggcaaggaacgataccattatcagctagcaaatagaaaattagttagcaattgtgattatatatcagtctacatagatatacatatacattttagactggcgctcataaagtggcccttatttaggattaattgctccagtagccaactaatcctattattatttcttgattatcatcacaatttggttgaacctagtctctcaagtctgaatttgaggaaattagagttttgaaatataaacgtctgatttttcaagttcagttacatgatcatgatgcatgagcctgggggaattgttgacgaaaaaatcgaacacaccggcctgggagatctgcttagctcctgtgcaggtccaaaaattaatgaggtgcgggcgtgccagtcagtttgatcctacaactgacaagatatgtaaatggtagatcaaaacagccgatcggctgacaagcctatggagtagttccagccgatagccgataatagccgatgccgataccagccgatagcgatagggtttaagcaatcggctatatgtccaatgtagataatgatataaaggcaaacggctgatgatgatgtaataaaataacaatacaatccaatataaaccaatcggctagcaatgatatgataaataagcatcgatccgaaagttaaagcatacatcggctggaggtccgatgtcataaaatccacaagattatatttaaaaattaaatcttattgcgatcggctaaatccaatatgtatgcagtccttgtaagccgatgcaacgtccagataactcatcggctgaaaccccgatgaaacccttattggcaatcaagaagcagactagaaattatggttctaagcacgacttagtagatcaaacttaactgatgtagcactaagtatgaaaagaaacacaatatctagacaattaagccgttgactgattttcagggtggtagatgcctaggctaatctaatctagtaaggcgatttaaccgatactggcagaaaccctaaagcgagagatagccgatagaactaaattgagatgctaggactagattaacatagacatatgataaatagccaagcaaatatattatctaaaccagagtaatccaagaggtcgaatgtcctgatgcagccttgaacgacgccgacgtagatgagacaattgcctgggccaacggaacattggacttaccccttcgccggagatcgaacaccgatgcagccctgcgtcaggtgccaagtcccgccggacgataaaataaagtagaaaaggtaaaaggtggcgatgcgccgaattgtattgatcgtgaggatatattacatagaccccgggtgtacatatttatacccatgggttgatacaagtccttgtcagacaagaaagaaactaacctaaagataaaaggaaaatataaagtccttatcggacactaaacacactttcctaaagataaaaggaaactaacaaactattcctaattaatagataaactgtcatgccgcatcctctttaaactcggtcacttaggaataagcttcctttagtagattgatttccttaaccgaatatagcaggaatccgactattggcgacttgataactcccatcgactgattccgagatgctacagccgataatgattctaagccgatgacgtctttgccaattaccaaatttcactattaacaggaatataacaaaggtgattttcaccatataagaggttgttatattcttttcccaaatagtgtaacctagtacaataatgatgtggttgtaattgaggccctgtttagttcccacacaaaaaatttacgccatatcacatcgaacgtttaacacctgcatgaagtattaaatataggctaaaaaattagctaattgcacatattgcgactaatttgtaagacgaatcttttaagcctaattgctccatgatttgataatgtcgtgctacggtagacactttctaatgacagattaattaggcttaataaattcgtctcgctgtttactgacggattatataattagttttttttattagtgcccgatcaccccatgtgataccctatataatatccgatgtgacacgctaaaactttacacccctagatctaaacaccccctgatatgtaaaaggtaactactactacaacaatagacttaaaattattagaagctatagccaattgttaggatcgttaattaatagtgaccccggtgaccatctatcctggcttcgccctgattttactatgactaatggccagatcactgaagaattgagatttttcctgagctgcttctttgcatatttgctagtagaagttgttactaaggcgtattcttcttgtaagcgacgctttacgtcgttatcttgtaagcgacgtccaggaagaccaaagactcgatgctactacattgccggtctatttttggagacgtggttatctacttattttccatttactaatgatgtctagtgctttttcagtggagagtaagatccaaaatggttcatccatttcgtctgaatttgcgagatatacacacaaagtgacatacacctgtttctgtttggaccataatttccatgtggatccacatccactgtatcaaacagcacacacgtagttgaagtgagtgtagcacgagtgcacaactggttaggtttcttgtggtgaaaccaacccaccttgatacaagttttaaacttaacacagtactcatttatgactaattatttttttagtgagatattcatggtgacttcgtcgattttaagatatatcggcataatcttctaaacgtgctcataggggtagggtgtgcgtgtgtgtttaggcgggatgagtctgcgtattatgaacgcttacaattgtaccgtgtttctaaaaaatactgcacacgtgtagcaatttaactatgaacaaaaacatcacaccatttttttaagtaaaaacagtaggaaattaaggacaaattcttaggagtatcacgcggtgttttccaccaaatttgtttgcttgaggagcccggcggggatcgaatcgaacgccaagaccaagaagaaatggaaatggaagagaagtagctagccagccattgatgcctcgttagttgggagatcactccaatgcttcgtgagcctcacgtaacagccggtgatgcatattgcatagctagtttctgaccgagatggtggggggtgaaggaacgcatcaagcaataatcgagctgcagcaactggggtggcttgttacggatatggtgatagcttccaaggatgaaattgccatgtcactctcttaattgcttctattgaatcattctttcaggactcgttttccagccaaatgataccccatctcgatcgataatacctatgtctactgctgacgaaatgtacacaaactttttttgccgccagctgaacaatgcctatactagtactagtagcaaggttatgacaaaggaatcgcattgttaattgtcagataaatctgtagttaatgatgaactgttggctaggtcgctatcgttgcacgcatgacaggcgcactagctagagatcagtacatctacgcttctccgtgagaactgtgactggccaatcccctttatgctgagaaatattgcaagaaagaaacttaagatgcacgtcgcataccatgcacgcacagcaaaaaccaccaaataaactgttacgaaattgtgaaatgcctcaggatttcaaatatcgcatcttacaaatgtacgcaaaaacaagagtctgacttggctgaaaaagatattgtgtgtgtgtgtactcgcgtggacatgaacacggttttatatatcatcgttgatcggactgatcactttgaactggttaattaaactcatccaagctttgcactaatctcatacgctaattggcagagttgacacggctaggtcagctgctaattgcgcttatatgcctctacctaattgcattgcatgaccacttctatataaacatcgctgtgcttcgacgtacgggaagagcaacgagctgtgtcgacgctagctaagccaacaccaacgaagattcgaagctcgcggttttcttggctttggtcgtaagcatcaaaaatggccggagctggagaatacggcggcggcggcggcggcggcggcggcttcggcggcgacttcatggtgctgcggccggacaagggcggcatcggcgacctgttccacctgctgtggtcgtgcaaggtggcggagaacgccgccgtggactgccccatcggcacggagatcgccgagcgtcggcggcggtgggcgctgttcgtgtcgctggtggcgcagatgctgctgctgtggacgaagaagccgatggcgctgctcggcggcgggacggagtactggatgaacctcctcaacgagaatggcggcagcgtcttcatgctcatcaccaacgctctgcaaggtacagattttaactctgtacaggttaactagctacctagctagcttggcttgcatgttcttctgcagttaaacttgcaagaaaaacttgctcctcgtacaaatacagctgtcagttacatttatcacggcctcgtagatttgcatttatgattatttcgctttcacgttcgtgcgtgctccgatcttgagtttgctctgcatcacagacaagaacatttcctcgtattacaacgtagcagtatacagctagcagctaacttccatcctgatttctactcctagctagtgttcaatgttacaaagcaagggagactcgatatttaaggctgtttttcagttttttctaagcaaatttatcatattccgtgtttctgggctgcttaattgattgcgcttctctaattagatatgcaaaaaaataagcgctagttttttgtttttttttgtcgtttttgccctatcattttctatttcaacagttgaagatttctcgtagactagctacttaaaatatgttcttcattgcatcctctgttcatcgaggtataatgaagtaatgatataagcgaagaagaaaaaaaaagatgataattgctatctctgcacttctgcaggaaaggtgaaaatgccagacaaatcatccatcaattaccgatcatgcattggattgcttgacacaagaatcgatcttgacgagaagatcaaaccagaggatagaaactaccacgctgccctgtcgatcatggctgcaaaactagcctacgagaacgaactcgtcgtcagaactgttgttcagaaccactggcaggtcagtgaaaattcgttcaaactctgcatagtcccaaatcttgaaatcgccgtcacatttttaacctctcctcacgagtctgtttcttctgcagatgaatttcgtgggcttctacaactgctggaatggtaaaaatacaactttttggaaaacattataatgtcgtttgattttttttctagtcaaactttttttaggtatgaccaaatttatagaaaatacagtattattttcaacacaaaacaaacatattatcaaaatatattcaatgttcaatttaatgaaactaatttaatagtttagatgttgcgaaatttttctataaatttagtcaaacttaacaaaatttaattagaaaaagagtcaaacaactttacgaaacggagggagtagtaaattcgtgcacattgtgagttgcatatgccattttcaccaactcgcttaatttgttccattttttgtgcagaattccaggaggactacacgacccaggcgttcatggtgtcggacaaggcggaggacgcgagcctcgccgtggtggcgttctgcggcacgaagccgttcgacacggagcagtggtgcgccgacgtggacttctcgtggtacgagatccccggcgtcggcaaggtccacggcggcttcatgaaggcgctgggcctgcagaggaacggcggctggccggagcaacccaccggcgccggagacgacggcggcagcgacaagaagccgttcgcctactacgtcatccgcgagcggctcagggcgttcctggcggagaacccgcgcgcccggttcgtggtcgccgggcacagcctcggcggcgcgctcgccatcctcttcccgaccgtgctggcgctgcacggcgaggaggacatgctggcgaggctccacggcgtgtacacgttcgggcagccgcgcgtcggcgacgaggggctctgccggttcatggacgggcacctggcgacgccggtgagccggtacttcaggttcgtgtactgcaacgacatcgtgcccagggtgccctacgacgacacggcccttctgttcaagcactttgggacgtgcctctacttcgacagcttctacaaaggccatgtcagtgtccaactctagtctttctacctatagtactacggatctaatatgagatgtgacacattctagtattataaatctagatagatatatgtttagatcttataaaaaccaacttagtatcagatataatacatcctaatataatatatttgaatatgtgtctgtttagatttgtagtattagaatatgtcgcataggttgtttttttattaattgagcgagtacgttgttagtagtgtagggccggcctgttgacagattgcattagattgggttgtttcttggcatctaatccaatcccctgaaagagcttggaaaggggtccagtgaccaatatacacacggtcatgttttcaaggcaagcaagcatggcttgcaagcaagaatttggtgttaagaacaatagaaagtgagaagcttcttttctcgtcatgggcagcatccttgccttgcttgctgaaagcctggaactggagcccactttggtgtgggatggagagaagaggatgatgctgcaaactgtgccaattggcagatgcagcatgtgctagttgtagcccacaactgtgttccaactgaacttggtgactgacgaggattggtgttgtggcgatgcaggtgacggaggaggagccgaacaagaactacttctcgctgctgacggtggtgcccaagtacgcgaacgcggcgtgggagctcgcccggagcttcgtcatcggctatgtcgacgggccggagtacggtgagggttggctgatgaggatcgccagggccgccgggctgctgctgccgggcctgccgccgcacgcgccgcaggactacgtgaacgccaccaggctcggcgccgcctcgctcgagccgctccgataggtagctcgtcggcgtcggcgccaacacatttagtagtaaactagtaacaggcttgtgattcatgattcatgaagtggaatgcaacatccacagtgtaaattcatgccttaaacacaataatatgattcataaagtggaatgcagcattcattttcagaattcttgaacaagacagtgtagattcgatgtaaattcatggcttaaacacaataatatgatgaaaatcggtccggttggcatacaacaatgtttccaagatagcatggctaacatcagtcaatccatgggtcaggactcaggacgagcaatgcattacctcacagatgtcacccaagtgatgaaacatcagatgactcaagtcacatacaagtctgatcacccttggcacgcaagctatacttggtgcaagctgttcttttgcttaatgctgaaggcttcccaaaacgtgctggaagaatacaggatgcaacaagagttttagaatgttgtacggttacatatcttctgatgatgaccgtgaaaaaagtggatatcttgcattggctcttacccacccccacccaaaaaaaaaaaaaatcctcatacacaagcccgacaacactccattggctacagtcagggtagttagataatctcatcagtatcacaacagcgaagcatctctccagcaaacaaaagaaaaggaaaaagctcatcatctatgtcaagccagtaggaataaccatgaatccatgttaggcaactttctccgtggcgggaaggaatgaaagactgtcactgtcagcatccaatttcctcaaaatgagacgagatgcttgattcagtagggccagcattatgcatactctataaacaactagaagaacaatcagcgctgcgccaataaatagtctgtctgcggtctcttcccctgactgatctggtaagcatggttccactaactggtttacatagacccacatcaatcactgaagtaacctttcttttaccatgatcctcatcaaaatgcatatcaaataacatagccaggcacagaatttggtgagtaagtatgtagtcctcatatgacgaaggtacaacctgaaggatgtgaagattcacctgcatcataagtgtagccagcataagcagtgaagcttcactgagaaatacattaaagtgagagcagttagcagtacaaacctcagcttccattgctctaagatcattgtgccattttaaagcttcagtctttcccgaaagcaattgcaatgtgaaaaaaggtggcctaacaggatattccatgctgatcgcaatctgcaatgaaaaatccacagtgagaaagtattgtgcatggacatactttaaggaaggctcacaccaaaagagtaactgaagaatttaccttggcttccagcattacttttggaccattcttcagagttttactcaagaccagggtaaactccctggaagcatagtcctcccaggatttgtctgtagcaaggttgactttttccacttcttggtcaacaaatgtctgttcctctaactcactgtcactatacatcaagagatcaagatcgtcctcatttctaccaaaactgtgtgagatgcttagtttagatggtgtggcgctctttgatatcagggataagcctctagaatggtttcgaacctccggtgacacttcagagtgtgatattttagaaacacttggcgtgttttcagcaggaaccacggccagaagctccccatcctccctggtactctcagtttcttcccaatgcgtcacagatcttcgctccatatcactgtcaacacttcctgcagccccaacaaccatcaaaggagaacgaggtgctggctcaggaaatatcccagtaaatgaccagctatgcagactacacaatggggtacgtgatgcccatggtgcattc

SEQ ID NO: 56110 - DNA, 42518 bp, Oryza sativa
  unsure (1)..(42518): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcggcgatgtgccatcaaccaccaaggtgtctggacactacttccaccagctccgccatgattactccttcgttgacattgcggactctgccatagaacgacgcccgcttccacggtcttttcctcccgtatcaacacacgggtatttttctagtctttaattatatataagtagtggtgttggcaaataatagaaggagatgcgcctcaacatttgtagaaatgagttgacaattaaggggagcaaagatagataagagagagagagagagagagacgcgatgcatactagcatatgctctccgcgcaaaatctaaaactcatggtaactctgtccatgcattgacatggagggattaggattaggatgcattaggaaacacgcaagaatagtgaaagtgatgacaacccaagctcgtgtatcagtattatctcacagatacataccatgctgtaaaccactccactacataccatggtgagggatcatactatcagataacactcgttactttggcatgctagatcaggatgttcagtagctcccagaagtcagcagcaaaagaggcattatcatgtgtttctatcttctctgcttttctgcttttggaacctctcgaaccaccgtcatggtgtggtttccagaaatgaaccactatcattacatcgccttttggtgaagtgtataaggatgctactctgggctgaacgacttcgagaatagacttgtaatttcagcttggaaggatctcctcttttcctcctttcgttctctaaatctgtaacgatcttgtaatgatcttgtacttctaggcacccttttatcaatgaaatacaggtggggaaactctcccctcctaatgacatattctaaaaaaaatgttagatcaggatactaagtcttccttttaggattatcatagcaaaactaaactatattagctgagttgatatgtatcgtgaggtacggaccattctggatagctatcaaaatgtgccttactaattgatcctctactcaataatgtttggctaaattttggattgaagccaattcttttatcaaatcaatattgatgtcctacgaaattattgataataccaataaatataattggatagtaaagaaccaaaatgaccattttattgaactgaataaactttaaagtcattgaaagtttctccatacctcattgttctagaaatattgcataacataacacctccccgttaacactaataatgcatttacctttcaagacggtagaaacctccaattaattttagaatgaatgggcacattatgggtggttgaatcctaacgccaacgtcattggcccccaacaagtgtaataaatgatatttctattaagctacatcatcacctccattattatttttaacctagcatgattaatctacaactaaatcattttccttctcatttcacattatcacactgtcacgggcttgggccctaagtgggctggccatgaagacccaccaggctggaaggttaacctgctactccctccatccctaaatgtttgacgccgttgaccattttaaatatatttgaccgttcgttgtcagggttatgtatactacatacctaatagtagttgactaaatctcggcaggacgcaccacataccatgtcctatatagaaacaatctgcggatataggaggagttccggataaggaaagacaaccagagttctacatgaaaacgacaaggactactcggattgtatccatattggtttccctagttctacttggacaaggggacacctatgggtataaatacaagcccccctaggaggacagggggacaaccatgatgagacgatcaacacgatcaacacccaccatgacgagacaatcaacacccaacacaatcgacatagaagccacaacatacaagccaacatactccaagacaagacgccggatatcgacttcagggataggcatggctattcccctacggtgtctccggataccgtcaggagagacgaaagcgctatctctgatctcgccgggcacagattcgaggaggaaggctaccctgttgtcgattacgagtcagatcttcagaccgacatgtcgataacagttagataggctaccccacatattgtattggtgtgattatggtgaataaaagcaactccggctccggccaacaggatgtagggttattacctgacagctcaggggcccgaacctgtataaaaatcctcgtctccatctcttttacctcagtcttgtgtatatcctagcaccaacgttccccatactgtccaaataccatagtcgagacatcaaacgtcgacagtggcgcgccaggtagggggattttggtgctctaggatttcaacgagatgggttcaaaagacagattctccgacaacaagctactcgacgacttcgctgtggggagatctaacccgaccagagtatgtctctcgacgagatcggaaccatcgtcgtcaacaactcgatctctcgagatcgaccaaacttcaagacgtcaccgccacagagaacagtgacttgatattatcaactaggaggtctccgatctccatctcttcggaagcgacatcatcaactgatttttggtaacctcggtaatgctgctgcctgctcagaaacccggccatcgaggaaccaaaatcaacatctcgatctattcactggattcttttgggatttggatcgttctcacaccccgattaggatccaaattttggacccctgacgcatactgagaacatccatcccgacatcatgtgttccagggattattgatcacggatgtctaccaaggtatcgagaaaacaacaagacaaagatccaactaatatgcttgctcctgacgtgtacacatgcatatgcatggactcagtacgtgcttaggcatgcatgcattagttggccgacgtgtacctgcaaagaagaccaacatggctgtctaaattgcaacgtgttgattattcagataaatcaacggccgcccgtgatcaggtatttagtagattgattttttaaaaatggtctactaatttcgtagatacatccggcatgtatctacaaaggtacgcaatattttatatgcaatttatcgtacctattcagatgatacagcattgtcagatctataatttattacgtttacctagagcatgttttttatacaatatctattgcgcggatgtttccgacgttaaaccaactacggtctaacgctgggggctcactctgttttcttctgtataaatcatgcttgttcacggtttacataatgcttaatatttgcatctgcttgttgtatcctgataatactagaagatccatgcagttttttgagtacatactcgatattatctgctatatatcttgccttctaaaaaatatttttcaggaacaattgagcactcgagtaggttatggtcgagtacactccattatcgagaacattttcgacaaatgcggagttatcgcacccaacctaccaacaaagaccgacgacctatctcatagcatctgccatggctagactactcgagaaaaggttgttaacggataattcctcgcgaacgtcgtcggcctgatcacccgacatgattgcgaacggacatccggatatgctataagttgggtacgtgagtcatactagccacatgagatacacttgcaataaaccaactctagcacttccattggtgttcgagagataattctgctcgctcactggttctcgcaccagtacgcagcaatctctcacaccgcagcgtccattggtgttcgagagataattccgctcgctcactggttctcgcaccagtacgcagcaatctctcacaccgcagcgtccattggtgttcgagagataattctgctcgcacactggttctcgcaccagtacgtagcaatctctcgcaccgcaacttccattggtgttcgagagataattctgctcgcacactggttctcgcaccagtacctagcaatctctcgcaccgcaacttccattggtgttcgagagataattctgctcgctcactggttctcgcaccagtacatagcaatctctcgcaccgcaactaccattggtgttcgagagataattctgctcgcacactagttctcgcaccagtacgtagcaatctctcgcaccgcagcatccattggtgttcgagagataattccgctcgctcactggttctcgcaccagtacgcagcaatctctcacaccgcaacttccattggtgttcgagagataattctgctcgctcactggttctcgcaccagtacgtagcaatctctcgcaccttaacttcagatggtcaaggtacgactacagcagcgtagcggtcctcgtaccacgactccatgtgatcaagggattcctactcaccggttctcaaccagttgatcgtagtgatctctcgtacatttgcttcaagtggtcgagttacgactactgactggttctcgaccagcggtatagcgtttctcctactatttccacttctagtggtcgagttacgactactgcctggttctcgaccagcggtgtagcgtttctcccactatttccacttctagtggtcgagttacgactattgcctggtcctcgaccagcgatgtagcgtttctcccactatttccactttaggtggtcgagttacgactactgcctggttctcgaccagcgatgtagcgtttctcccactatttccactttaggtggtcgagttacgactactgcctggttctcgaccagcgatgtagcgtttctcccactatttccactttaagtggtcgagttacgactactgcctggttcttgaccagcggtgtagcatttctcccactatttccacttctagtggtcgagttacgactactgcctggtcctcgaccagcgatgtagcgtttctcccactatttccacttgaagttgtcaagttacgactactgctggtcctcgaccagtgatgtagcgtttctcccactacttccactttaagtggtcgagttacgactactgactggtcctcgaccagcgatgtagcgattctcccattacctctacttcaacaaagttggcagcaggtacacaatatcgccaagtgttttacccagagatcccttatcacacgacacctagcgttgaaacctatcgtactgtccctttacgccgtcttgacaaggcctccgaggaacctaagggatcttcggctggggacgcccagagccgataaggccttgtcggatcctgtagagacgaaagaccatgtaagatctggtcgtgtaacagttctcgccctgcgtattaaccaagccgtgtaatcggaaattgagttttccaacttcatggctgggggctaggatcagtgcttattcaaccaaggcaggtcaagggtccaagagccttatcctccgagaatgattctccgacgacaaggctgggggctagggacagtatatgactctacaaactgactgatcgaagtcggtaagagagaagacgctcatacacaaaacattggttggtaaatttaattcattttcaatttaccatacatattataacatgtcaccctttgagcattcgctcgggggctatttctatctaatattcttttctgagtattgatttcaggaaaattctattcgacattatcgaagatcgcatgtctctatggttctacaccaagatcgactaaggcgagtacgacaaatgtcgacaaagttccgtcgcggactctatgccttctcgatcgctcgagaacggttgctagatctcgacaaggaatacggaatgaagagatggtgtacccgccgagataaaatttcttgacttcaatccaaattctcgattacagcaagacgggagacttagtcgtacgctctgtactttctcggtcgacatcagagattgacttagacaaactctttcggtgcccgcacgaggctgacaaaggaagtccaacgttctctctaaactcaccgagaactgtcacatgagctcgataatagttactccaatgtctgcgcagttgagaatatgaattcattcatttgcatcgaagtcgggggctactgtcagggttatgtataccacatacctaatagtagttgactaaatctcggcaggacccaccacataccatgtcctatatggaaacaacctgcggatataggaggagttccggataaggaaagacaaccagagttctacatggaaacgacaaggactactcggattgtatccatattggtttccctagttctacttggacaaggggacacctatgggtataaatacaagcccccctaggaggacagggggacaaccatgatgagacgatcaacacgatcaacacccaccatgacgagacaatcaacacccaacacaatcgacatagaagccacaacatacaagccaacatactccaagacaagacgccggatatcgacttcagggataggcatggctattcccctacggtgtctccggataccgtcaggagagacgaaagcgctatctctgatctcgccgggcacggattcgaggaggaaggctaccctgttgtcgactacgagtcagatcttcagaccgagatgtcgacaacagttagataggctaccccacatattgtattggtgtgattatggtgaataaaagcaactccggctccagccaacaggatgtagggttatgtcacgcccggaatttctatccaaaattccaaacgcttacatgtgtgtgaaccctcgtccagaaatcagccgaggcacacaataacaaattgataatagagtacaattattactctaattaataagcgaataaaatgtcattacagaggtagatagttcatctcaatcaataaagatctaagcagcggaaaaaaaaagataaacggcgcagacgactccactccacaggtagcttgaccagggctacacctaatcctccacaccatcaacatcactgtagaactcttcctctgatgaatgattgcaaggtgagtatatgacatactcagcaagccacgcagcaaatatgcaagtgcacaggataacaaaggatggcacagtggggtttcatttgcataaacagcatttaataaacatttcagaatttaataaaacagttaagtaataattaaacaatattaatccaacactatacaacataccctgttgcataggcccaaccattctgaacaaccatcccggctgcacagttctatctccaaaccaagaatataccgttccaaaccaggagctaatcaaattattaccagttatagcatcttttattatgatgagaagtgtgagactaatcacgaaagacattgttagacccgcccataaccgcgggcacggcttttcgaatagttttactctggccagaggtgtaccactgtactcacaagacacagccccacaacatgtcactatgtgccttaataccaccacggtacctcggaaaggagctatgacagtacccctcgcacaacacgatccaccacagcgcacctttcctggatcataatcaatcaccccttataaacaaggcatggactccccagtgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaagtaatagtgaatcataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaattgttgaatagaaacaatagctttaaacgggatcaacatgctcaaagggttctttgggatctgtgtgacttgccttgctggccttggaactcttcaaaatcttctcctgcaaaaatggactctccggaaacgtcggaatctaaacagaaaggagcaaaatcaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaatcacttatatggattttaattgaattatgacgcaataatgaattattttttaaaaggaaaagggaattattgcgtcagcggctagggttcgcggtgaaccgggtgcacggcggcggctcacgaaaacgaacggctgagatctttccatccaaaacgaacggccgagatcgaccggtccacagccggaccacggaagacgacgacgatgacgtcagcggtgacatcaccaccggcggcggctcgggtgcgcaaactcgtcggcgaacgacggcgcgacgacgcgaacggaggacaccaacacgtagagggcgacgcggcgaactcaccggtgaccaaaacaatggcggaagatcaacggacggcgacggcgtcgaggaagaagcggcggcaaccttcggcttgacgacgacggcggagaggtggacgagatcggcgacggcttggtgaccacgacggcgacctccccgagcagcgacgacgaccggagcgacggcggcgcacggctggagctgcggcggcgacagcggcgctaggctacacgatgctagggctctaccggcgacgagaggcgaatgcgagggtggcggcgggtagcggcgggcttgggggtccttttataggagcaaggaggcggcggcgaaggcccacggcgaccggcgacatgaaggaaagtctagggttcggaggagagagatcgatccgaatcgaactcgaatccacgatttccaaacgattttagccgacgattccaaaagagaaaggtagaggagatcccgaagatcatttcccctctattgatttcaccggagaaggaaaggcgtgagcgaatttggaaggagacggcggcgcggctcagctagggttccggccgggcgacgacgcgaggaggacgacgagtccgacaggtgggccccacctgtcagcgggcggacgcgcgcgcgcgagcgggcggctcgactgcgggccggattgggccaggagagagagaaaaggttttgggccgactttcggcccaaagccaaaagaggatttttaaaaccttttacaatttaaattattcattaaatgtaattccatttattaaaaatacttccttagctcaaataaatctcagaaaaatctaggaattatagagttaagcaaagtatttaatgaaattttatctggccccattttatattggaatttattaattaaaattagatcttctcttctaggctttttaaaataaattccaattaaacaacaatttatatatttaggatttttagggtgtgacaggttattacctgacagctcaggggcccgaacctatataaaaatcctcgtctccatctcttttacttcagtctcgtgtatatcctagcaccaacgatccccatactgttcaaataccgtagttgagacatcaaacgtcgacattcgtcttattcaaaaaatttaagtaattattaattctttttctataatttgattcattgttaaatatacttttatgtatacatatagttttacatatttcataaaagtttttgaataagacgaatggtcaaacatgttttaaaaagtcaacggcgtcaaacatttggacaataagggagtataaacgaacagggagacatggcaaaaggcatcgatgaactgaaccaaggaacgagcctctccttctccctggatgcttcctcttcccaaaatccttttctctgaatcccaacctagctatttttccctgtctaattcttctcccagtctacgaacctgtatctcccttcaccacttggtatcttgtgcgatgaatgaaggattaaccctgagttatgctccaacatatcatagaaattaacccgctgattgagaggagcgaagatatcctgttctaataaatgaaattgacgctggttgatttgttaaaaaaacaaaaatacagaggagggaagagagctaattaaagatagggttaattggatccatgccactacaaatataccaaattagaaaaatgtcactacatttcacgatatcagctgagtgccactcgaatttggggaaattggaaccgtgccactccgttgggttttccatccactccctgttaatttcccaactccgacactcggcctcgatgcggcggcgaaggagctcggcgacggtgccatttcccaactccaatggcgagaagagttttggcaatggcggagttcctgcccctctttctcctcatgaactcgtcgtacttcctctttgcttcctcttcttggttccgtccacgtaggtgctgtggaagctgtgcccgcatgccgggagcacgccgccgtccgccagctctgacaggcagatggcacactccacctcggcccacccgccgaccatcgggactccgaacgccgcgccgaccgccctgacctatcggtgttggcgtcgtcgtcggacgccggcctaggtggctgtggttgcgcccactccccggagtcgcgccaacgggcgaggcagcggatgaggcaccgcgcggcggcgtggaggtagaaggcgaggagggagacgcgggcgaagatgatgaggatggtggccacgttggagaagaatgcacgcatcgacagtgaagtgtgaggtgaggaaccacgaggacgacatattgttaacgaccaaatttggtaatatcagcatcggaagaggagactagatcgaggtggagtcgaaggcggagattgattcgagaacagagcaagaatcgactgaagtccatatcggctacgattaggatcggatgggtctaagtcggactaggtaagccgatgcagccgattccgacagtataatttggtgtatgacatcgggttgaattgaggtgcttcaagatgattgccgcacatggatagagtcctgagaaggcaattgtatctattaattaggatgttttatgtaacttccttagagatatgtttgggcaaaagtctaccgcaaagacttatggtatcttagagtgtgttagagatagtggtcgtgtccggtatggacatatcttgtaattcttgggtataaatagaccccgagccctatgtaatttttaacacacacgttcaatacaatttcggcgcatcgccacctttttgctttagttttgttttcgacgagttcttactttcgggttgagctgcatcggttttgatcttcaacaagaggtaaaacttgttatgacgacttgtgttctcgagattagtgcttccatctttatgacactctaatcttgcctatataattcgtcgagttattatatatcttacattagctttggcaatatcgtcatctaacctacaatcggctgacatctgttaatagaaggcagccgattaggttaaatagcgatgttgtcctagattatataaaatatctaccactttatgaaacatccagcgtcttgattgtctagatattgttcttcttttcatacttaatgttgcatcagttgagtttgatctattaagtcgtgcttagaatatcaatctctagcatgtcctctggttgccgattagggtagtatcggagtttcagccgatcttatctgatttaaccatattcgatctatgtgcctaagtgacatgttaaatccgccctttatgtcaagatcttactgcatttaagtatattaagcttttgtttggtatattatacttgttttgatatctttatgtagagtagtatcggagtattagccgatacatgctagatctatctgatcggctatgctataaacatatataatcatgttattaatatatatttcgatctaagtgatttatactgtctcggcatggtgaccgatctatcccaatcacttgatttaagtatatattaatataagaactatatatcgttaatatctacagccgatcgaatagatttagttccttactgtctatttataaccgccgatcgattcatatatgacatcggctcaaagataaatgatatgtcatcggcacctagccgatcggctattatttatagatttaaccacgaattctttgtctctatttcttgttgattacaggatcaaatcaactggcacgctcatacattcgaaggtgagctttggacctgcactggagttaagcagatctcccaggcctcgtgttttctgtcaacacatatggaggtcttgacgacacgggagacgacgaccgcgcccctatggtagaaatctacggcagagacgagctccccaggtagcaacacccttccctgccgctgatcatctccgtcgagtggagcagcggtggcggcagcagcggcgacgtccatgcacgggaaagagaaggcgtcgacgaagttggcactgtggacagggagtggatggaaaacgcgaaggagtggcatggatctaatttcccaaaattccagtggcacccagccgatatcgcgaatagtggtggcatttttctaatttggtatatttgtagtggcatgaatccaattagggatacatatacacacatgtgtgcacaacttcacctcagattttacaagcctcataaaacccaaaccttatggcaactttggccatgtaaattgttggattgggatgcactaggaaaatacaacaatgctgaggtgatctcctacctcgtcgtctcatagtcagggttagaaattttggaccaaaatttcggaaattttggtcatttcggtgacccccgatatgatattaattcggctgaaatttttgaatttttcaattttttcatgaatttggataatatttgttcaaattcaactaaattttgtttaaaattttagaaattttgaaccgaaatttctgaaatttcaggatttcggtgaccccaatagaaacccctaaaccgatagagtgaaccctgctcgtagttaggctagcaccttgttttcggccggtgacaaacaagaaagtatcatccacggacaattggcgtgagactacagctgtgttccgacttccggcacgtcggaattacaatcgaaaagctctccacacaatcaacaattgcactcttttttttttagaactcatgattttatttaaggctaatagcacgttatatgatgagttgatacaacttccatagagtaagaggagagcaagcccaaaaaagagaagctgacaagtatgcccacaagcatacgggctggtaaacatacagcacatattgcaaaagaactcctaaaagatagaaaaatgcaaaagggcctagaaaaaagcaaaggacttctaaagataaggaaaaaaaaaagcgatctggtccttgcgctgcttcttcctctaatctggtgaccaggacaacgaaaccgacatcaacaacgacggcgaaagcaagggagactgtaaaatagagctccaagccgtaaaaccatacggggctttcaccacacaaggcggaagttgacgcacgacaaaaagaataggaagaatacagtcgcacattgaagaacgtcgacagcaatgaaatggctcaccacattagtagcaactttgccggagttggttagaatggctggcatcaccttcaacagaaacaccaacctgcttgccggagaagcagacttattgcccttcaagcagcgaacaacgtgagagcaaacctggaagccacccaaaagcaggcaacaactaaggagatcttcagcagcaccttccatagaggaccaccggaacaagggagctcgacgccggtgaatcccttgcactacacacaaaaggaaaacggaatgaaccctacacggaatatatccgaccatcctatcgcctaagggtaaggaggccaacccctctccctaccctcatcagcggcgaaccaccggatcggaggaggaggaaaaggggtcaagaagaaagaggaaaaactctcaatggatctcagagtatcgcgagagggatagagaaagtcccgccccagctgatggcttcttctactgctctactacaagtgaactcgtatatcgtatcccatgtcatggatggagccctatcccagtcatggatggagaaccaaggagatataattagaacaggtagcagctaatcataggagaagtcatttggtcctccggcgtaatcttctactccttacattccaaaatataataacatagaactggatgtctcatctaataccaaattattatattttagattggagatagtaggaaatatcaacaaatatgctggttgtgtttgagattgattaaaaagaagatgaagtcacagcaagcaaaacgagaaagacattagcatatgattaattgagttttaattattacaaactaaaaaatagatttatttgatattatatatatataaacaccgtttattagttttaaaatcatgctaacaacaaccgagaataaatctatttctgagcggttacgtgtttgtaacttgaaagactaagctcggaatatgaatcgttatcattgttaacaatgatagagaaagactacacaacggtataccgttgaacagtataccacttatccctcatgccgcggccccgcgtgccggcttctcccgagtatgtcgtgtgctgctagaattatcatcacgcaggtttgttgtgtgtatcagtgtatagtcttgttcctgacagctagctagtacccagcatgcctaagtcatgcctttgatactagcctagctagtaaataaaactggaggtactactagcttgttgtgcatgccaaatccctgtaatagctacctacgttacctagatacggggatacggatatggatacacgatacgtcgatacgggatacggcattttccaaaaaaacaaggatacggggatacgcttttatatatatatatatatatatatatatatatatatatatatatatatatatatatatatatagaaatttgtttggtgctccatggtgcccgggcaccattgttgaaattgagtatatacccaattcaaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtacgaatcaaattcttataactaggtatatactcacaattagaaaattttgaaaaatttgagtgattttgtgcatttgaaaccatggtgcccgggcaccatggtgccccatatgagtgtcctatatatatatatatatatatatatatatatatatatatatatatatatatatatatatatatatatatatatatatatatatatacacaaaaaaaattaaggaaattgcatttatatataaaaaaaatacaaaaaatcaaggaacttttataaagaaatagcgatataatactagtatcagtgtagcagattccatatcaatattctgcaattttctcttctataagcaattcaaattaacaagcgattaagatcccaaaaaccacatattaatagttcaatcatatatttcttgatgactttgcatcaacattagaagccgcactaagcagtaacctctaggattgctagatgcactagcacttgtatctaataaaaacgatagtactttgtcctaaggaaaacaagaaaggcacagcagattcaagcatgaaacttttgaagataatggattacccggccaggcagtcaagcgaagaaagaaaaagttgctccgtgcttcgatgctactagcctgccactggccaccgctatgcccggcggccggcgtcggaggaagtgcctcacgcagtcacgcggcaagccggcaacagttctggcctcgaggttggcggcaaaagaggtgcgccaccaccaggctggcggcggcggctctgccgtctcgcgtaggggacgttgtggccccgcgcacggcagcgacgcgcgcggctgcagccggcgtccggcggcaacgccgggcacgcacgagaggcatcagccatcaggttggaagctcgtgaggtggcgcatccctgatgcgagcgaagacggaggaaggtcgtggcgtatcgctggcgtatcgtgatttatttatttttttggaaatcgcaaatatgtgggatacgtacgggatacgtatcggagcgtatccgatacgtatccgtatccgttgccgtatccgatacggatacgtgactatgcagccgtatcagggtaacccagatagctactagtagacctgtaccctagctatgtagggtacttattatggcggagcctagtagcctagctacgtgtctaagatgagttgcatctatttgttgtgtcctataccatgcacggattagaccagacaaataattacctagattatacatggatacaatggattattctaattagatatgtcatgttgggctcttagttataccacatcttagaaactctagtatgtgatacatagatgctagattatcatatctgatatctaggtattgggtcgaatacctaggtaccaggtatgaaacctataaatacaagatctgatgctgagttatccggcctgatacctataagtaccggatccgataactaggtatcgcgtctgatacctgagtactagattggatacccgggtatcgggtatctgatctcatacctatgagtatttgttccaatatctatgtgtaacgggtcggatacccaggtaccgagtatgatacttatgaataccaagtctgatacctaagtatcgggtctgatacctatgagtaccggattcgatacctaggtcaggtttgatacttatgagtatcggatccggtatcgcgcatgatacctatgagtatcggatcggatacccgggtatcgggcatctgatcttatacctatgagtatcagttccgatacctgtacgtactgggtcggatacccaggtaccgagtataatacttatgaataccaagtctgatacctaagtatcgggtctgatacctatgagtaccggattcgatacctaggtcaggtttgatacttatgagtatcggatccggtatcgcgcatgatacctatgagtatcagatcggatacccgggtatcgggtatatgatcttatacctatgagtatcagttccgatacctgtacgtactgggtcggatacccaggtaccgagtatgatacctatgaataccaagtctaatacctaggtattgggtctgatacctataagtaccggattcgatacctaggtcgggtttgatacctatgagtaacggatctaatacctagataccgggttgatacatattagtagaggatctgatactaaatatagggtgtgatggtacgagacttcagatgtgataccactaattctaatatttatgggttatatacttctattcaacaatcaaataaaaagatggaccatgcatagctaggccagaaagtacaaccaaacttgctcacatgccgctgacatgctttgtttaggctcatgctactagctctagtgcttaattctaactttactagttgaaccaggtgtcagacccatatggacctaaagaggtgtagaagtagtgctgtattagagtatttcatagctattttgtactgtaggagaaaagagacctctcgtcagtcatcactagtcggcagcctccatgtgaaaggacagcacacgacacgcttttagagagaaaaagaatcggtgagtgattggtaagtataaattataaactataccgttgagacagtacaccgtcccatagtttaatttggaatcaaaccggcccactaacatacgagaaagactggtacattggcccgcaaatatatgggccttttatctgttcatctaggcctacccaatctcggagtttttcacaaaaacccctgatattaactctagcaacatataggtcctgatcttttctaagaagccccccttttcagtccagatatttgcataaatatcccttattttaaccgttaacatcctcagcggtcaggattatagcataaaagcccttgatactgctctagagtcccccccccccccccacgacgccttcagcgacggcgtgcccatccgactccgacgacgttcttccgcctcgccgccgatgatccccgccggccagccatgtgtcctaccctacccacccaccagcagccgattgcacctgccactgccgtttcttccctcaactgtagagtggtcagcggagatggccggcagacggcaggggggcaaccttgcctggggaccgcgcctcgcgccgtgcttggagacgacggtcacgtggttggtcgccgtgatgaagcggcttctcgacttcaacccctgcgccccactggagtcccagcagtacacggggcaaggccccggtacattgttcacccctcgcacatgacttgtttgttgaattgcctgagtggaaatcttacgcttacctgacctgcgctatgtgtttctttgatgattgagttggtacatgtgttctcctatttcatcatactttgtttcaaacttatactccatcccattttgcaaatgagatatgatgatgacatgatgtacagatgaaagaacgagctataagctggactgctagagagctggatggagaaggtcaaagcgcacaacaaggaggagctcttgcgcaagcagagctctttgctgggcactgatggtaaaccggaacaaagtattctcgaggcaactatttgaactcattggaaaatttgtcaaccgtttttctcttgacaaacttcggccaacgaacgcatcgccagcccagcaaaaagaatgaactgtcaagcattctaaaatctaaagccaacactacctattgctttatatcttagggctggtttagttcccaactttttcttcaaactttcaacttttccatcacatcaaaacttttctacacacacaaacttccaactttttcgtcacatcattccaatttcaatcaaacctccaattttgacgtaaactaaacacatccttaatatggtggtagagatgctacagtcagtagggtatgaaagatttgattggaatgaaaggtttcttgaaaggttaaatgttagtcttctgtttttgcgtgcaaggtatacttaggatttcagcttattgaagaaccaaaacttcatcatgaaagcaatatttttttagctttgtaaatcctaattgtagcaacagaaaaatgcactctatacgagagtatagaagatatttgcttcaaaacaatcttgatcacatatgaattcattttatcttttaaagtcactgattccttagcttagtagcccgttcatacccaggctaagatttaaagtggattttagtgcagaacatactaacataagacagccccactgactatttgcatagatacacattgttgatgtgttcctgcgtatttctgcctactgcaatcctttgtttttctcaccgggccggcctacttccatctccacttgggcatgttcttttacattgctgatttatcactttatttttgtactttgattatagtgaacttcatgattgctggcgtacttttaccatcatgttctcccatacaacttagactgcgcagggtgcaatgctacgattgattttcttttttaccttttgaatttaattgtacaatgaattggatgaatgcccaaaaagcaattggaagttttctgcagccagtcttagttttagcacgattagatgtgagctcatgaaaatttcgtcttttgtgatctcaactgctcaaggttcttttgctgccttttctttggactcaactttgactaagttctttgagctactgatgggcattgatgtttttcttggtgcaggatacttgataatgtaacctaaaaaagcaggatggacaatgaaactgaaagaagcaaagttgtgatgatgagatgagttaaactactggctgataacaaagttgcagtaatttctatgatccccctcatgctcctactctgtctttatatctctttatttgttttttttttcctttgcaactgtgcccttgctttggaacaaaactttgataaccatttaacacaatcgtcaaagcagaaggaaagcttatttgcaattcccttttggaactaatgacatctgtttaagtaacaacgaccaacctcaaaacttctgctgcaacattgtgtactttgttgctagactggatgaacatctagctgatgttctgttttagcattgctttacttgagacttgagagagcctgctaccagtttcacttaaccattcgtgtttatcttcccaggatttaatatgctggaattaggaagtctgaacaacattttgtggaggctactttattaaactgcggtgctgctctgtccaaacttgcgctaactgcgggagagaaggggggctagcgtgaaaagaagaggtaaagaaagagaaaggcaaaggcgcgacatgatgcctcgtccaagctttttgttgtcacgctgccaaagaggacaaggatttggccctgcttctcttcttcttcctcctcttcttgcggtaagatcactactactattaccatcaccatcaccgcatcatttgccaaaccatggaccagcttgcctttttccaggttgcagctgcctgacgcagtttagccagccactgtaaagtgcaggtccatttatctgacaaatagagtatgtgagcttaataattgtacagttttttcaaggtcaattttaggggagtaaaacacaattagttttggaggggaaatagcttttgacattgctgtgagatgaggggttggtttggtctgtggcctaaataggtattaccaaattttgtcaatgccaaattttggcaagttttggcatgactaattttggtaagtcaaaattgtgtttggattgaagccaaaatagcctaagttcactattgaaatggcatattttcttaagcatgccaaaatttggattcaaaccaaatagacactaaacactgttgaaattgacaaatattggtaagtctaatttattcctcaaaccaaaccagcccgagatggtttgtgtaggtgaactggtgaacagtttggcctgcatctgcattggtaggggcctaggagcagacaagaacagagcaaaagtgaaaagtggaagcatccagtactgtcaatctgacactggcgccacagctctcgcgaccactcctcatctcacacttaccgaagcaacaataaaaccgttctatcctcgcttcaaaaatcgatcaaaaaattcaaaaatcaaaagtgaaagaaaggaaagcacacgatgcttctcttcacccaatgcagatcgatgggggtcgtaccagtagcagagatcatggctgtgagcctgtgattgagtgatccctttcctccatgccaatcttgaatctttctagctaaaagaatcatctgtgctcttgtgctcgcagctagctgcacagtggtgacaatggcgatgctgctgttgttgcgttctttggagttcttggcgatcatggcggttgcatcgagcttggcaatgccggtggcggcggcggcggcggtgccacagccggagccggaggtgaagccgagcgacaccgacgcgctcaccatcttccggaacggcgccgacgcgcacggcatcctggcggcgaactggagcacctcgaacgcctgcgccggcgggtggatcggcgtcggctgctccggcgacggccgccgcgtgacgtcgctgtcgctgccgtcgctcgacctgcgtgggccgctcgacccgctctcccacctcggcgagctccgggcgctcgacctccgcgggaaccgcctcaacggcacgctcgacacgctcctcctcggcgtccccaacctcaagctgctctacctctcccacaacgacatctccggcgccatcccggacgccatcgcgcggctcctccgcctcctccgcctcgacctcgccgacaacagcctgcgcggggccatcccggtggccgcgctcgccaacctcaccggcctcctcacgctcaagctccaggacaacctcctcaccggcttgctcccggacgtcaccgccgccctcccgcgcctcgccgagttcaacgcctccaacaaccagctctccggcagggtgcccgacgccatgcgcgccaagttcggcctcgcctcgttcgccggcaatgccggcctctgcgggctggcgccgccgctgccggcgtgctctttcatgccgcgcgagccagccccgacgtcaccctccgtcccgtcgtcgccgcagtccgtggtgccatcgaacccggcggcgtcgtcgtcgtcggttgcttcgtcctcgccggcgttggccacaccggagtcgcgcgacggacccggcaagggggggttgagcaccggcgccattgccggcatcgtcgtcggcaatgctctcttcctgttcgccatgctgtcgctgctcgtggcgtcctgctgctgcagcaccggcggcgagagcggcggcgagccacccaagaagaggaaacgaggcggccgcgtcggcctggaggatgacgacgacggcgggatgttcggccaaggcaagggcgtgcagccaggccggccaggcagcgccggcatgcgcagcgacgacggcggagacagcgacggcgcgcgcagcaagctggtgttcttcggggtggacggcggcgaggacgacgacgacgacgacggaggcggcagcgacagcagcgccggcaggagggcaaccggcggcggctggacggcggcgccgcaccagcctcacgggaggaggagcaggttcgcgctggaggagcttctccgcgcgtcggcggagatggtcggccgcggcagcctgggcaccgtgtaccgcgccgtcctcagcgacggccgcatggtcgccgtcaagcggctgcgcgacgccaacccatgcgcccgcgacgagttccaccgctacatggacctcatcggccgcctccgccacccaaacctcgtccccctccgagccttctactacgccaagcaggagaagctcctcatctacgactacctccccaatggcaacctccatgaccgcctccacggtacacatccatgtctgatgtctcctcctcctagctgtgaatcgccatgagagtggcacgatgagctcgatctcgccattgattgtgtttgtcagggcaccggatgtcgggggagtcgccgttggactggacgacgagggtgaggcttctcctcggcgcggcgcgcgggctggcatgcgtccaccgggagtaccgcacgtcggcgatcccccacggcaacgtcaagtccaccaacgtcctgctcgacaagaacggcgtcgcctgcgtcgccgacttcggcctggcgctcctcctcagcccggcgcacgccattgcccgcctcggaggctacatcgcgccggagcaggaggacaacaagcggctgtcgcaggaggccgacgtgtacagcttcggcgtgctcgtcctcgaggcgctcaccgggaaggtgccggcgcagtacccgcagccgtcgccggtcgtcgccgccgacgccgccgcagacgcgcagaggaaagacaagaggtgctcgacggcggtgagcctgccggagtgggtgcgatcggtggtgcgggaggagtggacggcggaggtgttcgacgtggagctgctccggtacaaggacatcgaggaggagatggtggcgatgctgcacgtcgcgctggcgtgcgtcacgccgcagccggagcagaggccatccatggccgacgtggtgcggatgatcgagagcatcccggtggatcagtcgccgttcccggaggaggacagggacatctccaccatgtcgccgtcgatcggcattaccactgacgacggagatggtcgtctcagctgctagctcatcatcatcctcctcctcattgatcttcttttctgaattctgaacaactctgcctgctgcattttttctgatttctgaaatgatgctctgctcgatcttggcattctgaagtctgaaattgctactgcagctggtattatcttgagctgcttttcacttctgctgaaatgtcgaattgtcgatgtgcctgtgcttggaagatggtgcttgtgttcttgtaagataattttggattatgatgtcgaatgcatgctcctggagaacgctggcagttgctgctatactctgtttgcgtttgtcatactcctctatttttaactttgacacagtcttcgagatactagtttgatcaataatatctatataaaagtaaaatattttaaataaaaagtaaaatgttttaaataaaaagagttgtatattgttatagtttatttaatgataaattaccatcaattacattattgatttttttattttttttgctattaatagtcacaattataaatatttgacttgatatatgctaaaaatacttacttatttttggatgaaggaagtagtcggtatggttgtttctttgtttctattagcgaatgtcgttttgtgacatactaaaatgctataaaaatgagaatatgggcaatcttctactactatcacatcatcattttgttctttttttttctttgaagcggattgcgtatgttgtacaacattttggggtgtgaagttcatggcatgctcacgccagacgatgactgtagactatagtactatttcggttgaaaattagcatttgcattattattctattagttagcctgtgttcttcttgaggaggttgggaaccatccctctacacgcaaagtggtgtgatagagtaacgcatgattaaaaagaattaatatgatttttaaagcaattttgttataattgtttttacaaaacatactattaacacgaaacggaaggggtgagttgagaacataagacagatgctttccgaaagaacgattgagctaccctgattaatcaataccagtagcaaaaatgaccagcaatcctgcctcataaaacaatgacatataggtttgctaatgccaactgctaagccaaatacaaattcgtatctgttctagaagactaaaagtagtctattggaaacagaacaatccggtcaaacagaagcatcttgtatgaaaatggtagtccaggacgaaaaagaaaaaaaatgagccgacaactacgttgacatcgttaggtaaacgtaaacaaaattccttacgaaaaaaaaaaaacaaaaacacatgtagacactgtagagaccgatcagtggtccccacgagaccacgaagaccatgtccattggaagcgtagaagaaaagcggaaagagtttgaccgatgcatcggaacacggcccgccacgctggcaccagacggttttgatgggccggaccagtctcggcggctcggcccaccaccacccatccatccatccatccatcgcggcgcatcgtacggtccagagctaacccagcggcgggtccaaacccgcgtgcggcgcggcgcgtcaccatccaccgtttattcgcagctcgttttatcactacttaaccctttcttcgagatttcccttttcttggaggcgccacgtttaaagggcggagtcgctgtaattagagaagaggatttaaagagagagaaggccattctctcttgattgcttggagaggaagaagaacaagagccgccaccgccgccgttaggtttttatttattttttttctcgatctgatccgaggaggagcgaagcgaagaagggcaagatgcattcgacgaatctgctgctggaggagcccatcaggatggcatccatcctggagccatccaagcccgtaagttgctcgaatgctttgatttcgcttcagatttgtttggtttttttttgttgatgaaccctaaattcgattgatctgcggggaaaaaaatgcacagagcttcttcccggcgatgaccaagatcgtggggacgctggggccaaagtcgcgctccgtcgacaccatctcctcctgcctcaaggccggcatgtcgggtaaccaatctgcttgcttcgccatctcctgctcgatcgagctgttcttaaccttcttgtgttggtgttggtgttgtgtggtgcgaattgcagtggcccgatttgatttctcgtggggagacgccgagtaccaccaggaaacccttgagaacctcaaggtcgccatcaagtccaccaagaagctctgcgcggtgagcccccctcctcaccgccttcagatttactgcaattcgattcgatttgattcattcacggtcatggtctcttagtgtttgcttttgctgtttttgcatactgacattttgggtactctactccattggcattggcaggtcatgcttgacacggtcggcccagagttgcaggtggtgaacaagagcgaagcctccatctccctcgaggagaacggcactgttattctcacccctgaccaggggcaggaggcctcctcacaagtgctgccaattaacttcgctgggcttgctaaggtaatactccctttcagttcttttttttttccgaaatcttattacgctgtgcatgaatggttgcaagcgcataggtaggagtacctttcagtgctatttatgcaaaatcttattatgctgtgtatgaatggttgcaaatagataggtccttcttttatggaacttgctattttgtcactgcgatttccagcatatgctctgtttgatatataaaaaatgacttattgttttgtttgcaggctgtgaagccaggtgacacaatatttgttgggcaatacttgttcacaggcagtgagactacttcagtttggttagaggtaaaaatattcggcatactgcgcttagcgttctgcatttttttttcttatgtcattgtcagtaggatttgctttgtgcccacattttccgataccaaaactctaatttgtctggtttaggtttctcaaattaaaggagatgatgtggtctgtgtgataaaaaacacagcaactctggctgggtcgctcttcacattgcattgctcgcagattcacatcgacttacctaccctatctgatgaggacaaggaggtaaggaactcatttcagaatagtgatatgtatctccttatgtatttgtatttgatgtcttcctttatggaattaagtaaaatgttgtatatttttccttttggagcaccttactcaaaatctgtcctttatggaattaagtaaaatgttatatatttttccttttggagcaccttactcaaaatctgtccgatgccttaaatgcttatgagcatgtactgctttcaggttatcagaaaatggggtgccccaaacaagattgacttcctctctctttcttatacaagacatgtagaagatgtgcgacaggtaatacatttttttctcaacgttcccggtgttttgtccttggaagtaaccattcattgaaaacatggcattgctatatccaaatatgtgatctcctgtatgttttcatttggtacttgaaaaggaagttctaaacagtgctgacatctttcgtttcaatacaggcacgtgaattcctctcaaagttaggtgaccttagccagacccagatttttgcaaaaatcgagaatgtggaggtatttacaacatgcacttttaacatctctgagccagcttctgtttgttgtacagcctatcaaccccctatctatttttgcaggggttgaataattttgatgaaatcctccaagaagctgatggtatcatcctgtcaagaggaaaccttggaattgatcttccacctgaaaaggttagtatttctagcttacgtcgagcacatcagaaggcactgcttaattgtacatccgctacacttagtaccttattaacaagaattgtagttttctcaaattatggtgcaatacttgtctttggtttagttatactttatttattttgctctttgacctttgctgctcatactgtaggtgtttttatttcaaaagtctgctctgcacaagtgcaacatggctggaaagcctgctgttgttactcgtgttgtagacagtatgactgacaacctcaggcctactcgtgcagaggctacggatgtggcaaatgcagtgcttgacggtgagttgtttgagctattggtaatgttaaattttcaattgccttctgatagtttaacatacttctattgtttagggagtgatgccattctccttggtgctgagactctgcgtggtttatacccagttgagactatttcaatagtgggtaaaatttgtgctgaggtgaattttcttcctaaatatgtttttatttacaatgtttaacatgtataaggcaaaatcatttctgcccaattttcgttctgtattagtttgttagcatcatcaagttaatggcatatgacatccattgttttgcaggctgagaaggtcttcaaccaagatttatacttcaagagaactgtgaaacatgtgggggagcccatgacccacttggagtctattgcttcctctgcggtgtgttctttggttcttttcatgtttcagacttcatttaatgctgttcacacggaacacattttctcatattccattgatttaagtctatgaggcaagcattttctttttagtctgaactggttccttcactattttctaggtgcgagctgctattaaagtgaaggcgtctgtcataatttgcttcacatcatctggacgtgctgcaaggtagaaagactgaatataagataagtttgtatcttaatggaaaactaatatcatctctaatctggcatctgtactatctgcaggctaattgccaagtataggccaaccatgcctgttctatctgttgtcattcctcgtctaaaaacaaatcaactgaggtggagtttcactggcgcatttgaagtacgtgatcagcctttctttttctactatgtccatgatctgtttctaactttctatacagatgtttagcttgtcttgtttggttaacgcttagctgttgtagctcatatttcttgtatccttgttctgcaggcaagacaatcgctcatagttagaggcctctttccgatgcttgctgatccgaggcatccagtaagtttggcttctttgttgactacagaaattgcaaaaatattcatgcaaaacatacttggtggatttattttcttgcaattgaaaggcttggccttgtcatgggggctttttcagatttctaatacattacaatataacaaagcttagtagatagaagcgtcaaattttaacatgatagctttcttgcttgcatcatgttccacaattattaacacttcatatatgataaacgtaaaaacaactggtatgcttcctgcattgttaactgaaatattcttgaacttgataagctgatttgtagagaccatttaggcgcaataagccagcttattaagtgctattattctcgggtgcaaattttgtaatcatctttcacttcgtctttcaggctgaatcaaccaacgctacaaatgaatccgttttgaaggttgctcttgaccacggtaaagtttctggtgtgataaagtcgcatgatcgcgttgttgtctgccagaaggtgggagattcctcggttgtgaagatcattgagctggacgattagacaagcagcttgtgctcgtcgtcgatgatactatggcatgttttgccagattttgactaggccaaaaacgttgcttcttggctatgtataatcctatagcttcaaatgagcagtttttcctatggtgtattcataggatttgccttacagcttgaaaccattatgatttagttaaggaaattaaatttgcgcagtatttctgtatcgtatcacttagatgggcaaagggaataatgaattttggtactgaaaccttttaaaggtcgatgcgacctatttttcatggatttttcgtaatgctacttgacgtccatcaaagtgttcatctgagtctgacaagggacaatcgatggttgatcccacggtcacccaccatgtacgaaactcgagcatttcaaggaatatgcagtagtattgtctcaaaagcacatgatcacttgcttgatcctttacacatttcataccaataaaaaaattgccttgtaatgccaactctcgagtacaatcctgccatggttccgcagatcaaattggaaagagcaggcagctagtcaatacaagtaaatttcatgctccacagccattacagaaaaaaatcacggaaaacagctgacatgattgtaattagctcctacaacttcatctctctcctataccaacttttgaagtttccaatctacaagtcgcgggttttacacttgaatgtgctgtcctgtactgcagtctaaacagtgatttacacggtgaaagttaaatgaaaattattttggctcactatactcgtgccgttgccgtttgccaaagcactacggaaaaaaaatggttaaaagtattacttgtacaaaagaatgatcatcgacaaatactactaattacaatggattgaccatccagaaacaattgtgcagggagaacctgatgatacccagtatcttctgaagcttctatcagaagaggtcacaactttcctctttaggacatccttagatattgacaggtaacttaaaaaggaagacaattgttgattgaatcacttatttaagtgacacgaatggctgaactggggagggtcagaagatatccggttagtccacagattagcaactttaacaaaatagtgatcaccatcccaaatgatcacttccattcctacatgaagcgaacagagtaaattaattggttgatagaaacatctgatagctaaaaagttcctatccttgaagacgtcactgtaggacaagtattacctggtaaaacactagtcggcaggagggtatgcctacatgtcatcttgctgttgggaagggaacattggagagtggccacttcaatttcgtcaattttaatgatagattcgagaagaactttagcaacaggtgcatctaagttattgctgtcaacaaccattctaagagccgttcctagaccattattagtccatgcattcaggcagccgtcccaacaaaccaacattttactcaccattccaggatcagcaagaacccagggcttgaaggactgcaaggataaatttagaatctgtgcaactctgtaaatctccccaagagcaataaagaattggccacctgtgaaaccagcagaaagcatgttatagtcaatcttcttttaaatgatcagtgagaaaggaaatgataagctctgctcattgttccaagtttttgcaccttgggaaattactacgctgcagacatttgattgacaggattcttgccaaagcaccacaccatgctgcaattcttgagcacagaacagaagcattctgtaccaggcacggacgtaatcacgttgctcctccttggatgcttgctccaaggtatgtaatgttgacacgctgtgcttgtagagttcaactgccaaactcatgtcttccagtgcttatatttgagtatcagataagaattataaaaatttaataacccaagaaagatcgcattatgacccacgaaaacaagaagcagaaggtagaatggtaaactgcaagattaactgcacatattgtatactgaaacaaagaaaaattagttgtgtgccatctacagattttcgttgttttgtataatctacagatcagttaggaggcaattctaatgcggaatatggaaaagcactaatccattcatttccacataattatgtttatcacttatagaaaattgtgcatgtgattattacatgctatccacctaacaaaacaagtgtattgatctcgagtaacttgagaataaattgcaagatttgaccatctaatgaaatagtttattttgggtctagctcaaggaggtaattcctaacaagtactagtaataagataggcagtgtgccgaaacattatattccccataggagaatgcataccatcggtatcttttctattaaatgatattcttcctcaaaatccttcaaatgaacctctctggcactgtcaagcagttcagaaatgaatacatcctttgcagtatgttcctctatacaaaaaccttcaggtagtttctcacagatttcctggagattatggaaaatgtttaaatgacggactatattaaattcatttttttttgtgccaaacaatagtttcaagtgcttgagtgcggagcacacctgaatctcccttgcaattgctgaacttccctgttttcattagaaagcatagaactcttctggactccatgttatcaaatgaaaaggcactatcttgtgttgttttccgttcaaaaaaaatgttatcaaatgaattgcaaaattacaaacagaaaaataccagtgatttatcaactgaatgtaatcagtggttactgaccttaaaatccttcccattccgaaatattactgtcagtgtttcttccctcagcttatggtagaaatcaatcaaagtcctatcgcttgaagatttaattgaatgattttcatctgtttcaaatgaagagttctgatcactgatcattagtgtacatcacatgaaattaaaaagaggggggtgatagcaaactcaaaatagcaaaaatactcaccatttcattatttgagaacatatcagaagggctctgcacactttctgaagaactttgtgtcatgtgtacagcatcaaccagctcagtttctttgtacaggtcaagtatggctgcatcattaggacctgtggacttacaagtttcaatgtggtttgtagttcgaacatggttcaaattttcatccacactagtaaatagtgaccagtcttctgtcaggaatgatggtgatgatgctctgccgcaagacaatggcgccaagactctgtttgatggtgatgagaacgaaggaggaaggaaggacttatcaccacagaggaagcgggccaggtttcctaacaaacttttgagtgggcctgaatgggctaagtagctggcaagagaggagaggtggcgtgagtgagtggtgctgtattaatactcgaactcttgtaacgaattacttgactaatagaatctggaggcaattggcggcggaggatgcaatccggttggattggcgtgagagaaatctcatctgtgaaaattgttcttgcttgcaagttaggtagctaacatcttcctggtcacttcccaatgattttggtacatcctgtaatgacgaaattattcagaccaatcaatggaggaagccatagccatatcaagacttaatacaaagagaaaaggtttagaaagaagtaatgataggatttgcaatgctagaatatactatcaaagaagtatattcacttgtttttttgcgggaactacaaaaaaagggttatttgtgaattaaaaaaatgaattcctgcctaattctacaacacctataacaatttccaagtagaattaataagttgctaaggcagagcttcacacttgatacagatacagaatgtaagaggaaaaaagttatcacatccctttaggaagcttgatcattcaatttgaacattataatcatgatttattgattcagttttgtgagactggtcgcgacgtccgtttcagcaaaggttatcttcatctctgcaattttctaagtgggctagactatctgagcctacctttcctttatcaccagtttgcctttggtaaaatgccttaagtaaacagtttccacataatactatctcacgcgggcggctcggggagcgaaaaaccctagccgcccgcgcctccatcccttccccccccccccccacctcgccgccgccggagcttgccggcggcaaagccggcagcgagcagggaaggcggcggcgaggccttctttgtggcgttctccctcctcggcgcgacgtggacgagatgatgacgaagctccccaccggcgtggtcaaaggcggcaacggcggggatgtgtggggaggcggcggatccggcgcccccaaggccggatccggccatcccccgcctggagctggcgcggcggcggcgcgaggcggctgggcggcatgcgaccgtggtggcggcgcgcggctgccgagcggcgtggtggcgtgcggccgtggtggtggggcgcggcggctggcgttctccctcctccgcgtcagaggcggcgacgacgggcgttctgctcctccacgtcagaagcggtgatggctggcgttctgccgagcagcgccgtcccaggcgtggaggctgctaggcgacgtgcggccgtcgtggcagcggtgcgcgtagccaagcggcacggcggcggtgttccgggcgcggcggccgtgcctcgccggtgtgagcgcgagcggccaggcctcggtggctgggcaaccgatgccgccgtggtggccaggtggggagcggcggccgggcaatgggagcgccggcgggtggcaccggagccaaagcggcaatgtttccggcgtcggcgcaggcccagatggttgtgctaagggagctggcggcgataggtcgtcttcctcgttgccggtcagcaccctcacccttcctagagctcctccccttctctgtggggagtttctaagctggattgaggcggcagcttgttagcgggagaagctcaggctgctgaagcaatgccatccaatcccgggttctccttcggccagatctggcgaggaggccggcgggtggtggaacggagaggtcctgggccagttctcagggatggtggttcgatgaagccggccgacagaggggcgtcggtcgggtatggcggaagccatgtgctgccgatgttcagatggtggattcggattgggtgacgtaccatggtggtagggggttccgagcgaaagcttagcccaattctttgggccaacagtgactttgccttcgggcatagtaaccctcttgagggcactgttgaggtatccctcctccctcggcaaggagctctgggtgaaaaccttgtccagtctttggatggatgacgtcggcgtcttttggcgtcgtgaccctcgtgagggcgttgttttggagtcttcgtgtcgtagtggtgtcgttagctcggtggcgatcggtctcgcatagtgatggccggttcggtgcttggctttcctctctgtagtgtgtgtttggacggttgacacatggtttggggcgtgtgctctggtgcacatcctttctcgacagccagctgtcgatgtaaaacgtacatcctttctgccagctgtcgatgtaaaacttttcttgtaactttttctttccatcttaattacattgaatgacctttgaatgacctcctttggtcattccggcaatataaataggcacagcattatgtttttttttcttgttaaattgaactgtttcgtatgattttacatttgagtattgatcatgtacgtttggtgggaatgaattttgcatactaccccgggtttaaatatacggcatccttaacttcttttaatttattttcgtttttttaaaaaatatttatataaattagacaaatataaaaaagcatgctaaaagtacttttgatgggtcatctattatcactcttttcatttttacttacctaagtaattaaataaacattgtcgatcaaagtttaagaaaaaaaataaatagtgctgcatttagaaagggagtgagtgtgctgttcctccgatgaaagcaaatggatccttgacgttgagtgaaggaatcccttgcattcataggcaaacaatgcttatttcaaacttcattcgaaggtaatttgcaaaagataaaaaccttcccttcaaggtattcctaatggactaaaagttctaaacatcaacgcaaataaataaatgaaatcaagggacgccttgtcgttgtcgcctactcgccttgagtagaaactatagcatcaagccacatattgttcaaaaaaagtgtacccacaagcaaaaggttaaaagctctatacgaaccatagctccaatgctcacgaagcacaaaaatgtcaggagtttctaacaacaatatttgacaccgattgcgtgctgcacaactcgaatttccaacctacagtacaagatggtcaatactgcataatttttccagtaaaacatgtcctatccctactcatccttgcgtttgaacagtttaacaagatagccaattaaggagaccagccatcgccagaagagaactaggaaatttgacgccttcggtttgggttcaggccttggcccgaacagacctttgtatagctccttttgtttctggtacagagctttatcctgctccgcgagcgaccgaagctcgcgctggatctccttgtcttctggagaatacttcttggccttcaggaagtcctcccttgctgattctgtttgaccaagttcagctctagcttttcctcgtctgaacaacgctttcacgttgttttcatcctctgacaacacctgaagaatgagattatgcagttgatcatgatcagcaattctttgattcttattcaaatggtcaatcaacaggtccgtgaatcaatacaaaaccaaaatcatggttgttttacacaaatgagttggaaaagattacacaagtacactaagatcagaagagtgtctttcatgaagaatcatggacaaatatttctccctgctttagccatatgcctgttttccatatttattttgcaaatttttagtgtctgaatgacaaatcaaattcagttttttcttgtgttatacatgtaatgttaaagcatgagtgtaagagtaaattttatgcaatgtagaagaataacatacaattgtacactgtgcgatagcttcatcaaatctcttcagtttgatcaggcatgcggccatgttgagatggcagggatttttcacagctaaggccatgtctctgtacttcccaaacaattgaaacatgaaatcatcccccatgtatgcaattgcctgtaaagaagaacagctagggggattatgattgagcatcttacaatagctgaagaatgacatcagtagacaactaaccatttcatattgctgcatagcctcctcgaacttcttttctttgaaatattcattgccttcaatcttcctcctgtctgctgcttcaatcctttcttccactgtcatatcacttcgggcttttccctgtagttttacattatctgtaagcttcctaggaacctttggttcacaaatatttttttaaaaaaaatcaaaatcaagggtgataagagggatatttatcctacctctttgacatcatcaaacccaataagttcaacttcatatacaaggtctgccattggagggacatttgggaatgaaaagcttccttctttcccatagccaagctcccagttaacatgtaacaatgcacgctccccacttctcatgttactgacaccaatgcctaaaccagtcatttcctttttctctgttgatgagaagaaaaaaaaaagcttcaaagatttatactaaaggcaagtgtaattgatgctcacgtctgttcgtacaatactactcggttagttatctagttaccctgtccagcagatttattgaggcatgaaaaagaggaggtaaaattactagcaatagaaatatcatacttcgtctttagcctttgcaaggtgaggcaagtgggaaagttactggtgggaaaagttttttccccctcaaaaacctcattttgattggcattatggaactatgtgatgcaaagtaagctgtttgagttcatggaatttacggatgatatgcatatgtgcacagaaaagctgaggataaaataaaggaattaactttagtgttaccttttccaagtactagttcaattgaatgctgttcttgccaagtatcctcgaatttgtgcgaagaaccttgaacccatgctctatagtgaactgcaagacaaagattgggaaaaaaataatttgcaaaatcaggtataatatattatcctcattctaatcacaatcctaagcaaatggaacaaactgactacttatggcatacttaccaaagcatgtggcaaaccttgagggtttcttgccatggccttccttgatgacttgctttttgactttatcattaaggacttccatatcagaggtaaccacaggtggagcagtgccatcttgaggaggctcagtatgcacaaaggaagtttcttccactgttatctcatcatcgctagcacctaaacaaccaaaacacatgttcagacatagtactgaatttcttgaataagacaattcactgttctgtagtgtggccattttataaaggagattcaaagtactgtgaactacatccaacatcaaacatttgatgcgccccagttttttggggaatacacaaaaggattgcgcatcattcgatgtgggactaacccaacacggaagatatacttacagttttctagatgtgcgcccatggatacaggagtatttacatctgttttgcttagaaacaccataggccaaaggtcccagtgctacaccatctatgcctatgtacttatatggtgtagtgtcaactactcaatcaagtagcataacctaaccctgtaaagcatgaatcatgtgccaagaacagctaggttactgtttagttggtacgttacataattgcattgcacttgtataaatcttagagacttttagcaactccagaaaattggacagatttatcagaactaattgtcggtactatcgtcaaaatcaacgggatatgacataatatgctgtcatgccataataatcccgcctaactgcttacaaactactccagtagtattgaagtgcacactcgatagcacttgattcgagcattcggggttcattcggcaaggtgcaaactgcaaaatgatttgaatttgagatgaatttggcgtcctcaagagactgaatctagtttaaacccaaaccggacattttacaaccaaaggcgcctaattttccgaatcccataaaaaagcacatatatgctacgattccgcacggggattcaaaacaacagcctgccgaaccaaccgatccaactcaccacaccaaacacaagacagacacgcccccagggtgtagggagtgcgagagaaagcgggagactcactcaccggaggtagaatcggcggcgggtaccggggccggatcttcttccagcacggccatcggtgcgggacggcgggcaggcggctggtccgcggatttggaggcggatggctcgaggagacgagagcttagctcggcacttcaccgggggatcgtgcagcgcgacgacgtggtgttccctcttcactttcacttgggtggtccatccagtccaaggacggcagcgaagacagagaggtggatgagagagatgacgagccgcattcgtaccttcgtgggcttcattcaacttctaactcgttgccaagcccaactactcagtatggtccatgtgctactatggatctgtttgttgaatttttgttatatttttttgaccttttttatttttaattttaaaaataaacccttccaaaaacttattttcaaaatctgaacatttaggccacgctctggagtggcaaaacaacactgacacaccacctgcagcgccgtgacaatcttgtaatatcatgacagcgagagcagtgtgatcagataacgttgttacgctagcaagaccggcatggccaaataacactgtcatgatagtgagaccggtgtggtagtattattttgccacgctagttcgactggcatggccaaaaagattatatcttgaaaataagtttggaagggtttatttttaaaattatagattaaaaatgtttcaaaaataaaaaaaattatttggaagcttaagatcatgagaaaatagctggtttatagggatctgtagaaactcccaaaacaatggtcacaagaaaattagaattgaaaaaaaatgatacaagaaaaatagaaaacagaactattcacgtgaaatttcgattggaaaccaataatatgaccacatgggttaatgcttacaactatgcaaattgtgaacgctatgggacaaacagaaacataaccaaatgaggtagttagtgttaagtatgcgatagtcaagaatatagggataagaaatactaggatacaaattaatccattccagtaagaaatatagtaactaccggattacggtttgagaagacagtaaaccaagaaaacggtcgataaaatagcaagactatatcttttttttccccatttctgcttctcatgatttctcatggttaccctgcaacacttttagtttttcacccctaattatcaccgtcaacgcccgctagacggggcagggacaaccggacaagacaaccaagcgtaataatactaccaaacaacgaacatgcagagataaaccaaaattaagcggagtctgctacatgtgcgctcacaaatgagaagtcagaaccatatgcgtcagcaaacaaattcttcaaattacatagtagtacacaactgaaacaagctgcccatttcgcagctgctatatatttacaccaatcattctgtatgaaacacacaaatcaccgtcataatacaggctaagctattgttaccatgaccggatatacacttggatgtagaggttgcaatgattttcactatcggaaaaaaaaaaagagctactgttacctttgcccagctcttttcgctaacctccgcaattgaaaatcacagcacagtggtgcagcttaacttcttgccaaccaaactgtactaatgtactaccaaaaatgtgtcctccccagctcagctacctagcttatgagttatgaaagctttgcttcagtaagagaggacatggccatccagcagtactcctttggcttttatcacccagtgttgagtcttttagctcccacacttgaaacattgtggggcatcaccatctttcttctcaagaacaaggcatagaggagttcattccatgcatcagggacaccaggcaggcaccagtggctgcaatcctgcctgtgatgagatgcaggccctgaaggactcaggtacaccgagaggtgcccgtctttacgcagagctgtcatctgagtcacattcagtatatccagcccgacaagcttggtcgtgatgctgttccccagtacatgatttatgggttcaagcaggtcagcccacggttccagcgatttaattggagttacatctggtagagtttccaagtggcaggtccctccagtcttccagtcaccacctctgtaagaaatatctaatctagttaaagaaatagtttgactgaatatttgaaagatactatgatgtttgttcacaagtccaacaataaataccatcagcattgtttcatgatgctaacaatatattggcacaattcacataaaacaatgaaacaatgtatggtcaaaagcatctgatatcattcgatacaacatacacaatcaatcaagactgtcaaataatgtttgagcaaggaattaaaaccaagggaaacactcactatttgagtaattagagttggtgattcacagacctgaaatgcacaggagcatatgtacggaagatgatctgggtcttgtttgtgttaacttcattgcgaagccaatgaaacaatgtctgcatggatctttggtaagcatctctaacagtcatctccattttgacctcgttgccttcttggaaataggcgccactggtgcaagacataacagtaagaatagcatgatctctcagccataagacattaagtagagaatgctgttcagtcaatagaattcaaacatttatgcttaccctttgattgttttctcatggttccaccagtgccc

SEQ ID NO: 56111 - DNA, 5477 bp, Oryza sativa
agcagcgagcatacaaagcagagactcccattggtttcttgcaatcgaatccccaacaaatacaactcttctgtttctgagtttctctagcatatttctggcattaaatctaagaaacagaaaaggagacgaaattagagtgagacaccagcattgctaatatgggcatttgaatttattgataatggtacatctcagtccacaggtatcaagggagtaccatacaaggtcacaaaataatgaacttacaaggtcacaagcatgctctttccttataaaataattcactgagaaatcaaaaggcatgcaatacattaaaaaacataagtacaacgagattatgcttctaacaaaaaaatgcgagtccttttacatggtactatgtaacacatccctaatgttataatattccacctttgcaaaatttcatacaattagcacttatgaaggatgacaaacttaccctccaagtatagctactgacatttatggtgacaagaatcaagattaaatattcttttcaaaaggtagaaatctaatcttggaaccactttacttttccaaattgaatcaagcaaccacttaactgcaacaaaggcagttagaacacaacaaaacagagccctcaacaattaacaggacaagaccacctctccatcgaaggtaaagatgattgcaacagcatgacagtcgcagatcaagtaaacaatactgatttaataaaatatatcttctgcaggactaagcaataaccatacgggtaacattgtttcctacttttgtaatcatgtgggaagcaaaagggcatcgaatttccaatcgtggcgcacagttccaaagtggagttggtcgttgacagcatcatgatcatcccatgttccaataatctaattttaaccagggtgaagattgtaaaatgcacgcccactgatccaatctcagcaagaatatcccactggaagattgaagtcagaagcactaacccaaacttaatcctcatcatgccagcagagcagcatgtttgggttctagattcaacccaagtttatttaagtccgtcttaatttctttgcctttataagttaacactcaagttgtagaacattccagcagacaaaattaagtagcacggtctccaatccacatctccttaattaatttatactaatcaattaatcattcgccatctccgcaccgttctagatgcttggattgcagcaagagatctcattaaagatttcttcattgatcttcgtcaagctctcgaagtaaacatttactaaaatcgatttctatctaaacctccaaactcgccaccccaatccaacaatggaatcaatggaagcataatatgcaagagtaccaaagatgagaggaagaagtagaaatcgatggaagaggaggaagcaaacccaacctggggagatcgcagcgggaggggcgccatcgccacttggtgtaggagtcgtcggggcggccgttctcggagcagcggaagccgacgtcgaggaaggggcaatccctggaggcgtagagcgggtagccgtcgtcccacacccactccccgtcgaacaggtcgcactcctcgcctccgccgcctccgccggcgccgccgccgcggggctcctcgatggagaccccgccgctgaggagcttcttgggcgccgccagcgccgagccgacggcggccgatcagcggagcgaggcggcgcacacgagcaggagcagcgcggcggcggcggccagcatcgcgaccagccccgccgccccggccttctccagcggcctcctcatcaccccccgcgccagccggttggccgccgacgtcgaccccaccatcatcgcatcgatcgatccccccaccgacgaagcagtagcaccggcactagtagtaccactactactacctgtatactacctcgccatggccatggagcttacgcgcgcgggaggaggggagacgagacgaggtggcggagaggaggaggagacggagacacctcgagggagaagacgaggaggtatttatgaggaggtcatttgaaagggaaatgcacggagtttggctgcttccaattggacggaaagcaatgtgattactatttccctatttcataatatataagttattatagcatttcttacatttatattaatattaatgacttacattgtaaaatggagggagtagtactcctctccatcctataaaaaaaactacttaacctaatattgaaagaaaaattttctaatacaacaaatcagaacagatagaaactcatccaatactaaattatttttccaatacaacaaatcagaacggatagaaactcatccaatactaaattattttttttaaagtagaacttaacctattactaatataatatcgtttcgattcaggaaatattatattttatagtagattaatatatttttgagacgaagtaagtacaaattagtagtgtggtttgtggcaattgtgttgtgcgtgtggagaggggaaggaagaagtggatgggagggggagggttgaagttgaggtgtggggcctataaattcggctgtgtttggaggggttaagtatgagtcaagtcaagcacgatctatccctcggtcatcaaaaaatacttgctttaggtcgagcgcaagttaaatttgattaccatctgtctaatataatgtcaaaagatgtactggtattttattttaaaaaaactttgtttaattttaggccgctaccttttaaccacatcgatcattttcgatcggggcagttgctaaaccattttcacacaagcttcattgtccttgttggcttgtgaaaaatctagaactctattttttgactacagagagtacgtctacttgtgtgatggtaacgattccttttggtccttcccacgttttgtttttaactgcgttgttagactgtattgcgtatagattgtgacaaccatcgagtttgtaatcaaagataattgattttggtggggattagtagtagtagtgtgggttggggcaaagaatgatgcatcgaaagatgatgagggtgttacgaaagcaaggttgttggcttgtccttgtacgcaacgcaaacgcaatcaagtttaatccacctggtcatctcgataacagcaaatacactactaaacgagccatgatccaaaaccaatctttttttttttttggaataagttcaccagaggttcctcaacttaacaacgagattttttaaaatccctcaattacaaaactagaaatattcattcctaaactcactcaaaccgttcaccggaggtcccatgacagtatttgcacctggttttattgacgtggcatcctagtcagaaaaaaaataataataatatgtggggcccacatgtaagtgagagaaaaatgtggggtcaataatccagtcagcaatcttcttctcagtcgccgttttctttgccacggatggggagcggtagtggctcgcggccggaggcaggcggagcggcgggcaaccgcggcggtggcgggcgagcgacggctctgggcacgggaggagcaaaggggcgggtgagcggcgaccgcggagcatcggcggtggtaggcgagcgcggctgcggagcatcggcgttggcggcggcaagcggtgggcaagtgtggcagcgggcgagcggcggctccgggtcgccgccatcagagttaataccgagggagaaggagggtacgttgggagcctcataacttcgccgttgctcctcccggcggcgctccttatcgccgtcgctgtcggagtcgatgccgagaaagaaggatggcgcatcgggagcctcataacgcttttgttcctcccctccattgccgccgtcggtgaggtgggactcgtcgccgtcgccctcgaaatcgatttcggcagaggggggaccggcggcggacgagcgcgatagaggggagagcggcggcgagcaagcgcggaagaggggggaccggcggcggggcggagcggccggaataggccggcagaggggggacggcggcggcgcctgcaatgcctccgccgactccgcaccgagtcgagcgtgcaccgtctctctcccctctcccaccatcgccatccctactcatcgccgttgacggagtttggatgggcctcttgtcctccctcgacctggccctatcgcctaccggatttttcactatctcccgccgacgcatacactgctccgacggcgggcgtctcacatggagtctaccaccgtccctactcaagagaaggagagaagagaagagaaaaagaaaagaaagagagatgtgggggtacatcattttctctcacttacatgtgggcccccacatatttatttttttattttttgctgactaggatgccacgtcagcaaaaccgggagcaaatactaccatgggacctccagtgaacggtttgagtgagtttaggggtgaacatttctagttttatagttgagggatctcaaaataatctcgctgttaagttgagggacctccggtgaacttattcctttttttttgggccaaagccttgtccctacacaagcctagttagttagcctaggaaaagtacaccgaaggtccatcaacttgtaatcgggttacaaaatcacccccaaccacaaaaccgttcattttaggtaccgttcattttaggttcctcggtggttttgacccggttttatccaacgtggcggctgagtcagcgtggggaggaggcctgcatgtcagacagtccacgtcagccacttcttaccctccctttcaactcacttcctctctcctctcctctccacgtcgatggccggcggagagcagccagggcgcgacaggacagtgtgacgagcgcggtcgtcggtgcaacagaggagcacgtcgcggtcgagcgccgccatggcctcccttgtctctgacgcgccttcatcaccgctatggcctcccttgtcttcaccgcgtagagcgaggagcgtgcgggcgaagtgatgcacgaggcggtcactaacctcgccccgagggccggcggcggcaagcacggcatccgcgacacggcgtgccccatcgaagtccccccggtcgacgaggtcagagcacgcgagctctgcagaggttggtcggctggtggggaggaggcctgcgaggtgaggcggaaccgtcggcgaagtcctgtaagccatcgcagcccaccaccgccacaccctcgctcctgcacgcggcaggacgctcgtccgcacggcctgccaggacccgaccagcgcgaggatgccgtgcagttgctcccctgctggacgccgcccgctgcagatctggcgcccgcgcctcaacggcggcggtgttggggaggccctcctgctccggcggcgtgggagcacgaggcggaggcggatggcgccgacggggagaggaaggatgccgcagtcgtcatccatggccgcacgtggagagacgatggaggctggcgg

SEQ ID NO: 56112 - DNA, 4196 bp, Oryza sativa
gcgcgaggacgtcctgctcccacatcgtcgcggctgccgccggtcgccggcctcccgacatcctcctctcctgcctggcgccctcgccccgccggccgtcttgctcggattgagaagaaaaggtgagagaggaggaagggggagaagaggtgaaagagagtgatgacgtgaacaacctgacatgtggggcccacgtgggtcccacgctgactcagccatcacgtcggacaaaactggggtcaaaaccaccgagggacctaaaatgaacgattttgtaagatgagggatgtcatatatctgattttgtggttggggacgattttgtaactcgattgcaagttgaggggccttcggtgtactttttccgttagcctactcagacccagtcacttctgggccaggccgtgataccatagccttcttatgggccgtataagcccaaacactgcctcctcgtgggcctattgggctaatactccaaggcccaactagctcccactccatcagtccacaagtcaccatttcaccaaccacctcgagtaggtaaccggcggcggcagtttgacggcgggcgccgtgccaactccggcgtcctcctgccgccaccgcagttcgacacctccgcccatccacgacgagacacaggtatacggcgctattcctctccaccccagtaaccacagattgggagcagatcacacgaaggaattgtgtgaaaggactggacaaatttgtttcttcgtcaggcttgagagttcagaagcaggtgagaacacttgtatagtttctacgacctcttcttcttctttaccggaatcatcagggatcaaggattttgtctgcatcacggctgtacattgatgaatccaattgcactagtccatgtctctctaaagtcaggccatgaaatgccatcacgcttgagaatctagcaacttttgctttgctagctatctatccagtccagggtacgtggagtagttggttggcctttctatcatcttttaattcgctgccatgacggttgaggtagacagcattctatctgcacctgcattattgttgatccctttctcgtcgtttttttggttttgttttgttagagcaggtaaaacagcaaactataaatcagatataaccacatatcaaaaagaaaaaagaagagagagaagaaagcaggctacagatttgtagccggctgcaacacagacttcaaaacgttatgtgtgtatgagaggtaggaccgggcattaatggtgtagtatatttttataattaactattataagaatagactattagattagctatagatgatttggagtcagtagctggctatactattaaacttgctcttatctttctatctttttgaccttttagcagccagttgaagctagacatgttcacccataagcatgtgaaaatggaaataataaattaaacaataggactaatgtaaaggtgtccaattataaaatgatatgcaaaatcatctaagtttccgtaaccgcagccaccttggaagaatcgtggactaggaatagagtatttgtctgatttggactttggaaactatgggcacatataccgttccacgcatagttcccccgagatgatcgcataagatgcatcgtccaagtatgaatcaagaacaaactaattagagccattttggtttgaagttaaaatacacccctaccaaattattggcactttaaatagtattttggttagtgtttggttttgctactaaaatgtgacaataacatatataacttgccaaaacttgggccataacaaaagtttgcttaggttttggcatggtggcaaaccatgcaaattctaaggaatcacattaaagaggcttagtgctccctgaaaaggtgctcacttcattctattttacctgttgttttaggacatgttatatacgttaatttgatcattgtctttttgactatatattcaataaatattatataactgcatgaaaatatctttattgataaatctttttttaatgaacgcaaaagatttgcttccattaagcaaagacaaaaaaaacagtcttctgataaattatgtcatgtctttttcacatattaatttttaaagtaaatttcacaaaactacagatatttgactaaattatcacaaaactatagatttaaggtgatttatcacaaaactacagatttaacaataaatttatcagaaaactatagattttaggctaagtatcgctaaactatggatttactaatgaaattatcacaaaactatatattttgggttcaaatccttagcactaatgctatgtttgagttatatatatctaagttttgtgattaaattgatattaaatatgtaattctgtgataactttgttactaaatatgtagttttacgattttccacttaaactgtagttatgtggtaaatttagtgttaaatctatagttttgtgatacatcatgttaaatttgtagttttatgaaatttactctaatttgtaatattgaaaatatcaagagtttactccttgcgttttatgttataagtcgctttgacttttttaaagtcaaacatttttaatgttctatcaagtttaaaaaaaatatagcaactttcatatcactaaattagttttagtaaatctagcattgaatatattttgatagtttctttgttttatgttaaaaatattactatatttttaatataaatttggtcaaagctaaaaaaagtttaacttagaaaaaaaattacaatgacttataatagaaacagaggtagtagaaaatatgcgacgttaaataatttgataaataaatagagaaattttatggttctggagaggtaccaaagtaccaaaaattttattgtaaaattcagtaccttcttatacctagttagtaagagataccaaaatttacatgagaaattttatgagaaaaaaatacattacaaatgtggtaacttcttaagggcagtaaaatcacttgaataaataggagtaacatgttgacaagtgcatgacactcattgggtacgtgtgagttggcaattacagcgacaagattctttttgttttcttgtagactgttttctaattagttgtgcttcacttgattctagcaatcgccttctaggcgatagcaactgaaatgaatggagtaatatataactctaggtgtgcttcttgccaactttgcttgcatgatttcaactcagataaacagataaagtattgtaagataattacagtgcatgtctttctcatgataaggaaagggtgaaaacaatagtgctgtgtccaattcacaagttactagtactggcataagatattttgctgaaaatttcattctgaaaaggatgtgataaacccatggtctgatcaaaatacgctacttaatcgaatagaagaatagatatgcaaactattgctgacagcgttagagatgcaaagtccagcccacttaatcgaattttaactaaaggtgacaagtccccatgcatttgagcaatttgcagaacatttcaatgcatttggatcagctaaagaaaaatccccttcgcactgaatcacatggttagattctctctgcagtccacgagtactgcaaaataaaaatcagcaaatctgtgggtctttaccagtcttatctaatcctgtgtgcgcccattggtttccatttattaatgaaaaataattctttgatcagtattcagtataatgtatagaccttatgttagagagagatttaaacacagatacattgaaaaattggacatgtttcttgaattgtagtcaccttgctacctactgcaggtgctgaattctgaattgctgactaggtaactattgtccatttagattagtcatgatgatatttttttagagtaaattgcactttggtccaccttttattatccacgtttcaatttgaaccacccttaaacctatctttttaatttggaccgggtaaatttatcattgttgcgatttggactaccatgaacaactttttctcgttatgtctaaattccctttcggtaaacatatgagccatacatagaggagttcggccgtatatcagagctgatgtgtttaaggtcgtgctgaaaaagatcattcgtggtggtccaaatcgcaacaatgataaatttatttggtccaaagtgaaaag

SEQ ID NO: 56113 - DNA, 11618 bp, Oryza sativa
cacggaattagggagggaaatcttcgtagtgagactctcctagtgattggtcacatactgaattcttttctgaaaggtataacaagcgggtcaacatcaagagagaacctaatctagagcattattgttgtctactccgccaaatctggtgtgtcacaagtttttgcttgtgccaacaagaccgggccaatactggatttcttttttttctccatccctttgcaaaatacggtacaaacacaagcgtttatatctacgttcttttatgaataagcgcatataaagcttatccctataaacacgtttataagattgggttggtaatatcttaatattaacaaagttactattgatatctcatgatcacatcaaccattaaaaattaattaactgtaagctagtggatggttgatctcctccagaaacgcagcatcaatagtcactcggatgcctcttttgcgctcaggatcttgagacggcgaaccacattctcctcgactgcgtgtttgctcagcaggtctggctccgtgtactgtcgtcttctggatgggttgccctctctccctcgtggcagctggttctaggactggtggccgtcctccagggcctatttacctgagcatctccgcgctagcttcgactccctggtgctccttgtctcttggcagctgtggaatgaacggaactctaaggttttcgactttgcactattttcagtcaccgtggttctggagtccatccactcggagggtcatatgtggtctttagctggtgtagccgctttttgggacttgttaggagtgtagcgtggctcagcccttcccgctacttggagtttgtgtttagccgccgtagttttctagcttcagttttttatttcgctttttctcccttcccttggcataaactggtctggttaattgcgttgtgtaactataacttttttcttctaatatattaacgtgcaatcttttcgcacgttcgcgaaaaaaaaactgtaaatacgagcattgcatcggtatactctcgatatttgagaatcggtacctatttaaacatttcgaagacaatctaaaactgcacccttcgaggaagaaaaaggcatcaaagtaaaagaagaacattttattacttggcgaatggggatgtgtgctgaacaagtaaaatatctgcccaagaggccaaaatggccgttgagcgttttcctggcttgcgtgttgttcacaataaatcgcaataaatcaaataaaaataaaactgcacacgatgcatcatccgtcaccatcttcacacctcactaattcattacatgcgtttgtttttctctttttatcatcaatatagctaaccggtctccgtgcacacaatattttctctagaaatttctaggttccgtttcttgtaatctcacatccattaattccataaatccccaattgtccatatatactagcaacagaaagttcagacttttgtttcagaaaaggccataaagttactcattttaatttctccagggaaagaaaaagtaacaaagctctaacttcccgtgtcaaatatgtgcaccaatacccacagattatacaagacatgattagcaccggtaaaaagtgggcattgacacgtccaaatgcacgagaagtttgtactttttttgttgctgttttgtttcgtctatgcaaaaaccaaaaataaaaaggaatttgtacaactgaaatgatgatgaaccacaagaaaagaaaaacattggtgtggtccccacgtaattagcaaaaaaaaaagaaggaaaaaaaacaaaggctttgtggctatttaagccgcttcttctcctccatttctccatccatccatccatgtcgtgttgttagcttcgttttcttcttgtttcatcaatccaaggagtgtggaaggccacacgccaagattatatctatgctaatttgattagcagtaggattaattcagtggctagcgtagcttgattagttggtttaattagttggagagtaaagaagatgttgggagtgttcagcggcgacgtggtggaggtgccggcggagctggtggccgccggcagccggacgccgtcgccgaagacgcgggcgtcggagctggtcagccgcttcctcggcggcgccgagccggccgtgtccgtgcagctcggcgacctcggccacctcgcctactcccatgccaaccaagccctcctccgcccaaggtactaatcatcctgttcctctgaataatacagcttttgattaattgtagctgaatttgcttaagttctactgttcttcaccatggatttctcaagatctaaccaaggacagaatcagtgattgctttcatgtgttcttcctgagtcagagtcatttactatatgcttttactctttggttagtgaagtcttctttagctagtgatgatcaactgatcatgtcataatagctctcaatattttattttattttaaaggggactcccaaatcccaagatccgagtgtctgactaaatcagagaaaaaatagtttcttatcgtaacactttgctgattgtttcgaagggaaaaaaatcacggggttggtaaaacatatgcttagaatgagcgggtgtttgggatgtggtacccatctggggaaaaaaatgatttcatctcaagtaattcagtaacttaaacaggcttttaccacaaaaaaaaacacaaaatggtttttttttctgggtacggcacacatcttgagtcaataattgggcagtttttctcctcatataaaggcaggtttgctttcgtaagacaaactgaacaataaatacaactccataatccatttctgtaggttgaggggccaagctaccaaacctcatattcagttcatagattctcatccgaattatgggtcgcatgtctgagatgataattacatgattaactatggtatagatttgtttgtttcagaagtagaatgctaaacaaagaagaatatgcagagattttttgagaactaaatgcacaaaagtaactatcaaaaatagtagttttgccttggtgctacgatatctgaatctttcttgccatggcactccggtaactaggactctcttgccacgtgttacggtatcctggcatcaaatggttggtgccttggtataaaaaacgagagcagaagaagacatgaaagaaaaaatataatcaaaatgtctatgtcgatgtggacatcatcacatatcaatggaagaagtccacatcatgccaccttccacaaacaaggtgttaattgacctaacaacgaacaagaacttatattcttcactaggaatctaatggtatttcaatgtattagatatagtttaagaaaagggataggcaggatgatctatttccaagtctttcaaaagaaaaaggagacaagatagtgttggttgttggacaacttactaggttgcttatgaaaacctctcttgatttatgcatttacctggtattattgtgctgttcacatggcccagttcatagtagagggcactaactttgcaatcagttgctaataccagaagtctatccagttttgatacccacagatctgaaaggaaaaggctggactaggtgacccatatggtcaatcaatccaccactatgatttgtgggcctggttactctttgttcatatcttatctagtactagacagattcagtgaagaagtagcatccaaggaattccactccattgctccaatttttccagtacaagcatctttgtccttattgtaactagtagtagtacaatcttcaatgtagtacaattcaatgttaggtacatcttacccagatcaaatcattgatgttgcacctaattcttttcactctccaattattcttaaagagtagaaatgctgagcactaatcaagcatactaatgctgttcctgaatgccaatatatgttcttttctcctatgttactattaagatgcatgcatcataatacagtagttatgtccttttcctttctgtaaaaacctttattcctcttaatacaaagatacacaaatcttttgcctattcctgaaaaacagtagctggttgagtaacatatgcagctgtcttgatttgtgcaggtcatttgcagcaaaagatgacatcttctgcctgttcgagggagtcctggacaatcttggcaacctgaaccagcagtatggtctgtccaagggtgccaatgaggtgctccttgtgatcgaggcgtacaagacgctgagagacagagcaccttaccctgctagcttcatgctctcgcagctcgccggcagctacgcctttgtgctcttcgacaagtccacctccaccctccttgtggcctctgtaagttttgttcatcactgaatgctgttgctgcatcacttcacttgcattgtcagtgcctgaagatttggttgattttggttacagattatgacgtgttcttgtgctgtgatttgctttttcaggatccggagggaaaggtgtctctgtattgggggattactgctgatggatctgttgccttctctgacaacattgacctgcttaaaggatcgtgtggcaagtctcttgcacctttcccacaaggtaatgtttaaactttgaacagtaatgcagcgacgaaagatgaagcatttactataaaatttgatctctaactattgatttagttaggcacaattgaccttttctttgtttctgttcactaattcatttcggttgcaggctgcttctattccaatgctcttggagttggaggcttgaagtgctatgagaacccaaagcacaaggtgaccgcagttcctgccaaagaagaagaaatttgcggtgcaaccttcaaggtaaaaaaataataataataattgatggcaacctaaatacttaactgaatacattgtaaccgactgatgtcaaatggtgttttcaaccctttcttgggtcgatgtgcatctcttctttatcaatgaaatgaggcagagcttctgcctttgttcaaaaaaaaaaaacattgtaactgactattttctcctgcatttcgtctgaactcaatagacatttttgggtgcactgttaattaacacttttgatttgatatatgcaggtggaaggatctacaatcctcacagcgctgcattaggagatttttggatctccagctgttgttgggaaaggaaaactctgtagtctgtaaatggtggtgtaacatagtcgcaaggcatgcatctgatctgtatcatcatcttccgtaaagactagtgctgccagcatggttagcacttttcagtgtttgggtgtgtgtatgatctgtatcctatgctgttcaggcggaaatgaacttcaggcccagctgtgtcagttgaatgtagttgtgttgcaaataagtttttcttgtttgttatcactgtgattgtgtcttatgcagttatgcttgttgccggatactattcataccacaaccttaaccactcctattttaacaaaaatattttaaatgtttaaaaatgtattatattattgaaatatgttacatgctaaaaattttctttacataatgatatgatctagtagtaccacctaggaataatatgatcttaccatagccatgtaagtacaccaaaccagatttacttccatattgggcattcaaacaacaagtaatttatggtttccagattccggaaacatagctggtagaaataattatttgaccatcccctaagttgcaaacgatctattgtccatacccgattttgtagcgcaagccaactaaatatctgcattttgctagaacccacgccttccaaatcaactctgcggatggcgacgctatcattccgttgaattgaaactgataagcggattttgtgctatacttcccattggctgtccttttctaaaccatagagttctctactacatctgtcaattctaaagattcatgcgttcgagcccctcatacttgaaagaactctctgagttaaggttgtgacatatgtcatttacccaccttcttgttgcaagggctcctggattgtgtggtcttcctcttggtgcttctgtagaggtctggagctaagttttgaggctttgaacactaatccaatttgatttccaaagatcgcttttcactcatcactatccagtactttggtcgatgctgcaaacaaatttcgaaaaattataggtcaggttgacacgagaactgggccagctcttagtcggcacagaagctttttgggccgcagaaatattttcgtgggcctgattcgccgatcaaagcctagcagaaatttggttgggctggtatatatggaccgctacatccaaattcatgtgagccaacatggcccgcaccttccatcaggcccatactggaataaaacccaagtgaaacaatgggcttttctcaaccagccaaactcgggggaggaggctatgtgggctgtaaggtggccggacagtggacgaatcgggctttaatttgtcaaatgtcgttcatgcaaataggctacagcccttacatgcttccacaccaaaaagaaaaaagaaaaaaagagagagaaaatttagagggagagacattcctccaaacaatttttaacaagaaaaattgtaaacgtgttagagattgaatatgagacttcgatattgaaaccacacatctcttgtcaccaggctttactaaatcatttgggatggggttactaccacctcacgatttgatggttaccgtgctaaccgcgcaattactatgaaaaccgcacggttaacgcgatgtataccgtgattttaaaaactaaaaaggttaccgtacgtgacaaccacgataactatacggttttgtaaaccttacatgtcaccgtactatcatgcttccacgctttctgatgttcgaaaggagcaaaaattttcttcattttctaaacaaaggcagaacccatgcttcattttatattggtaaagaagaaatacacacgaacacagaaagcgttcacgccgaaaacacaccatcggaacttcggaagaagcagaaatttcacccctgaattggagtagtactcttattgatcaaacaaacagagaaaatcgaacgtgagaatggattaccggaaatactagcaaaagctgcgacgaaattttcggtgaatgaaagaaatgatgttcttgatcgacccagctgggctgaatgctcaagtagccgaagatcgtcagcgaaatgggtcgacaccattgtgcacttgcctgcaggttccaatgttcagtaggcctccaaaatatctagccttttgatattctgatctctgaataataccatccccgctttctgacgtctattcaccaccatcagaaatttcctttttgaaagatccagattagtataaatcctctccttgtcttgaaagatccggatcagaaaattctcttttcagttcattattccatacctgccgaatctcaaatctgtgcttagattcagcgtaaatttttttaccgtgtaaaatcggatatacggacacacatttaaagtattaaacatagtctaataaaaacaaattaccgattccaccgatagatatttactacgagatgaatttattaagcttaattaatccggcattagcaaatatttaatgtagcaccacattgttaaatcatggagcaattaggcttaaaaaattcatctcgcaaattagtcgtaatctgtgcaattagttattttcttaacgtatatttaatactccatgcaggtattcaaacgttcgatgttacaaggtgaaagtttttgcggtgggatctaaacagggtctaataccgaatgctctttttggttttgttatttcacttaagatagatttttttttactcctatcattttaattttcatatgtataatcttacatcaagattcgttttcatgtagattcaacttacaattagacttaattataaagcacttacactcaattacaatatatcgaaattagattttatgactgttttttctctgaatttacgatttttaacatgtttttttattcattcaaaacgaattttatctattaattaaaaattgaataagatttaaacccctgaatctatcagaagattaatagatagtcccacgttcttttcctttcgaccgagtttagttacaaaatttttcttcaaactttcaacttttccatcacatcgaaatatttctacacacacaaacttctaactttttcgtcatatcatcctaattttaaccaaatttttaatgcggtgacgagttacagcgcattattacaacgccgtaaaaactgacatgtaaaacgggcaattgtggaggttgaaggtactgtggggcagggcagcagcaaaatggcatgtgcgggggccacccgaggcagcagatgccatgtgacccctgtcgcctcctctcctccatcaagctcagccgttccagcagccaaaaatttccatgctttctcacgagctcatcagagagcagctctctctactgatcaagcaaccgattctgatgcacggtaaactcgtttctatccgacggtaatatttcggctgtcaaaatgcaaactgcagctcccatcgatcaatcttcttaagaaattcttcagtttaatttacgcgtaattttatcattcttaacacttagtaagtatatagaagtaatatacaattttctaatgtaaaatttggtatctttaacattaaaatttgaagtgtaaactttagctacctaaagatttcttaagaaattcttacgtttaatttataggtaattttatcatctttggtaagcatataaaggtaatatattatttagcgtaagatttggtatctcaagatactttattagtatcctcaagtatcaaaattctggtgtaaactttatctaccacaagatatgctccaaccgtaaaatttctcttactttacataccgatgatgtttgtgttctgcttctaaactattgtatgatcatatatggaaggagagctggtgaataataattaaaccagttactagctagctaaactgaagacaaaacaaaagggaaaagatcattgcgtgcaggaaggttcggattattctagcagagtgctctttttactctaaagcagcagtagtagttagttaaagacagccttttctttttctccttctagatcgtgagaatgtgatcagatatattcatatacgtagacatcactttgcaaagtgcagtagcttaaagtatgctaattaagcggcagcatggaggcataatttgctcgatcagtgataggctgatagcacgtgatcgatgctagtcgccatgatttctggtgagttgattactccacactaatactgctgctcaatagtggtttgttcaggctgattgtactgagtacgtactctctctgtttaaaacaaaatcaatctagataaaacgtaggaaaatgaattataaggttatctaaatttattgtgtattgttacatccaaacctactcatgtaggttaatttttttagatagagggaatagtctgttcatattgcttgtattagtagactatagtaagtactttcttttgtgtatagagtagggttctatgtcggctgtaagggttgggttttgagcaatcccggctgtacattctttcttgccctaacggtggccagtcacgcttagcgacggccggtccggtgctagccttctccagggtctgtgtgttggtgttgtcggtgcgtgggtggtggtataattttctttgttttcaggttacaactgaacgcgcaaagatgtagcctagaggggggagtgaataggctttcctgaaattcacaaacaaatcgcagcggtaaaattcagcaggaccaaaacttccgggtgtggaataccggaacttccagtctgctcagattgtccggaacttccgagcaaagaaaaacctgaagatctagcagagacttaaactaatttgcatgaattaaactacaggaagacagagcagatacacaatcacagcagcatgcacagaatcatcacagagaagacaaggggaattttttcccgaagttcggatctttcaattctactctccgttgagatgctccaaagagccgggtctcgattaaccccctgcctcacctgtgcaaagaacccagaagaagtccaaggccttaaacaaaacactcctaggtcattttctagaatttgaatgaccaccaagatccaactcacaaatacttctagaaaataccacaagtgcaagttgttctaccaaggagaacctctgaaatctttgcacaagaatctttactcacttacctcgtttccttgcggaggtgaggaaaaccttcaccaactttcccgggacatccacaagattttggaagctcgcgggcaacacctatccgtctaggagaagatcttcaagagtaataagcccaagtgacaacccacaagatatccaaagtactcaaccatacctagtcttcaaaccttctccaaatcactcctacactctcatctattctctcaatctcacaagaatggctttagatttgagtggaggaagcaaagggatcttgggagaggctagaacaacctaggggatgaaagaactgaagtggaatagccaaaaagtgagctgggtgcgatctggatatatataatggctaggtgacgtctagccgttactcacatttttgaactggaagaagtccggaagttcctgaccctcggaacttccggccaacacttaggcaagtttcattcaatgcaatgtcagggaccggaacttctggccagccttctctgtccggtctggacccatttgcaaaaatggctcccaaaaatattctatcactaagaatccactaagagcactttttatatctcagaaccacacttagaacccctcttaatagtacggttttttctaagactcaatttcaaaaattaaactatcctattgaccttcgagcttcaaatccgcataaaagaatgttgtagggggtctccaagcatctcttgatcacctaagatcaccttgggacactggtggagaaaccatctttacttccggttgggaacccccctttaatcccggttttccaaccgggagtaaggatccgggactaaagatgtccatctttagtcccggttgaaataaccgggactaaagatacatctttattccctaaagagagggatctttagtcccggttgatgttaccaaccaggactaaagagacaatagcggcagtgcagatggttcctttttctttttcttttttcatttttattttctcccgaatcaagtaggcaaatccctaaatcaatccccaaatctaactaacatcccaaattcacatcaccaaatccacatcacaatcataaagttacttatacacacaaatcaaatacatcacaatatcctaagaaattactcaaatacatcacacatccaaacaatgaatcacaaatttctaacttctcagtcaaatacatcacagtgaatcatcacaaattaaaaaaaaagaagctgctgccgccgccggtcgccacgaacgacgagcgcggccccgctggccgccggccaccgcgg

SEQ ID NO: 56114 - DNA, 8562 bp, Oryza sativa
tgcgccgccgccctccgccgggcgccgccgcccgccgtagcgcgtggccccgccgccggccacccgccgcggtcgccgccctccgccggacgcgaccccgccgggcgccgccccgccgccggccggcccgccggatgggaaggggaagccggccgggaaggggagagaaggggaggagaggaggaaggggaggagttggagaagagagttagagaggatagatctgaggagaggtgtgagattcgatctgtctaagttgtaactgtggaggagagggtaagggatagggattatatactacgtgtttaattttaatcccggttggtactaccaaacaatctttagtcccggttctttttggatctaggactactgtggattttgccggaccgaccaaagatggtttctccaccagtgggactaattacatgtatatctcaataaacacattagtcccttaaccttattcatcattaatcaccaaaacccactagagggataaatgcaacttcaacgacctctcagggttataatcttacatttttttccctgctctaaatatgaactttgtgttttctagtgtgagttgttaaaaaaaaacccttcttttgcaacagttactactatatacagacatactcactccgtgggtaaatgtaaggatttttttggttatttatcaagattaacaataaaatgaaagatttgtttttctcaccccatcggtcaaaatttttaatttttaattacttcctccattaaacaccagactgattaataaaatgcttggattctcgtgtattaaaatcagtgtcgtacaaatgtttcaactgtaaaaatacatatacgtacttagaaacgaagggagcacacggtaaaattgatgtgagctcaagatcgatcaacaagctgagaaaatatttcaacctgagaaaatttctcaatcatatcatttctataaccataattttctcgaaaacagaattaaaaatgttcaaaccggccaaagcaaaagcggtaccgtagatatcggaaaatcgagaatgaaactatttggtatcaatcgaaaccaataataataccagaaacatcaactttgtatgaatatataatatgtaaaacaaattcaaggttacactaggtatattacaaattgtctatctttaaccttgcactcaagttaggaatttggttgaggaattgaccgacctctaaactatgagccaaatgaaaaaaaaatggaccatagatattgacgtatttataaaaaaggtaatttctataagaacatgtaacgtttccattttcaatttcattgtatcattttgttttcatcggtaaccattttcacatggctcaactagtaaaagttaaaaaacaaacttcggttacttttcatgattcttttcacaggattaaaaaaaacgtgtgtacgaaaaatgagagagtggagctgggaaagtgttgcaaagaacacagccgaaggtacatgcattgtcgctcatggaacctctgcatgtgctactacatgctcagaatgtcataaccgacatggtgctagctgctagtacaatatgttagtaatactagtacctatagtaatatatagaataacactacagtagtgtacacgagaatatatctcatatacacaagttttttgtgcacaccaaccaataaatatcatggaaaattaaaaaaaatagacatatacttttaataatattgcacatatctgcaaagtctcatattcaaattcattatattttagccataacaaaaagagtgaaaattttgatagtttaaagagtaaaaacctctccgaattttatttttttgttacgactaaaatataatgaatttagacataaaatttcacatatacgtgtaatgttattgaaagtatgtgtccaattgtttataaaatttcttatggtatttgctaattggtgtgtatggagtgtgtgtaggaagtttttttttagagaagggtttttttttacctgtcttctacatccagttagatatatgtaggttttttaaatcaaaaatttagcctatcggaaacttagccctcaaataatctaatttgaaattcgctcttacgtagatttaaactcagaaccttgatatgctactcaggtcactgcagccactaggctacatgtccttttccttcaaatttcaaaccatacattgatattgtacagacatatatatatatactctccgtgaatgtataaatgcaccatacatacaggttactgatgagaacataactggatgtttgtcataaaatttagtcaaagtgaaaagaagttataggccatgcgcttcacagttttgttgtaactaaaacctagtgcatgcatgctccctaccatctactcattcttgaccatgcatgttacttggagcggagtacttacttgttcagggagattcctgtgatcgtctacatggagctgcttgcatggatttgacgtgtccggtcacaacgctctcgatcttaatcattggagggtttttttcccttttcttttggatcatgtatggcggggaatgcattatttggtgtcaggaatttatagctggatccacaggaatttaggcaagttgttcaattgcatgagtataataatgcagtgatcggaattaatatatcctttgtaaaaaaaaatctaactctagctacacatgttcgtaatcaggaatggatttttttagatagagggtgtatattcgagcaacttttgctgcttgtggtgaggcagcaggaatcgcctataaaatagtactaactggctttcttgtgttcaactctgcaaccaccaatcaagccgttctccgtatagctacaagagcttcaggacatgggctgttttgccaccttgttgacaaggcaacaagatgcatatagatcagcccagctcatacttcagtgccaatgaagtgactagtgaggaaaaggaggaaaatatatactagtattattttatctttggttaatttgagagccgcataaataagtaaataaataaatattctctgtcccatattagtaggtaatatgatacatctcatttggtttatattactatattttaggatgaaataagtataaattgcaaatgcagatattatatagagttgcgacttgtaaaacagtgagaaaaattggcatgcgtgatgacggcatgccaaactttagctcaagattctctctcaggccgagtttagttccaaattatttcttcaaacttttaaattttttatcgcatcaaaactttactacacacataagcttttaactttttcgtcacatcattctaatttcaattaaacttctaattttagcgtgaactaaacacacctgaattaggaagtgaggaagaagagaccgtcctgcagctgctgcaggccaaggcaaaggtgcatggaccatggtgatgcgagcacacacacctttccttataattttggcgggcacatacaacagtaggtcctggatgatgagatgttgggaggagtggccaaccaactgcacggaaatcgaggagtagcatagcactccccaaaggtcaaaaaagggtcaaagagcatatcgcaatccaacgaacaaaagccaccaaaaccatattcttcggcctctgctctattttgtctccccatcacctttttctcctcatcttttagtccaaactgttccaacaacaacaaacatgtcacagtagtgtcatactggatactattagttgcagagtggtgccagtacaaccgtagtgggagtacttcatccgtattaaaatagggtattaaaatataatgatttttagattatttaaaaaatattaaggttagatcaaatgatatatttttaagttgtttcatttattaattcttgaattttgaattatttagattttctttttaataatctattttactttaaaatttcaaaatcaatacaggaatactttatattatgatattatataaaatatgaatcctaaccttctttatagagtattttgttagaaccataaaggagtattatgtattatcagggggtgggcatttggtctgaccaaaattttcggtcacggtctttggtttttcggtcatttcggtctttgaaaagtaaataccgaattttgacgtaaaaatgtcaggaccgacaaattcaatctcggtctcggtctaaccgaaattcagttcatatatgcaaagaaataatggaaattttcaacacaaaaaaaaatccgtaagcacatatgagtaaagactcttattaggttgcatgcctagaagaagtatggatgtgaaaattagagtttaatgctattaaacttagtggatcgtaggttacatttagacattttttttgttaatttagtatattcggttaaccgaggagactaactgaattgactgaacaaaattcggtctttcactgcttatgaccgaattgatgactgaatttctgagtctcggtcttttagttttggttttttctgcccacccctatgcattatactttgttgtattttgaaaaacgagtcctaggatgggtctaattttattgtagattgctatattttgaggagagagtatatgaggatgagtcctaccccatattcctatagtacgtattactaggaatatgaaccgtattagaatacgtctaattttgttttagattgatatattttgatacggtggtctatgagatgagatgcctttgtcaaaggtccacgacggcattcatacgtgctagtactactcatgggcatgaatggatgctttcacgtgatgggtcaaacccgtagagaatcttaaacagtgtcacggtagttttcgtcaaactactaacgttgtcaggcgataaagatatactagtataatgctcgtcaccagtactataatattgcacggaataacagtgtgtatactggcctggtggcatttgggatcggctacaggcataaaaaagctggacgctggaacgagaattcatggccatatgatgcagatgtgcccggctcctgagaaagttgactacggctagttctttttggagggttggttgttcagtagtgacttttgtgtactaacgacacataaaaattgaccttagaatacacgtactgagtatctagcagtgccggtatctttagactagtttattgatcggattatctacacctaacataaatagcttaaaacaaatggtttaaatactagaaagaaaatactccctccgtcccaaaatgtttgacgccgttgacttttttaaacatgtttgatcgttcgtcttattaaaaaaaaattaagtaattattaatttttttcctatcatttgatttattgttaaatttacttttatgtatacatatagttttacatattttacaaaagtttttgaataagacgaacggtcaaacatgtttaaaaaagtcaacgacgttaaacatttagagaagaagggagtatatttttcaaagctagaaatacttcctccgtttcacaatgtaagttattatctagattcattagcatcaatataaatgtgaaaaatgctaaaatgatttacattgtgaaacggagggagtacgtgtcagtatttcggtaaaatagttgaaagcagctgtgcttgtttacaaccacgagaccacacggagtaataccgagcatcaagccacatcgcacaatgcagcatgcgcctcttctgtacatgccgctgctgctgctgctggctcccctgcctgcgcgcatgtgtcgcgtcaaataaccgcgagaaaagcaaagcagacagccactcacccagtgtcctgcatgaaactcggagcgtagcggacgacgaatcttgcgtcacagatcgccccccaacagcaacagccacaccgatcccccgccccgtactccactatacgtaggccacccatctcccaacccggcgtcgcgtgggcgtggctcgtctcggcgccggttgcacacacacggtggatggatgattggatgatgtgctgccgacgaggcggggagggcgtacgcgcgtaggaggatggtgtacgtacgcgtggggtgtgggtgggggtggcgggttgtcgagcgaggcaggcacatgggccggctgctggctgcggctggtggagttgaatggatggggattctgtccgcgacgcatatggcgagacgcgcgcaggcaggcaggcagaggcagggtttgtccttggctgagactgggatggatgggatgggatgaggaggggccagcattccgatgcgcggcctcgaccaaaactgaccgcctcctgtacggttctttagtgctcaactgcgcaacgtcaagcatatcgtaccagactactactcctcctcctacctatagaagcagcatttttcaaatcaaatcaagcgaaaaagtacttgaggaacgcagggcttgccgttactctaatggaccactagtattttcgtggagcatttgagaaagtttagaagtaaataccgctataatatggccctgtttagtttccacacaataaatttataccctatcacatcgaacatttaacacatgtatgaagtattaaatataggctaaaagaataactaattgcacagattatgatcaatttgcaagacgaatcttttaagcctaattgcttcatgatttgataatgtgttgctacagtaaacatttgctaatgactgattaattaggtttaataaattcttatcatcgtttactgacggattctgtgattagtttttttattagtgaccgaacatcccatacgacaccctatataatactcgatatgtcacgccaaaactttacgcccctgatctaaacacccctatcttcgtcgtaaaatatcttaatctagtaccgtgtctgttcagatttgtactgtatctaatatgttacgtctcatgctagattaatttattctgagacggacggagatagtagttgccattaccatctttttcctaaaaattagtttatttttcacacatctcacatatatcaatacaaaaccacattgattaaaatacctctactttatcaaattgcaataccataatttctcattttatctactctcaatataattatattctattttgcacaaactcctatgcaataattaatttgaaaataaaacttattttatgacaaatgaaggatgctacaaataaacttaatatgagactgcgcaagtagtgttgtcgtaatagctttttttactctccctctctctctttgtgaacttaatactccctccatctcaaaatgtttgacgccgttgacttttttaaaaatatttgaccgttcgccttattcaaaaaatttaagtaagtattaattattttcctatcatttgatttattattaaatatacttatatatatatatatatatttacacatttcacaaaaaaaaatttaataagatgagcggtcaaatatgtttaaaaaagtcaacatagtcaaacatttagggaataagggagtatatctatcttgcttcttgcagtattgtataggagtagaacaatctcttagtatatggtactgtagtcaatactttataattttttaaaattctcttctctacatagcattatagttagcttataatagctcactactacgcctacgttatccttgcgtttactataataaacccgtctactctatactctggtctcgtctctcatgtgcacgatgaatatagtaggattattattattattattattattattattattattattattattattattattattattattattattattattattattattattattattattattatgtataggggatcatacttccgggctatacatagccgtctcatggtaggtataatccgtcttcaagtcaaaagacacgagtgacagtgagtgattacccgtgatactcactcactcatcccagatcattccatcccgtgcgtttccagccttttccttttctccgcgcgctttccgctggccttcgctactccactttgcatgttataattgggtgggtagcggccgacctctccgtgtcggtgcggcttctcgtgtgcgcatcgatcgaccgatcggcacgcgaggattccgggattcgcacgaccagatcgcggcgccgcactcgcgctcgcgcctgtgaatcgagatggcctcccgtcccgtcccgtgccgtgcgtgccggcggccgatcaaagcggtgaacggcggcacatggacacgcacgcggttgagcattaattgggtccgaggctccacgtgacaacgagccaagcaacgacctgtgatgaatgctaatccgggaagaagaagaagaagaagcagggattgatcgccgattggccgtcgctgtcgatcggtcgatggtgaggtccaaatcagcgtcgttatccgccgcacctccatctccatgcacacacaggaatcgacaggtttgctgggctccgcgcgagtaatataatccagctttccgcttggatattttgcacgcaacgcaaacgagggtaaattt

SEQ ID NO: 56115 - DNA, 14406 bp, Oryza sativa
cacgatgcaccttcgtggcgtttagcccagaaacgacatattctacgccacatccatcacaagcggagcctcatgaggactgtctaaccaatattactcacccattcttcccactgaaaaacctgaaaaagttgcacacaacggttggggagaggggagagagagtgtggaccgcgtcgagcgtcaccttgccccgcccacacaggccgctaaggagccgagcgccggcgagttgaggagattcggcgagccgccaccgccacccagaaccgcgagcaccagcgggctgaggagagaggggtgatgcggcgagccacagccgccgcccgaggcttagatcttgcaagcgccgggctaggccgccccgccgtcgccatcctccttttctgctgccgagcttgtcgtcgatcttctcctctccacatcgaccgtcaagctcatcggtctcctcctctccgcaccatcaagctcgtcttcctcctcttcgcgccgccgagctcgtcggcccgtctcctagatctacattgaagagggaaaggccgccgccggcgtggggaggaaaaaggggaaggccaccgtggggagagggagaggcgtcgtggtcctccttctcttcgctgccactcttcttcgcccccggagaggagcgtcggacaccgcctcggcttcccgctcgccgtcctcaccgcttgggctaccccgccgctgctccggtcgccgccttgcttcctccgccgctgcctcgcttccttttactggtggggaatggatagaggagagatgaaaactgagggtagaaaaaaaggcgggtgggacccattcaaaagaatatgcactgcgcagtatgtactacgtatctaacaatgtttctaggtatttttaagctgagttggaggctccgcaaatgtttgcgtcgcactgctaataccttaggccgagtttagtatcaaactttttcttcaaactttcaatttttcccatcacatcaaactttactactcacataaaattttaactttttcgtcacatctttccaatttcaactaaacttttaattttagcgtgaactaataaacacagcaaatataacgttattcttctctctctctttttatttggtttgattgattgatatggctttcgagacttctccactcgttaaactcacctcactcacagcttcagcagtcccacagaataatcacatctccaagttccgaccatgaaggcagacaggcaggcaatcaagaaaaacaaacgactctctgaatgggtagtccacagcacaaacaaacctgctttcttgacaccacaaacaaaacatcttcttgccccctactacaatcaacggacccgccgcctatctactggcctcacattggatgcgtttttaccgctgatgacaaaccggctgacaaaggaacaataaaaagaaacagctgtgcgtaggactatgctgctaccctcgtgtccttctctgtcgagaaaaccggcaacacattgttcaggttatggcacggcacgattattaccctaccgtgcatgagagagaagagaagaggagaacacacactcatcagagagaagaggagaggagcagaggccctacgcttaaagccgccattattgcggcctcctcctgctgccacaataaagctaccacttcaaaccagctatgtggacagctatcctaactctacgacgatcactttgaagcaaacaacaacagcaacccaagccccctgcaatgattcagtgcagttgcaccccccaaaacatggcccggaaatcgcagcctatttttttttgacctagcatacgcctaccttttctcagctgtgtgtgtatgcgcgacacgtttcgctgacaagcagctgttgaatagtcatccgatgatttatgtgagagatttatatttcctaccttcaatttgacacgattttagtaacttcattttgataatgaataatttacttttagattttataactgtagattttcataatttatttctagggcatgacagcctgagcatcttcgtaagggtttcgactacttagtcctcctgatctcctatcagttgtgaaatgaacggaacttcagggtgtttcacttcacactttagtcggttctggtggtcctagagcacattctccaggaagcccaaatgtgatctactgcggacgtcgtgacttttggagctctgttaggagtgtagtgaggctccgccgccaccctccataatataggagcaacatttagcttcccttagcggccattttctcctcttttttactttcccatggcaaagggtctttctggccgattgcgttgtgtaactaaaattctgcttcttccaatatattgacgtgcaatttctttttcgcattcgtgaaaaataattttagtgacaatttagattgttggatgggtttaagaagctcctataaacacaacaattgagccatacatacatagaagtacataccccgcctgccctacatgcatagagagcgagtagcattcccttccatccggctccatcgcttgccccactataagatccttcctcctactccatggatcgctttggagaaagctgcttttgcctacttggacaaacacaacgcaactgaaacaagttcatattaacaaaagaagaggaattgaagctggctggcttgctcgtttccaagctcatgatggcaagatgggcctagtagtttaatggaggcgtgtgattaatgatggtaatctacggcacggcatgtttttggttccaattggggacagcggattaatctaatccggagagggatgattgctgttgctgctgatgctgttggtcccaacagtggagcgcccctgatacggagcagagcgtgagtctcctgcgcgaaatccagtggggatggatccaccattcgcgacaactaacatcgaatctcaagcatcgagtgtgcggcaaataccatgccaactaaacaaaaactttgtactactatctctgtataggtgtagccctctaaaataatgacagtactaagatccgtttaggtgaagaaaaatgtggtcaggacaatggtagtatgatactgtatttacaattccaaggcttgattactagcagtacaatagtactgcatacaaaagttcagacaattgttgctctgatcatgagtctgaatgctgcatatactgcgatatttttctcaccttttaccgcggtagttgggggtggaatcaatcgttgtgagggagagggaccaagcagttctatgatcagggcaggcagaagcagtggtgcttactgtggtcataggattgaaatgtgcaattctggtgtaagggcctgtggtcattagttggcgaaaaaatttgcccccctgtcacatttaaaatattaagcatgatctaataacaaaaacaaattacatattccaccaaaaaactaacagacaaatttattaagcctaattaatccatcattagtaatgtttacagacaaatttattaagactaattaatccatcttaattcatcattagcaatgtttattgtagcatcatattgttaaatcatggagcgactaggcttaaaagattcgtctcgtaattttctagcgaactgtataattagttttttttatatttaatacactatgcatatatacaaatattagatatgacaaaatcatagagcgattaggcttaaaagattcatctcataatttcctggcaaactgtataattgatttttttatatttaatacattatgcatatatacaaatattagatatgacaacctgaaaaattttgtttgggaacccctaagccaacctgaatgcagcagctgctgctgctacgggacagcgctatcttaccccatcaataatgtaagtgcagggtgcaggaaaaggttgcaaccatggccaaaactgcagcagctcctctcctctatgacttccctcttcctcctcacataacacatggaccaccaccaccaccacagccatcatcatgatcatccatcccctctcctccattgcattgctcccacaattatcattgttatcaccttcctcaccttgggatggagtattataatctttcttctctcacaccaaggaagaaagaaaagcatggcattgagttgacaacattccactactagtggcatgtaaaaagagcactatagctagggcacacatccactgtcacagtcacagaggcacaaacaaaccatttggcaacacattttgctttgcacattgttcgtctaccatgcatcgccacaaccttatatggagcaagaaggaaaccaccaccaccaccttccttctcgaattataaagcaccaccatcatctcttatgaaaaactatagataattactatacctaccttcgccttcaaggaagttgagttctcctttaaaagaaaggtgaaaacgagctaagtaaaaagaaaaaaagaaaaagaaaaaaagaagagcgatctagatgggactcatttcccatggtgtatactggttgactgatcctgagcatctctcatctcaaccatgatgatgacgatcacctgtgacctgatgagcttcttcctccttgactcctggttggttcactttgttgaacaacagaatgaccagaagcagcagcaggaggaggaagaaagcaaaccggacactggagacctcacatcaccgagcagctgtttgggttctcgtcgctgaagtagttgtagggatcggcatgcgggtggggctgcatcgggtagtgcatcgggtacggcatcggcggccggccgtacccgtaccccatcgccgggtaccccgccggagcagcgccgccgccgtggccatggtgaccgtggtggtggccatggccgtggtggccgtggccgttcatcatcatctgctgctgctgctgctgcatcatggccatgtactgctgctgggccatggggttgccggccgccgccgcggcctgcagcatctctgggccggacggcatgccgccgccaccgccgccgccgccgccctggtagaacgccgccgttggcatgccctgcacggcgccggcgccgccgccctgggcgctccccatgtgggggtggtgggccatcggcatggtcatgggcccgccgcccatctggcccattccggggaaaccggcaccgccccccatcatgttcggcctcatcatcatggcctgctgctgcgccggcatgccgcccatcggcccaccgacaccgccgccctggccgccaccgccgccgccgccgcccttcttcccctgagcaggatggttgccgccgccgttcggggcgccgccacccttggcgttgttcggctgcccaccgccgccgccgttcttgccgttaccgcctccgccaccttggttctgcttgccaccggcgtctttcttgccgccgccgccggcggcgttgttagcgttccccttgatctgcacggggatctcgttgccaccgccgcccttcttgccgccacccttcttgtcgccgccgccgccggcgtttggtggcggcatggccatctgcttcatcatcttgggatcgtcgaagtagtcctcgtcgaggccgtcgtcgtcgaaatcgtcctcatcgtcaaactcatcgaactcgtcatcaaactcgctgccatcgtcgccgaagtcatcctcggggggaaggttgaacttgacggacttggggtccttgatcggcgcggccgccgcgaacggcgccatcttggcggcgtccatgaactgcggcagcttcagccccttcatctgcagctgctgctgcagctgctgaagctgctgcggcgtcggctgcggcatctgcggcggcatcatcatcttcacgtctttgctgccgcctccaccgttgccgccgccaccgccgccgcccttctggcccttgccgccggcgtccttgggatgccccttgccgccgccatccttgggctggcccttgccgccgccgccgccgtcaaggtggagcttctgaaactggttgttcaccgccgccaccccgaccttggaaccccatagctccgccggcttgccggccttgttgagcttcttgataatggtggccggatccaccaggccagacaccgtcaccttcccctgctcagcgtcaatgctagtctggtacacacctgcagacataaatccaacgagcgtttcacccagaaaatttcaaaccaccatataactaaaagcaatttgctcataaaaaataatctctcttttttctgttaccttcgatcttgtggaggatcttcttgaccttcttctggcacccatcacagtggatgttcactttcagcacacaagtctgggaatttgggaggaacagagaaaacacaggtttaccaaaacagcaaaaacagaggcgttttcgaagaaaacatagcaggagaggaacacaccaggtgaatgaaaaagaaaagctagctgccctgtcttaccttctgatgaaaatggcagcaaaaacaaggagaaaaacagaatgtctgtatcatggttttgagttgagaagaagcaaaaaagaaaaaactgacctgaatcttgaggacttcctccttactcatccctgaccacctcaagtgcggcgccccccaccaacacaagcacaagaggaggcctcctcacagatctggtacaaagagtcctcaaatcagggacagaacaacaacaacaacaacaaggcagcagcaaccagtaaacattgccctctctgaagaaagggagaaggtatgatgagcaaaacagacaagaaaaatgccttctttctgaagataagttaatggcctccaatataatatctctcccttcacacactcacaccaagagttagtgctatggagagagagagaaacatataggcttattagagtttgcgtgtttgcagaaaaccaagaaggatggggctactattaagccggtggtccagagaagaagggagaggaggaagaagaagagagcttaatataaacacaggcagcaccatctcctcttacccttttgtatttgctttcgccttcggcactgcagccttgcctggaagaaggcctttctctttgcaccctccacagattgtgaaggaagggaagcctggggctcttgcaaaagacttgaagagaagagagaattaaatacccactttgtcacttgtcagtaagtacagggagatgttcaacatgtgaggtactcatcagatgtttacgccgagctcgcaatgtcggttttttcttgcttttttgaaaaagtgtccagaaaatcttgtttttctgcaaatttcatattagcccttctagcctctgtaacttgcagttaagactgactctgcagcattttggtcttcggggttcttaaaaaaaaatatttttgaatgtttctcaaaagacttggtgaaaaatttagcaaattgtacgtaggatgacaccgacgcatgaaaatatgtttcatgcaaaaattaagattttacgtgaaaaaacatgcaaccaaaccatccatgcacgagcgcttgtcctattcggtcgtcatgtattccatgcattacatttacagtttatatgacaagagcaatacgacgtccgtacaaccgacatataaagaagcttttaatgattcaattgtaaacgagtagtcttggccataacgtattccatgtactccaatccattgtagtttgtgtgacgagagcattagaacgtccgtataatcgacaaataaggaagctttaactacttgcaacgcttcaaaacgggtagcggttatgattctccgacgtttattgcaacactcgtacaacaagatatacatttccgttttgtagcatatcacattatttaacgatgtagacattacatgcttgaccttacaagctatattttcggttacatacgacaacggctagtcagcttctcagactcaacaaatctgtttttgtcgagaacagaagaaataggcatatcacgttttctccggtctatcaccctatcaattcaacgtaaagataaaataggcactaaggtagtgcaaaataagaaaaatacaactactagagggtttttaccggcgaagtaacctcaaccagaattactctcttatgaaggggctaatatgcaaaacaaaaggagatgagaaggggttccctgtgctgtgctgatcacgcgcccggtcaatcgtgtaacgcgcgtagctttgggcatcgtcacgctgtgcaggcagggcaaggcgatgtggtccgtagacgcgccgcggccacgccatctcatctctatctctctctctatctatctatctgtctatctcccctggctgcgcggcgcccgcgccgtgctgccgtggcgagcgagccgtgtgcgtgtgcggcgtgggctgcgcgcgccgcgcggtgcgcggtacgtacgtcgtccactgcaaaccgccgcgagccaagccgcgcgagacgacggcaacaacaacgtacgcgaggcgcgcgcgcgcggtcacgccatcctcgcgctcgcgctagctagcgttggcgttggcgtggcgcgacgcgcgagcggcagcggcagcgcgaggcgagcgctctccatgcatgcatatccccatgtctgtgtgtcagaggagggaggtgagcacaataactactcaggctcttattgatgacgccctcttaacttggcctttgcctctctctgcactgcacctgcatgcgtttcacctcccctgatttttttgtccactctttcccttccgttactgtcttttactactactccctctctctttttttttctttttgtttctatacgcactcgtctctccaaaaaggaagaggagaaaaaaaaacgtaaaagggctggtcacaaaaaaaaaaaacggaagggaagggatggtaaagtcttggtcacgctgacctcgcgcggtgtgacggatggatggacggttcacggctcatgcgcagaattgcagggtagtattgcagttttttgttgttgttgtagcagatcatcgtggtttgacgtcgctgacggatgaggaaggcagcagggagggcgatgggtgacagtttgcgtgtcgctgtcgcagctcctgctcctgcatgccatgccactgttgcgatcgggtgcacttcactgttcactcgtaaaacacagcaccatccagcgttcgatccattatcatctactacgtgctcaattaccctggaaacagttcggttaattcagagggattgacacaaacataaatttgttaaatatttggagatatatactgtactccgtattttacatttcaagcgaacaattaaaccaagatatgtgcagttgagctgaagatatgattgcaacatcgtcatcgtcgcgagcaaatcgcaaatcgaggttacagatttgttcgtatatgcactctcatctttttgacgaagagaggcaccgcaccagccttgcatgcatgctgctagtgtgctggatcaagctagattgatgtcaggtagccaattttgaacttcagtttctcgcgaaatttgctgtcatccatgggatcgatgcagtgacctgtatacattggaaactcgcgtatatggatgcatgtatctgatgaatttctttgtatgcatttgctatctttgcatgcagtgtcttaatgccatgtctactttgattgctatgtgcctatgtttgctactgcaagaggacaaggaggtagtcgacatatatacacgtacttgaatttgtactcacatgtagtagtaattgttcatctctcgcattcaggcttactgtacaatcacaccttgcaggagtaccgcatccgtgtgactctccactactagtatttgttctatctcccatatgaaaacaagaggctttttgatcatctagtcattgacacactcgcaataaattggcttgacgtattttgcagctgtggtcgcgttaacttatcttcataaaattccaacagccaaacagaaaaaaaagataccacaccaggcacaggttcgttcttgcgtgccttgtgagtgaagaagatgtttgggaagatgaagatggcacttcgaagttttcttttggtgaaaccatgaaagggatcgatggctattgtgctgggaacaagttcctctgacatgctgttctctaacgcgtggatcgttaacatatcaatcatttaaattcagaagatagtagtaataagttagagcctcattggttactcttacaagctactccatccgtcccattttaagtgtaaccatgagttttcgcgctcaattttgatcattcgtcttatttgatttttttatagttagtattttttttgttgttatgagatgataaaacataatagtacttaactcgtgatttatgtttttgttttttttcaaataagacggacgatcaaaattgggcgcgaaaaaccataactgcacttaaaatgggacggagggagtaaagtcgaagctaaaatttgaattatcaaattttattttaaagttgattttaaggtatttttaattagtttttaaataactaaaaacacacatatataaaattcttattttctaataagtcgagctggggctggacggacggcgccaactcgtgggccaccttgtgcggcctagcaaacgtttgctaccttgtagagatgtcactagtgatcgacttttgcaggagaagttttcgtggagaagcatgcatgggccggatggattagttggtacagtagaaaaaggggcacacaagaggccagaatgtgaccgatttttttgttgagatcgacttgaggaggaacacgttgcatcgcatgcattttggtggtgtttgccgggccacccaccgccatgcatgaatcagtcggtcggtgtgacatgattttgatggatcatgcttgtcctaattaatgtgggtgccatattgcagggcaacttataaggttgtgtttagttccttccaaaattgaaaatttgagttgaaattggtacgatgtgactgaaaagttgtgtgtgtatgacaggttgatacaatgaaaaaaagttagaagtttggatccaaagtttgaatctaaacatagtctaagtaaatcactgcagttttgcaaccggcatatatcctgaactctgcgattgaactagctggactgaatatgatcagtcgatcatgacttggctaattcggacaggtagggaaagcaaaggtatatatggtatgatggaggctggccttgcacagttgcactttccaagtgacagcaactgaactcacaagaaaacaatcggggctactcctaagttggactctgatcacgtacactacggaattgaagcaaagaggttacttgcattgtcctatataagcttggcaaatggcatgcaaatgtttacagcatatataatagcggagtggattctaaaactctaagagattccttacttgcatattatttaaatggttataaaaatattagaaaattcaataagatagttaacgtatattcaacaagacaagttgaaaaaaccaaattaaactatgactaacgtatattcacaatcaaatttgttttctttcgttacatcttatataagttgaatttgaccttgtatatttttggagtgatttatcacattttaatcgatcttgtttaatatttttacaattatttggattaaatgcaaatattattagtagtagtacattggatatgcatgtcggcacgtctggttcatgagaggccatgttgattgattatgaaagtaggaaattaaagctttgattattgttgcctagctggtttcatccatttgtagcgatcgatggcgtttgagatcattaattctttcaagctagctagccatcggtgttttggctacttttgtgtgcccatctgatgtaaacctgcgatgtataagttgtctagaactctagattcagcatgcatgggaagcagacttgacattatatccaatccaaggacgacatcgatcaattgatcgacataaaaaatactgtgcaaaacatgattacctactgctcaatagtatgatataatgaaccatattattaccctctaccaggtcccttttgcaaaagacgtgataaattcttgcgcgtaataatattaatgttgaaattacttgctttgacgttaaaattaacaacataccgagagttatcatataattaaatccacacaatacgttcgcaacacatctatatactccttgattaatgaatgactttcatcaatcaggattaaggaccggtggtagtaccttgtaagcattgctaaagcaaaattaaaggccatgatgcttatcttgaacccagcacgtgattcgacaatagagaatccccggcagggatctacccatcaggcagggtgggtagaccgattcagctacgactcgtgtcaccccacactcttaacacccccttatagtagtcatggactatcaaaattaggtataacaaggtataaacacataacaaattaagacagttataagaatgaactattaatacgatatgtattgtgttcgattgcttttatcgagtgaacttatctgttctccgccccatctatagtttagagctgcgtccgccactaatccccggctatctcgcggtagtgaatgcttgcgaaatgacccatcatgtaaatgacgagatttcaacagacttagcagtcataattatgcacatcaacatttgcaagtacaacgtttatactgcttagatggcactttacaatagatttgtttttatagaaaagatttgatttaatttagagcatctccaatagaagccgtatatgttccctacagtcaaatttgaggatttcaagtccataacccaccttaaatgactgctcaaaacaactcccgggttttacagagccccgaaaacacctcaccctcgctagttttggggcgtttttggagcccatgatccgtccctaccctcattctctcgtccagccttgcaatccgtgatgtggcactggtgcggatcaactagagctagctcctcgatgaggctttccaccacatccatctactctgcccaccggccacccacaacatgagtagccatgccacgggatctatggcgttaccggccagcacctaaagtcattgttacaatcgtccacaattgtctctgtgtcttatttattatattatgtagttatgttgagtaaaatatgtgattttgtagtcgtctaacattttcaacatacattactagtttcggattgatgtagaaatgtttcctccatatagttttgtctcttatactgtttttgattccatatcggaggaaatatatgattgatgctgtgttctccggctcgagttgggaacccttcccccattatacacaaaacaagtgacggttttacatatgattaatcaagtaatagaaaagaaaaataaaaaattgattaatatgatttttaaagcaacacacacacacacacacacacacacacacacacacacacatatatatatatatatatatatatatatatatatatatatatatatataaaacacattgtttaattggaaagcgcacacgcgaaaaacaagggagatgatcaaagttgggaaagtagactaaatagcacatcctgagactgtttttcgaccatttcgaacccttttttttcatagttggagatgctctttgatgatgtgattcggttattgggtttatcgctctcttttacaagcttcctttaaaaggcgctaaaatttcactactacaaaatattgaccaaagaactattccctccgttctaaaataagtgtagttttgcactattcacattcaacgtttgaccgttcgtcttatttaaattttttttataattagtatttttattgctattagatgataaaacatgaataatactttataagtgactaaatatttttaaatttttcataaatttttttaataagacggacagtcaaacgttgagcacgaatatctacgactgtacttagtagttcagctcatccccaaaagattctctaaatttccaacctgccgaaggaggcgacggacgattttcctcttgccgattcggaatgatttgatttgaagtgtaataatggaagcggatgattgttcatgggcatctagcagggggccctggcctggaccagctgctaggctgcccagtcgatcggccggctttgggcgctcaccaaggcccgtggcctcggcctcctcgctcgtttgggccacagtcgtacgtacagctgatgagcgccttctggtcttgtcgtcatgggcctcagggaccacgcgtatcggcgtatgtacgtacaataatacgatcgatacatacgcggcgggacatcaaattatgtttcctgattccgagtgtat

SEQ ID NO: 56116 - DNA, 7989 bp, Oryza sativa
atggtagcagcacagaaaaccacggttaatacgtccgcctgatttatttgaggctacaaatggaagaacaatcagccccaaacctgtacgtacacgcgtttaattagtattccctccgttctatagtagaagacttttttgactttctatttgcaaccttcgaccatgtgttctatatgaaaaatcagtgcaaatataacaaaaaagtcatatgtcaagtacttttgataataaagcaaatgataaacaaaataaataataatttcaaaattttttaaataagacgaatgataaagtacttttgataataaagcaaatgataaacaaaataaataataattctaaatttttttgaataagacgaatgatcaaacattgacaaataaaaaatcaagacaagtaatatgggacgaagaaaatcaagacaagtaatatgggacgaaggtagtataattgtgaaaaaaaaaagagaattgcacgtgacaataacgtccagatcatcgagaccacgagctgtcttgactctgagtctggacagaaactgtgagagagtgagtttgtctgttttgttttgttttccgcgcgcatgtttcccaatctactaaacggtgtgtttttttgtaaaaattttctatagaaaagttgctttaaaaaatcatattaatctatttttgaaatttaaaatagttaatactcaattaatcatgagctaatagctcacctcgttttatgtatcttcccaatctcctcaatccccttctcctcaaacacacccttagctagtgtgtactactgttagtagtgtaccactgcagggttgtgtacgtgggctatgtttagtttctaaaattgaggagaagtttggagaaagttgggctgtgtttagatccaaagtttggatccaaacttcagtccttttccatcgcatcaatctgtcatacacacacaacttttcagtcatattatctccaatatcaaccaaaatctaaactttgcgctgaactaaacacaacttggtagtttagaaaaaaagttgggagtttatgtgtgtaggaaagttttggatgggatgtgatggaaagtgggaagtttgagggaagtttggtgtgaactaaacagggcactggtgagagcggtcgatcagcgtcgacacaatgtaaggccgagtttagttctaaactttttcttcaaacttctaacttttcaatcacatccaaactttcttacacacataaacttctaacttttccatcacatcattccaatttcaaccaaactttcaattttagcgtgacataaacacatcctaaggcttctcacagtgcggtgagctggctcgtgccttacctgcgccatggaggattttcgcttaggtggagctaggaatcgcgactaagcttggcccctcgtccccaaacatagcgacacggtaccacgctttgacgagtccacgcgcgtccgttctttgacgcagcgtgtccttgcgccgcagccgctcggagaaatcccaaattcgccctccaaaaatccagtctgcgccgacgttcttgctgctgccgacggcgtcgtcgtcgtcattggccacaactcaatcaaatcaaaacaaaatcccaaacaagataccaagttcattcaatcccaagatcaaatcccaactcaccaagacgagaaatttctccttctccgagaaacaatctgaactagtatatgcacacaaagatgaaagctaagaaaagcagcggacatttctccttctccaagaaattttgcctaacgacaagaaggagcaggcgcaggacaagccgccgccgcacctacacccgcacctcctccgcgccaccgccgctggcccggcccacccgctccttctcctggcggcggtggctggtgctgcgcctgcgcggctcctctgtgggcgccggcggctccgccgacgccgagccactgcagctgcgaggcggcatcagcacggcgggcgagcggcggactccggtgacgcggcgggcgagcggcatcagcacggcgtcgtaggcggggacacagaggaggatgctgaccacctcgaagccggcttcccgtcgtcgtcgcgtcatcttcccatcgggacagagaagggaagggaaggaggcgccgtagccacatcccgcgctgtagccacagacggaagggcgagagacgggtgagaccgtgccgccgccccccgaagccgaccgctgccgccggggatgcgtcccgccgccaccgcgccagtcaccgccgttggggacgcaccccgccgccgcaaggggttggatagagcgaagcggtcgaggtgtccgcctgcgtgctgggttggagagaggggtaggtgaggaataaattttgctccgttaccgtgtccaaaagcctgggttcacgcccactgtgggcttcgtttccttcatcagtgtctccatccaattaagccacacatatatgggtgcttacactatgtggtggatgtctttggactaaccttttgagctaagggcacccgcaatggttatctataggctctttacaagatatccatgtcagcatattttcctacttggaagagattaaatgaagagagagagcaaagctatctactaacgtggagatagtttatagagaaaaacgagacaatgcattagagagctatagatacccatatagacatactattgaggtggtttactattaatctagtctattgctaagatgtacatgttttacagagagcaccttactttaacattacgggtgctctaaggtacgggccccatgtcttacaatgtgagaggcctaaatatgcatcatgcatgccttggcagtttggctggttcccgtttaacttcacataacaacaacgactcagcgctcggtccggatcgcaagcaacgcggccaccgcgggatgctgccggcggcaaatgctcctcgatcggggcaggaaatccacgcggattcacaaaggcgtgtgggttagtatgtactccgtactagctagcctgtacactaggatcacgcacgcacgcacgcacgcacgcacgcacgcacgccggccggcctttgttgttgttgttcctgcgccctgggcagtcaatggatggggtgtggcacgcgcgtcgtgcaaccgcggcaacatcccgtgactcgcgtgtcggtgtcagtagttaacgattggggctatttgattcaatgcttcaatttgacacaactccttaggcttgtgtttggtttattgtcatagttatagcaagccacactttctcaccgtcctaccccacatgtcataaactcaattctttgcctaactttgccacacgtgtggcttacaatttgtaggaaaaaaaaacgtgataagtcacatttgtctaacattgtctaaagtgatttatatcaatgttagttaagaaccaaacagcccctaactcctgtgactgtgtgactgcaacttgcgtttgcacgccgcgtaccatgtccgtatataggagtactgtactacacaggttgtgctcgccgctgctgccaatacagctagtagtagtagtagtagtacagtactgtacgtcaatgcccgtcatgggcgctcctgcacccagcagctagctgggtcgcgtggcttgcgtgcctctcaaacacgtacgatcgcgtgttcgtgtgcaccgtggaatggctcgcggggctgcatctgtagttgtagtaggctattttgtagtaattttggaagaaaaccaacatcagctctagcctcatgttttctctttaagtcttgaagtttgtatggttttccagtagtgttgccaaacggtatttgttgcaaatgtctgtggttaaaattcctttaggattcaacgaggcattattcccgcatttttactattcttgtttttctgaatcccatattccaaagaagcccttaacgggtattaactattgccatccaatttctatcctgaattatggtgcatacgaaattacaaaatcggatggtacatacatgtccaaatttctcatatacaatttttgttctaaaatataagcatatgttgcatatcttaactaattaagagattcgtattttttctttcgtcacctcgtccgtgcggtgattttcgctcgccctcctccccaacaaaaaaaaaccagtcggaattccatcatacaaataaaactgaagcgtatgaatcgaagacaaggacacaagaagaaaaacgataccggaaggagagggtgccgctgtcgccgccgaaccgccgccgccgtcgaagggacgctggttcgccgcggctcccctcctgctggatccgattgaggggaggctgggccgttatcgcctcacgtcccctcccctcctgctagatccgggatgccgggtctaggccgccgggccgccgccgcctcccctcccactagattcggcggaggggagggtgccaccgccgctgggccgcagcggaggggagggcgccgcgcggaagacgatggggaggggcactgcgcggaagacgacagggaggggcgccggggcaaggccgcttgatggcggcgcactcaccctcgggcaagtgcgcacaccggggaggaggcatgcgccagtgccgctgcttttctcttttcgggcgagggggcgaggaggctagggttttcaccggcgccgggagggatggggttttgtcccttcaacgtcggcaccggtcgtccgatcaaaaccctaagatcagacggccggcactggccgaaccgaattcggcccaagtagaggcgcgcgcggggaggcttccccagcccaggcccaggttgcggcccagggaggtggggagctcccgcatgtgtacataagaggccgtgggccgaccagccagtccgggagaaagtctgatttagatccctaagcaacatttttttttcaatgtacacactccgtaatcacccggtgcaacgcacaggcacttttgctagtctgaatatactcaagaacaagagtgaatatttatatccctgtaaaaatatatcaggaaattaatactattttctcacaaacagaacatatcacactgcactgaacagccagagcactcatagtactaaaaacatgcatacacaagatagcgagcaatataatggtatcacaatttcctggatcgagagggggcttcaattaggccgtgtagacgccgatggaatcgagcaattctccagagcggccgaagaagccgacgacgcggccgctggcggtgaacgacgtgccctccgcgcggccgaacgggccgtacgccctcaggttggtggccaccctcagcgacatcaccaccacgttgctgttgtacgcgccgtacgtcccggacacttccatcacgtactccgatagccccagctggatctgcatcgtcgtcacagtacacgatcgacacaattgtgaacggcacgaacattattttgttggacatggatgcatcatgttcaaaatctagtatatatataaaccacagtggaacccgaattaatatttcaccttgggtgtgcaattaatgatattcaaactctacatgaaccactgttgcttcctctggggagaagtataaggaattagggagtattttcaataccaatataattgatgcatattgtagaaaaaatagtgttaaggtatttctagaaaaaaatattatagaaaaatatgaagtagaatgctttatgcacggaaaattgacatataattcaaaagggcattcttaattatgttatatttccatgttaaaaaaaattcatatactcaccgtggttgtatcgcctccactgctactgccccatgggccaacagagcgctactgaccagtttggtcagtgtaagaaaaggacatggagtcaattgtccagccgtgacggattgttatgctttctaaacgctggggtgcaatagggatgtcgtgaggagtgcctccagttccaccccatggtccaaccttagtgggatggctttgctgaaatggattgaaagagttacttttgctttacctattcatgatgcaaatgaaatatactttttttgcacggtatgtctaaaagaagatatttctcttactcctatggtcataaatactcggacagctcttgaaaaagaaatgttggtgactgaactaattgcaaaatacatgtaatgcttaacaatttacaagtttgtgttaaattgctctttaagccaaatctagtacatgattttccaaaataccatttgaaggatatcgatgcttaaaacttatagaagtatgacaaaaaacattgtccaaaattatgagcattatttgtgactacatcagaatgagtagatggtagcaatcagagttctaaggccaaacaaaccacacggagaatagcattctttcagataacgggtaaacttccattaatacttactccctctgtttcaggttataagatgttttaaagtcaaaattgctttaagtttaactaagtttgtagaaaaaagcagtaacattttcaacccaagacaaatttactatgtaaatatattcaattatttatttgatgaaactaatttagtattataaatattactatatatttatctataaacttagttaaatttgaaatagtttaactttgatcaaagtcaaaacgtcttataatctgattataatctgaaagggagggattaaaaactaatgaaacagaggaaaaacttggtcaaaatttttgttcaactcacattgtacgtgggcatggggtactgctgggatggtcccattggcagagtctgagagcctctaggcacagggcagaatccatggattgtaatctctatgatgttgccatcgtttctccgttggtgcaccctcttctggatcacacctcctgccatggcgaactgaccggtcccaccaacaattccccattcaccgttttcgacagacacttgtcgacgtttgatgtctcgactacggtatttagacagtatggggatcgttggtgctaggatatatgcgagactgaggtaaaagagatggagacagggatttttatacaggttcgggcccctgagtagtcaggtaataaccctacatcctgttggccgaagccggtattgctcttattcaccataatcataccagtacaatatgtgggtagcctatctaactgttgtcgacatgtcggtctgaaggtctgactcgtagtcgacaacagggtagtcttcctcctcgaattcgtgcccggcgagatcagagatagcgctttcgtatctcctgacagtatccggaggcaccgtaggagaatagccatgcctatccctgaagtcgatatccggcggcgtgtcttggcgtatgtaggcttctatgttgtggcttctatgtcgattgtgttgggtgttgatcctgttgattgtctccttgtgggtgtccccctgtcctcctaggggggcttgtatttatacccataggtgtttccttgtccaagtagaactagggaaaccaatatggatacaatccgagtagtccttgtcatttccatgtagaactctggttctctttccttatccgaaactccctccatatctgaagtcggtttccgtataggacatggtatgtggtgggtcctgccgagatttagtcaactactattaggtatgtggtatccataaccataacaacactcccatcaccaaaagcgtggatcccctaaacctaagtacaacacaaataaacatgtcaattttttaattaaaacatgccctttcagctatatattattctaggcgtatcgttcttcggtgctcaagtgctatcttcgtcccgaaataaatttattttcatacatcctgcacataccaatataaaccacaaaaaaaactagaatacctctactttatcaaatctcaatgcaactatttctcactccatctactctcaatataattatatcatactttcataaactatgtttcaatgattactcaaaaacaaactta

SEQ ID NO: 56117 - DNA, 3563 bp, Oryza sativa
agtaaatttaatttggaatagaggaagtactttaacaatgtgacgaatataactgatatgtaaatacaatgtaaatagggtgtaactactacgtaagtactaactaaagtgttatgtaattattgcataatggatataactttagttttggcaagggaagaaaaaatggtgccatgctcaattggtttggtgctatcactacaacttagaagattagaagaccagggtttcgatccctgccaccgtgctttgtacattttttctgctactacgcactagcacagatatcaaagtacatcctatggccaaaaaatcgactaattttcataaaaaactgatgacatatttatagcaaatccgattttatttttatatttgtttaaattgaaacgtgtcttacaataaagttatactgcctcttttcttaaatagatattgccctaaaacgtatatatagtcaaaccttgaagtcttaaataattaattaatataaaaatattatgatttgatatgagaaaacgatatcggtgtatttgttataaaaagtacattcatatggttatcatatctttctagcttttataaacatgtattccctccgttttatatcataagactttctagcattgtctatatttatgtatatgttaataaatctagacatatatagaatttcgaggaagtagtaaaaaaaaagatggtgatataatacatgtactgcgagacggtttcaatgcccaaaacgacaagtaaagaaaacacggagggaattgaagcacgggtacctttggtcctcgaagacgatggtgaaggagttgtgccagtcaccggcgtagacgtggagtccccgcgcgcgggcgacgagggagccgaggccgtcgtagatgggccagttgttgacggtggtggcgccgagccccgtggcggcgtcggcggcgagcatcaccgactgcgtcgggttgggccccaggtagagatggtgcaagtagaggttgcggaagttgagctcgttgtactgctccaccagcgccccgcacggcgtcacctgcaggctactgcctgtaattgggtacccagagctaggagggtaagccatgtctcagcaatagctgaacttagctagcttcagacttcagagatcgattgtatgtgtgttataatgttaatatgttgtgtgtgcctttgctatcgctagacagtagacagagaagaggtgcaggattgtagctagctagctgctgggagaatgtggagctggctggagtagtggtctccatctccagggcatatatatcccatatatatttgggcatacatgggtgtgtgtatcacgagtgtggctggccacatcctccatatcgatcgtcgtcctagcttgatcaaaacattggatagcattgttgattgttgaaaggtcgatgcggccatagcttgtgtgtgagaaacgtattgtatgtatctaattcatttggtggttgttctacaattcgcgtacgtgttcctttcaatcggattgaaagttgatgttctcacttaagaatgtacatactgtaaattttcatgattaatatgctaataatgagatatttgagagagaaccatgcaagtttctatggttaattgtgttagaatggaaaattggctttgtgttagttaatatgattgttgtgaggggaatatgattgtttttgttggcgaaaacaatgaaaaatgcttaggggtcttttggttagctccataagatggtgagttagctggcctagctaggttcaatttttttttaagaggggggtattgtattcaatatgcttctgcagtgataatggtcctctatcataatgatcatcttccattcaataatttgcccacaatgtaatgttatccacaaatttatttagacaaacattgaacttgatagcaatgccatgcctgttagaccaaacacagctatctccatcagtcttccaatcaagcacgtgaggtggatcatggccaagttcagcaactgtcctattaaacacaacaaaatatatatttgattcaaaattatgatttgactgaacctgcatcaacaaaatttaaaattaattgttcatccccggtacctatgccgtattggtgtcatccggatgatctgtcaagcgttgacgttcagttcaattcagaggattccgattcattctatgctgaattattctccatatcttatctggcaaacctgtttaacgtcgagaggccttgtttctcaagttatgaagtcatatgacgaattcacgatgacttttgtctagttaatgttacatatactgcgcttgatttcacaagattgtcgccatgctctagggcctattttgggagctttagattctgagaagcagctgtttggtagccagcttctgatattctggaaaaactctgaaaaccagctgtttggtagctaacttctgatattttggaaaaactctgaaacccagcttctatagcttctgacttcttagttcatttttcagaatctgtaactacagatgaaacccagcttctgacttcttagttcatttttactacagatgaaacccagcttctacagcttctgacttcttagttcatttttcagaatctgtaactacagatgaaacctagcttctacagcttctgacttcttagttcatttttcagaatctgtaactacagatgaaacctagcttctacagcttctgacttcttagttcatttttcagaatctgtaactacagattcacagcttctgacttcttagttcatttttcagaatctataactatagattctcagaagctgtggactatttgggcagcttttaagaagctgtgaattgtttggggcagcttctagcagaagcagcttttgggaaaagctgcagttgggacaacctcccccaaacatggccctagtgtctttggaagccagagatctgagccctaaatattcttcatccgacggcaacggcgtgtcattcttggtccggcagccctatctatgcagctcagcaacgcaccacggcttgctattaatccaactctaatgcaaattaacaccaccaggatttggaagtcacaaccagtgacccaatctcttgcattcaaacatgttaaaaatgttatcaaatgatcaaatgaaaacatagatgataatttacatgtgtacatcctaaatagaacctaaatcggcacgtttagccgatttaggatcgcctgtgccaatacatggcacagcagtaagcatctgataaattcttgcttctggtcctgaagcaaccacatgttactgggatccgttcttcttcatcctcagaaagctaactaatgtgagcctggagggagcaccggttcccggtctcctcttaattgttgtcgtcttccacagctttccatctctcatggtagtcgtggttgtagatgatacgttatagaactgcatacagacaagttgtgactggaacttaaaatgtttggatgaagatttaagttctcaagaattgttgagaaaatatttacctcacatacaccatgcagaagcaacctctg

SEQ ID NO: 56118 - DNA, 5909 bp, Oryza sativa
ttcctgcagccccgtgagtgtatacatcaaaagtttcacaagactgataaatgttggcaaaataagcactcaaccatctcatttctgagaataataacacatttcacagtagcaataacagacaatcaggtcaccatgtttaagcctgaagcctgagcaacaggactgcttccttttcattaagaagataactatacagtaccattccaaattgcagagacagatgcaagagcgaacagaacatcatctaaaaagcttaggtacccgcactgttacttgtaagccagctattagggctagcaatgccaggagagattttctcagaccctcaaaagtgtaaatcatgttgtaaaggaatatttctagatgtatgtttagatggtccttaccttaccatgagttgtacagaaaaatcttttaaaccaaaatggttaatggtgtaataagataggtgatgatctcagaccctcaaaagtgtaaatcatgttgtaaaggaatattatagatgcatgtttaggtggtccttaccttaccaggagttgtacagaaaaatcttttaaaccaaaatggttaatggtgtaataagataggtgatgatctcagaccctcaaaagtgtaaatcatgttgtaaaggaatattatagatgcatgtttagatggtcctttaccttaccaggagttctatagaaaaaaaattaagccaaaatggttaattgtgtaataagataggtgctgatctaagaccctcaaaagtttaaatcatgttgtaaaggaatattctagatgttagatgtatgtttatatggtccttaccatgagttctacagaaaaatcttttaagccaaaatggttaatggtgtaataagataggtgtgtaatgcaattccacgctacaaccaaaaacactgtaaggatccctaaattgcacctaattgtttgttcgaacttgctcataaaaaaggtgtttgatcttttaaaactacaaaatcagaaagatgcatcaagtagtaaaacaactcccaactaaacaaatctagtaaccattgtggcaaacagaaatacaaaaagtatggcaattggtttaaagagtacaatcaaagagaaagaaaggcatacctcatatatgtcaagcagatctgggaggaaatttctctttatggcttctcttgtttggcgatctatacgatgccaagcattgagagcaatcaattcatcgctgtccacatgattcttctgttttgtagaagattgtttcatctgttgcatcaatcgtgcctacagataaaaagcacagtaagcaaaatggatccctaaaaagttcacatggtatctagatgataggcccttttttctaattacacggtcggtttgatatattattgtcaactcaaggtggacaacacagattactgacgcactagcatacctcaacgtccatgtcaatactcctgaaggcatcccattcaccatcacttgtcctacaaaatgcagaaacgggcagttcctcacctacatgtagaatatagataagtataacatacaaaaaagatgtggaacatctctgtaataatacatcgaaaatactaatttccctgcagtaaacagtcagcacaattaaagtgcacaactgaacataagcacttggaaggaaaaaaagtgtgacaatcagggaaactggatagcatacatccttcctgtaaatctatatatttttaattaatgacacacagttaacatgcacatgcagtaaggaaaataatattgtttctcattctcaatgtgaacacatcgtaaagagtatgcataacatggctcacatcttctagagaacttactactccctacacaaatctgaacattcaatggccagactgtaagacctgcaatatggagttagaaaatgtgagcagcactggagcttaccccatggtggaggagcaaaaaggcctttgatttcttcaacatgaagacgggggacaagttcaatgagcaagcgatcattcaaccacctacgagatctccggttactaacctgtgtaacattacaatctgtaaaccatcaacctgcatattcctaatgtcaaatataacaacatactgtatcaaatataacagattatttttagctgctattccgtagatcactatccatttctttgcaacagggatgaaaccataatttcatttaatcataagctaacaacccaccttcatttagctgcaaaggaacaagctaacagttttttttattctagcaggatgagccgtctcaccttggtggccatgtcctcaagaacttcaatcttcctctcaatcatctgcccacgcgacttgacggcatcgccgcctaagttcacaaaccaaagggcgcccagtgtgaaaaaaaaaagaaaaaagaaaaaaaaactcacttgcattaggagacacctcggggggcaatttcgaaggtaaaaggagagtcacctttgggggagtcgaacaaggaggcgtagaactcctcctccctcctcagcagatccgccatggtggactcccttcccgcgggcttgtcgcgctccccctcctcggcctcgaagctcgaagtgctgcggcgatggaggatttgagagggagtagaattgcggggtggatggattgcgcgtcgtggtgtttctagggctaaaatatggtggggcgattgattggggaatcgtgttcgagagaagcgatgcgcacgcagagtagtggtgaggaatatgcggatacgtggcaccggatacccgtgggctgatattagcaattgggcctaaacagcaaagcccaattaccagaaacagcaaagtccaggtttgcttcccattcatgggcctcatggctgctcatggccagtgttctagataatttttaggaaagtctatacgtagcttgtcttacttaaacttttattactaacaccatgtgttacactgtgagtacatctcgattttttattatttctatctacttacaaatggttgagcttattgtttgtaaaagttttgtaaaagaaatttagtacgtgtagcagtgctctaatttttataagtaggtgaaagcccgcgtattgctgcgggaatttagtatgtttgtgaattatgtgaattattatgtgatatacattgaaacattatgtgaattatgttggatgataatttaatatgtttgtgtttgaaaagctcttaaattataaaaactataaagatatagcatgtttgcatgatgtttaaatgtgatgattgttagtggatgatgatgtggtatcttgttaattagtggatgatgatgtagcatctttgcatgaagatatacattgaaacattatgtgaattatgttggatgataatttaacatgtttgtatttcaaaagctcttaaattataaaaaatataaagatataacatgtttgcatgatgtttaaatgtgatgattgttagtggataataatgtgacatcttgttaattagtggatgatgatgtggcatctatgcatgttaagcttaagataaaattttcaccttcctatcaacagaagacgaccaggcaaagttggcatcacaagtttcttagtagtattttcttttttttagcaagagaggagatcctctcctgttcccattagcagaaacgatacaatatcccattggagttggacacaaccaaagcaccattctgttgtactccgttttcctgtgatgatgccatggcaatgtcacgaggggaaaaaaaattcaacaaaaagcatccaatcccttgtaaatacttttacttctacttcatataatgaaattggcccggtcttatgtcggtgcgttaaaaaaaaaagaaagcatccaatccacataccaacgcaacaaaagcaaacaccgccggccgcagccgcaccgcacgacacgacgagacgtgagggccggcgcacacgacgcaagcagcacgaacggataagataaaaattgccctcaaaaagaaaaacggataagataaaacagataaatatactatgcgtgccaccaaacaggcaaacaaaaaaaaaactacaaaaagcacaggagatttctatgggattcgtctagaaagctacgattcctagttcctacccttcccggtaacttatttatcctcccaaatcctctccaaattcaaacccaccatttccttttctttaaaaaaaaactttacttaaacgctagtagtacacttccactagtgaaaaaaagacgaggagtcggagtcccccacgcttcgtcctctgcttcccacgcgccacaaatttcttcgccttcttcccacgcaacgcctcgccggagaaacaggagacgagtagtagacgactagtgcgagccaagggcatggcgcggcagcagcagcagcgggaggaggagagggccccaatgggcgcggcccagcggcggctgcgcgccgtctccggccacctccagccgccgacggagtccggcggcgttgacctcgccgccaaccccaccgccggcgagtacgcgcacggtacgtacgatcgatcgatcgatcgtctattcgtctgcactactacttgctacttactagtgatgtggtatgcatttgtgattttatccatcccgtgcatgattgatgccgcgatttggatcttggggttggattgcgtggggcctactgggcgcgcgcaccgctcgagcgtaaagtggataaagtggagaataacaagtgcaaccactcccaaattcccaattcttaagctgtagagatagcttcctctttctgaatttgtgcttagactgggcatctatgccataattccattgctgagctcggtaaccgtctaaaataattgcttagctccgagctcgttagcttttaactgactgggatgcttcttttcctattttttagtacgccgacgcatgctagttgcggtttctcaactgcactctgcatgttttaagttatctttcttgacatagcaatgctttttttttttaaagtttacaactcaatgtgcatagcttctccagtgcagggctacagtgctgtactccctgagaagttgcaaactggaaagtggaatgtgtacaggtaggttatttagtagtatatgttatactgcatttgcttatgtcatggctcaaaatttctgtttccatcttgcagatccgcaaagtcacctcttaagttaataaatagattccctgataacccagacattggaacgcttcatgataactttgtgtaagaatcctcatagtctgacttgagcatcaaacttctatttctgaatgttaatctcaacttcgacaaatctcagttatttaccaatgttatgctacgatttatcaaattcttgtcttgaattgtcagcaaacctttgagtgtaattacataccatcaagcaaaataaatgctagttatgttttccttaggaatctcccatattttttgtttctgaattgtatcaggaagatttttaggaaaatctaatctaattaggaaaaagaattattcgcaagtgagtctgttattttattgaaaccttggagttggaaaatgtttgtatgcaacgacttgaatgcaaaggtttttatctgatgtttttatgaaaactggtaaacttaaatgcctgttgcaggctacatgttttacaagagaactattagtgttcaaatttaagttctgtgataagttctcaggcaatatacccaaaattgtgcaggtatgcagttgaaacctttagggactgtagatacctgggcacaagagtctgtgttgatggaacagttggggagtaagaattggttcctggatatatatgtcattattgccttttgtagctttgttaaaatcttttaaatgatatatatgaattgttgcagctacaaatggatgacatgggctgcaggaat

SEQ ID NO: 56119 - DNA, 1976 bp, Oryza sativa
acaagcaccgtccttctgattttaactactaacaggcagatcttgtcacacattgccataatgatatagcatttgtggttacacttacagattcctttttttaaacttgcattaaataattttctaaaactgaaccagggtgcgcgcattggtttgtattttataaacagacctgagtggaccatagttgatcatgcctgtgcggcatattcatatgtatccgtgccactttatgatactctaggtatgcactcatcacataatgatcatctatctccttttcatttatctagcaacaagttttatgtattgtttatacaggtccagatgcagttcagttcattgttaaccatgcgacagtacaagctattttctgtgtgcctcaaacactaagcactgtgagctttaacccttatctcaaccttgtatagttactagtctatacaatcattaaaagtcgcagttttcatgtcactgctcatactggtccttaacttagtgatgctgggaactagctagttatttccagaaaacagatctgtgctttcaggtgctgatctcatcctgcaaaaactgcatgcacatcaaatactgtttttttgggaccatatccacatgcacacaaccaatgggctgagtgctgggctggggcctgatcatgaaatacattctatgtggattctgatcctatttccattttcttatttcaaacactacatcaattttggtaacactgcctagcatttaatcttgaattttatcatggtatattctatggaacgaagtgtacttatgttctgcttatgtgtaactatttattgcagctactaagctttataactcaaatgccgtgtgttcgccttatagtggtaagttcaaaccatttatagttagtatattcaatgaacggccatgattgtttaagattctctctttttctttttttttaaaaaaaacttgtttaatataggtaattggtggagacaatgcaaatatgccatctaccccaacagctactggagtggaaattataacttactccagactacttagccaggtgagtttgctaaatggcccttaagtttactaacactacttcttgcttatggtatttgttctctttttcataaaaaaaaagtatctgttatctaatgtcagtcaaccaactggcatttaaacttgttaaaaaaacactttacatgcatacctgtagtccttgagaaccacatatctagttccaaagttgtatgggcatatggttcaatatttatatgaaatctcttgggatacgaattacttggctgcactcttgcactgattaatttagtactgtttccaaaagatttatccatggcaaacaaagttgatgtgacatcttgtttccacttccattagaaaacacgtttgttatgcaattatatttatgtatgtatgagacacgttgatattttggggtgaaaactgggaacatgaatattggatatccagttgacagctgtaatgcacgtatgcatacgttagctctctaattccatttcatattttcatgtatagtaaacttgaaagctaaatgacaatcttacataataacaaattgtagggctaccacatggagtaaacattacataataacaaattgtagggctaccacatggagtaaacatctttttttcctttcaaattgttataaaaccggccccgaaatcacatcggaaaccaatccgcggaagaaaacgccataggagatccaaacacgatgatgacaccgaggcatgatatttgataacggagttcagccgaggcctacatctccggggcactgattacgggtgctcctccccgatctagcatatacagcgtatcagagttacaacgactcacggccggtagccgccggcagccgctccctctcgctatgctaagtcgccatgcgggtacaacaggcacgccctctatttatgagagatcctaggata

SEQ ID NO: 56120 - DNA, 1464 bp, Oryza sativa
gtttgtgtaaataataaaaccagtagaataatggggtttctgagttctgacctagcaaaggtaaatatgaataaccggggacaaatgaattaaaccactcggaaaagtaatttctaatgttagttctgccacaagttacccctagatataggagcagaattgaatcacctagtgcaatatttcaaactgttatatgacaatcattcagaggttaattgaacacaacagatgcattttatgctggacctttcacctacaaggctacaagataatattctgataatcccattgtactatttgttatggcctcatcatcttaatggatgcattatgttggctcatgctagttcacttcagctctatgttgctcatcatcatcctttcctcaccatcgtaccatcatattgtaaacctattgctggatttccttgcacacagcaagcaattagatccatatagggttatatcttatgtgtttgccagtagcaataactttgttcaacacttgacaaatatgcatttagatcaaatatccatcttacttactacatggattctttgccataataatcgtttacattcaatggattctttgccatatatctgatgtgtatattgttgttgtttctaggataatttgaagctgatggatgatctggctgcattgagaccaacagtatttcctagtgtgcctcggctatataatagaatttatgctgcgtaatccaactacacccgtaacttagatactttcatgttgggaaaaactatttctagtcatatcctttttgaggttagcattttttccccttttcagtacagctaagtggttagttgtttatcattttgtagaattacaaatgctgtcaaggagtctggagggttgaaagaaagattgtttcatgctgcatacaatgctaagaggcaagcgattattaatggtaagaacagctcattgatattaagtgtcttagttttgcaatgacttctcatttaaaaacagttcctacatgctttctgtgacttatgtcatatcccatttttttgggaaaattggaaccatgccacttttttatccactacatctacatgtatgaaatgttaattctacattttgggttattagggagaaatccgtccccaatgtgggacaggttggtatttaacaaaataaaagctaggcttggtggacgtgtgaggcttatgacttcaggcgcttctccattgtcagctgatgtaatggaattcctaagaatgtaagctgtcttcatatatgcccttggggtagcacgattattatttagaacttggattaactaatatactactgttttaattttttaacagatgttttggtggtgaagtactcgaaggatatggaatgacagagacatcatgtatcatctctgcaatgaatattggtgataggttaattggtcatgtcggatctccaaatccatcttg

SEQ ID NO: 56121 - DNA, 13369 bp, Oryza sativa
  unsure (1)..(13369): unsure at all n locations
agatggccttgtgcctttgtttcattatatagagaaaaaatgtatatctgatcaatctacacttttaccttcgctgcagtttcgtaatgatacctaaattagtcagttgctaaattaaattgttaagatgcatacttgaaatcttaagttagcttgtactattttcttctcagtgtattgtttgttagctgagatttgcatggttggtgataaaactctaatatgtgaaagttcaatgctatttggtctaacttgtagaatttgctgtcatttgtaattttgaatacataccatattactaagatggtagggatatctaataacaacttggtaagttcaaaactactgtgctaaaagactaaagtgaaagcaagatgttaaaccttcttagctattgatcaaagagcaaaccaaaactatcttacccactgttattgtagcagacagcacatggtagccttcaactaggaaggttgtaacacatggatgtttttgagaaatgaccacaaccctattgtgaaatacttttgtctctaattacttattatcctctttccacacattttcttaggtaatttaagcccctggaactgtatttgatctgattagttttcttattaaataaattattaattgattgtgttttaatggtctcaaggaaaaagaacattttcaagttagctcaaggagaatacatagctcccgagaagattgagaatgtctatgctaagtgcaagtttattgcgcagtcctttatatatgtaatattcatgtccttatactggttataactaccaataatttgccatatatgttctaagctgttgattcggatgcaggtgatagtttaaactcttctttggttgccgtagtagcagttgaaccagatgtgttgaacgcttgggctgcatctgagggaatccaggtaaatatgctgaccttagagagtagatattctgcaactgcacaactggtttctccaaactagcggaacattatattcttcttgcacctctttgccagttcactacacaaattatgtctctctttgtcaaaaaaaaataaataaataaaaacagaacacccacaaataaaactccttacatcttcgttggctacttatgttatgtcctttctaacctgtagcacgaggatttaagacagctttgtgctgatccgaaagcaagatctgctgtcctggctgagatggactctattggaaaggaagcacaggtttacttctcacttctcataaccttgcatgctcttaataagttatgaatcatgtgtatgattcccttattaatctctctttccttgctgcaccagctaagaggttttgaatttgccaaagctgttacccttgttgctgaacctttcacattagaaaatggtctcctcaccccaactttcaaggtaggcccgttaatacaagttggaggagatttctacaccaggtactaattctctatctcaatgacttttgcaggtcaaaagaccgcaagctaaggcatactttgcaaaagaaatcgcagatatgtatgcacaactgcgccaagcagaacagataaaacctaagctgtaactacccgagtgacaatcggagtaaaagttctagcaacaaactacaaatgactggcttggtatagtgaaggcaactgtgaatgaactctgttggatatgtccacgaatgcttgataatcatctaataggatgatcaggtaaaagaatagcctgttttatgtacatctgtaagatgaaatgaaaaaagatgtagacatgttaaatgtcatatatatgaatccattgaatttcacctgactatcataggaatataaggtaaaactttccctcttaatcctgctgtgaggcattctgccaaccacttgccaagcaatattcatatggaatggatctattgaatttcacctgactatcatatcaatagaaactatggaattgtttccctcttatattacatgtcttgatccttctgtgagaccgaggcattttgtcaggcaatatacttgcacagctgttatattagagcaggtttctctggatgaaggcacatttcgcatgaaagcaaataatcgacagctgtttattggttagcgtggagctaaccatcacgcatcctcctgcgcagacgtggtgtttcatagactgttataccaaagctttaaactgatagtggtctgttattctttctgccatatttttttttaaaaaatatattcactttccaattgtacaggtcactgaaattattgttagtttaaaatgcaatggtaccttttattcccctctcaagaactaaacatgtctgcaataataaattaacattattcacctcccgattttatatgtcaattcaaattatggttagtttaagatgaaataccttatacaggtgccctttcatggacacaacaagactaaaataaattagtaaacaaatatcattgctaatcagtttggttaggggaagacgctacttagattcagtactagatttagatagttgttcacgggaaaaaaaaacaaaaaacaaaaaacaaaacaaaagtagaagataaacaggatgatcccttctcacaaataacaacaaagttcatacaaaaatttaaagttagaagataaacgagacggccatttctctactactgtaaaaacgaaattctccctccctatcatcttacttcccttgacgtcattagataaaaacgaaccgttggatgataactgtggcaaattattcactgttggattgcatatatgttatttaaggctctagatatgtggaaagtagtactgtattagttcagtcaacatgcatgtaaaaaattaaataaaaaatggaataatccagaaatttgtggagcccttgggaaggggaacaatccaatatattaatactcaattaatactgaataagggcatgtttagttcacgttaaaattgaaattttagttgaaattggaacgatgtgacggaaaagttagaagtttgtgtgtgtaggaaagtttcgatgtgatggaaaaaattggaagtttgaagaaaaaatttggaagggctaagaaaggagcgtttcagtttcccatgcaactgagtcctctctacacaagcacccagtacggctttagctgaaacctttgcacttccatttcaaccttcacaaatcacaaacaccccaaacccagctttcatcgttttcatcttatccaaattgactgcatctggagacctggtcgaagcttgctgacgtacggcgccggatacaagctccctccgcctctttgaggccatgtaatgaggtactacctcccctccgcttccctctcctccatttcctgcatctcaatctgaggtcgcatccacctgctgcaacgagacggagagcgcttcgctggtattatcatatcatgtttatgtcgtgtttgtgttatctggggaggtcagaattgagatgttgggtttcattttcttattagacaggatatacttttgacagggcggcgcgcctgattttctagtttctctactactgtaaaaacgaaattctccctccccatcatcttacttcccttaacaaacaatagtgtttccatgtgaaaattaacccatcaagaaaacagattagataagactgaacctcataaaaccacgtaccgatcgcttaaaagactctagtgaccattagcactcttcagagcaagaataataatacagccagctgcttacttatagcctatctatcatctcactcatataatggttaactcttcactataaatatatggtctacctatctgtctcacagattttattggttcttgtgcctaagccggctgtaaacttatagctcgcttctcatctctctcctctcctctctcatccacatcagcattcagccttcttatagccctctattatacttgctctcaggacactgcacacccgttggcgttgtgctctcttattctgttggagcccatcttactatgtgtcatcaaagaacggcaattcgtcattaatatgtctcatcaccatcatcacttcccatgcattcttgtataagctcatcacaacctatctcttgatcttccaagacggccggggttgccataaattaatcaatatatagtctattaatccgtcctccaatcctccgaacaaatgcaccaccattatcttaatccaacccattgacagcgagatgtttgtgataacttcatcaatatcaatatcaagatataccggtccactattccaaaggtgtttatagagatagaatgtgcatgtatattcatagggataagtgtgcgtgtattatgagcgtctatatttgtaccgcgtttctaaaaaaaaattatcttgatcgtaccacttatacgaaggatgatcctccatgtttccattttgtagcatattgtctgtttgatactgatgagcataaccctcaatatttccatgtggcaagatatagtcaggatggacagtatatgacgttagtctagatcatctccaaatgcatgcaacgctgctattaatattctcggcttgctggtaatggagattctccgtgtaggctggctgtgtgatcgtcatcaattgatcagcagagtaccgtggctgctggtcctggttgcaccacacggcagggccctgtctgggctgcagcttgcactactagctacgctgtcgtcgttgagctgagaaatgcttggtgtgtttgcatgttgttcttcgtcaaacatcatctgcatataatggggatcaagttgacaaagtgtctccaatatgttattgaatgctcttcctgcccttgggaggtagccgcttcctgccttccttccccttgctcttgcatttgctgccgctcttcgcctcttttccggccttcttttgatcaaccttgtgggtatgcttcaacaccatcggagccaaaatggcatataaacaaaaagtaatttatgaataaaacttggtatatacgtgttgttagcgatctagtttgtagaaaatatagaagtattttcgatacaaaacaaacatacttctaaaatatattcatccagctctgctaggctggatgaaacggcccaatactgctccctcccgcagaaggcccaatagaaagacaagcccaagcagtttccagaaggcccaagtagcccaccgtcgcagccggagcaaccgcactgttcacacacgcaacggcgcaacacaaccacttcgtcgtcttcctctgctgcttccttctcctccaagcccccgctccgctccgacgacctcgccgcctccgcctacaggtgaggaggtttttctccgccgcggcggacgcctccgctcgccgttctcgcttgggtttttgggtgattctggttgggttctcccctgatcgcacatttcgacgcaggtgggcagatggcgccgtccaagcagtacagcgaaggcgggcagctccagctcatggacgccgagaggatcgaggaggaggaggagtgcttcgagtccatcgacaagcgtacgccctccgcctcatctccatcccttcctccccctgtctcgtatcccgcactgcattgcttggcgcgcctgctcgtgtgcgttcgtgtgtgttcgcgtgtgttcgcgcgtgcgagtggcagtgctcgttctgcctcgcctttcaattagtcgctgttcgacttgtagttcgatgcttgattcgcggtgaagtaaacgagatttagcattagtacgtttccactttttttttgttggtttcgattctgcttgcgagcagcgtctggatgctttgtgatgtgcgtgttgggttgcttctagttttccccccaatttcgtgcgttctggacataaattagcctcgtctcgtgacgaatttgttctggaattttcgccgctccacaattgatctctgtttttgggctatttcctgctgatcggtgtgtggatcgccacatcgcttgctatgagaggatcgattagaatttatccccatttttagtcaaatttacacgcgttttgcattaacccgtcaaaatgatcgctggaactcgtcggaattctccaccggctagtttaaacatttgcattttctgcatattagttgaatcagttgtgtgttttggtgcacttggagtgcatttagttgaaccagttgtgtatgggtgcacttggaggtttagggattaagcttgagttcctcttgcactttacgttttctggtggctccctaactctagcgagttcaattttagtaagttgtttggtgtgatcctgacatttgcctgtgtttcatgcttcatttggttcttcctgcaaattattcattgccgtgaattcaaactaatgagcatagttcctgcattactgttcatctctggtgcacttgtctacagtaatctcgcaagggataaactctggagatgtgaagaagctgcaggatgctggtatctacacttgcaatggcctcatgatgcatacaaagaaggttgtgaactcgggatcccaaaccttcatgccatctcctgcttgttccatttctggtttatgacacccatcttctttcgtttgttctatttctttcttacagtatgcttatctgatattgtttcaatatatggattcatcttgtagagcctgacaggaatcaagggattatctgaagcaaaggtagacaagatctgcgaagcagccgaaaaacttctggtgtggttctcttttcattattaaagtctgaaagcttcactgtcaattctgtgtgatacattcttctgaaattgctatatttgtttttctcagagtcagggcttcataacaggaagtgatctccttattaaggtaaggaaataggagctaatctgcatacagcatactagtgtacaggatatggtgttatagcaaactaagtggaaactattccttgcttcatggatgctctagagcttttagttactccagctgtgcacttccctgggctgtttggtttattctttttcttcttttgaagcggaaatctgttgttcgaatcaccactgggagccaggcgcttgacaagctgcttggcggtagcatatatagtcctctgattatgttatgatcagttgttgcattatgttgttctaatctattttcattcttcaaattttcaaggagggattgaaacactttgcatcacagaggcatttggagaatttcggtgcgtagacgttcttgttccttttgattctttttcctggattacaactgcagattggttgtaccaatggaatgtggccatatctgtctaatagatatggtgaaaatctagcttagcaatatgtttagtattctggttgaagttaatttgctaaggctgttgtgctcccatttttatcatttattcatgccagtatatacagtaaattcctaaatatgtttgtattctgctaacactgagaacttaatactcctcatgtgtaaacttcaggcatatacacatcaatattgtctgaaactgttttctttgatgttaatactaaattggttctactaaacattaaatttagctgagataatcttgttttgcgacaaagttgatgtattatagaatgattccttgaattgcagcttggaacaatttggctttgtgtagcacataaataaaacatcttactatttaatgtgaaccagccaaactttgacccttgatgtactttgatttaacgttcatcattcgtcaatttggttccagcttcttagctttgtaatttgtaatctgtcatctttatttttggtcctcagatcagggaagacccagttggctcacactctatgcgtctccgctcaggttcatttccgacacatttttgtcatcaacaccttactaccatagatccaatgaataattttatttattttttgtttgtgaactgcagcttccaatccacatgcatggggggaacgggaaggttgcttacattgatactgagggaacattgtatcttttgaatttactgagtaataactcagctgattcactcaatggatttatttgcatttccatatcgccccaacttgtttccttaatggaattttcagccggcctgaacgaattgtgccgattgctgagagatttgggatggatgccaatgctgttcttgataatgtatggctcttaatttgtctttaccatttcaggcctaacagatgaagctgtatgttatatttccatttatttcttgtttagatcatatatgctcgtgcatacacctatgagcaccagtacaaccttctccttggccttgccgctaagatggctgaagagcctttcaggcttctggtaggcatggctccataacataaaagaacattgataaatttgtgtatctcagttacttatgtggttgttttacctgagtagattgtggattctgtgatcgcactattccgtgtcgatttcagtggcaggggtgaacttgcagagcgccaggtattgtcaatatttgtgttggtagaaacaaaaaaaaatcataaagtagttgaaggcctaaagttatgtactaattactctgaacttgcagcaaaaattggcacagatgctctcccgccttactaaaatagctgaggagttcaatgttgcagtgtacatcaccaaccaaggtgagctttcaggactatcctgtatatcccaagaaagagtaacaccataagggatttcaaattacaagtgtcctccttgtttcagtgattgccgacccaggtggtggaatgttcataactgacctgaaaaaaccagcgggaggccacgtgctggcgcatgcagctaccatccggttgatgctgaggaaaggcaaaggagagcagcgtgtctgcaagatctttgatgcccctaacctgcctgagggagaagctatatccttttgtattatacatatacatgtttaccaaaacttcttgtgcaattggtaacttcggttcagtaggttgctaaaatattgattggtttttctttctttgttcagacttgctcctcaaactcttgtgatttagttaattgcagatgctgttttcggtgactggaagtccaaaagctttgcataacagattattaatggtgtggtgtaaaatagttgcttcccttgaccaataacacgttttccaggtaacatcaggtggaataatggatgcgaaagactgaatgttcattgagggtgcttcctgtcttcaaattattcaggtttctcctagtaaattcctgcataggccatataggtttggtacattgactaaactactactgctactttgccactgtcgaggaaatatgcaacctcatttatccagacgattataccttaaaatgggtatttttctatgcttatgagatcaacagttgtactgaaacaaatacagtattgtcttaagtgaaaaatatataagaggtttacatgatggtaactttccccagaaactaaattctttatacccgcgtgtgcacaatttatacaatctgacttattctgctgtatcagctataaggtccttaattatttgatcaaaccccaaacaattattttttgcggcttatcctgggatttttccttcaaggacgtggtctaatctctctatactccagttcttcagtcccccaatctgcaatcttcagttaaaccacaaaagaatcccagcatgtgcgacaagcattttctcgttagaagagactccagttatcttttagcatgcacttcttcaattggacagaacaaggatcattagcataatcggcatagttgcagctaagctaacaacaaagagagttggaatgaacatgccattgtacttgtagtttgatattcggtagaggagatacataacatgcttccaattgaaaagtactactcgatcttggaatagatcgatagagaaacatgcttctagctttagctttacattgatgggacgataaaacatcgtctcagtctgtacaacacaactcttggaacagacaaatcaccaatctgcctaatgcagaggatatttaggtgaacagaggaacaaaatacagccttttggccggttcatcagctggttgctcctagctccgggcacccaagcttgtcgtcatcctcctgctgtagtgctgtgtgggtagagcgcggcggcagagagggcagatgcagctgagccggagccagtcgaagatgcagcgctggtggaaggtgtgggagcacggcatcatcctcagcttctcctccgccacgaaatcctgcaagcaaacggcgcactcctcctccctcgcgccggccgccgtcacctcacgcaggccttggatggccttgctcagctcgcctgtaggacgcagccgcctcgtcggagatctgtggcgtggggtgattgatctcctcctcgttgccagatgacattgatgaatacacgtcttcggatgatgatacgtaagcttccggcggcggcggcggattttgttccaccctcaggggaagcctccggtcgccaataaccaggtggctatagataagattcccctgctcatcgaagaggggggccattgcgatagtatacttctgtatggatattcatctctccggccaggagcacgacggcggcgacgcgatcgacgacggagatgatgaaacgagtcggcggaaggaagaggaggctgccaaacctccgactcggatcctggtatgatggaggcgcatacaaatgagggggcaccgggcgctgttttagcacttagcgaaagaatgttctttaaaaaaaaacacggtaagattactagatgaaacaatttggtttaacttacacaacaaaacgatttaagtcattgaaacacataaaatccgtgtacatcaaaacaaaccccgtatatatcaagtgaaataattaaacactatctaaaatccaccgtaacatttgattcacacacaaagaaacatcacgagcatattagttgaaacattgcttttgaaccattgaaacatcaacaaagctggtgaggcaaaaatagaaatatggaatactatcgaaatatccattggaacatttgatccaaacataaagaacatcacgagtacactagttgtcgaaacaagatttcggcaatactaaaaggggtggcaattaagctagaaaagtggatgggttatgagacacaaggtttatacaggttcaggtcttctcgatgagaagtaataccctactcctgtctggggattgatctgccgagtgtattattgatcgtatgatctgggagaaaagttacgctcataagagcactcggacccctccttatataggaggaggagccgagattacaacatacaatccatgttctttatggactaggcctttagagataaattacaatcataaccgactagaactatcggatgtttccttgatacacaagttaacattacaaccgagtcctttactacacatattctaaccgcataaagtatcccttataaccagtcagatatctatgccatgtgggtatgtagtacccataatctccacactagcggaaacacacaaaaaacacaaaacctagtctaaactgcatcttcctactctccgatgaacacagggttgctcgcatcggtcttctccaccacccccatcactggatctggagaaggcaggagagggggagggcagcggagatgaggagggagtgctcctgggagagagggggagccggcgagcctcctccaccaccactgccgccgccgccaccaccacctcgtcgggcgtgcgttgtcctccgcgtcggccgccaccacggggacaaagccaccgtcgacgttgaggaagacaaaaagcggcggcggatccgacggagaaggcgacgtaggcgaggtcgtgggggagaggaggtagcgtgggcaagggagctcgtgggagaggaggtggcgccgatgggggagaggaggcgacatgagtgagagaggcacggggagcccgagtgacaaggaatgagacgtgcgggcgcccgatatttttctctcatcaggcgcctgagtataaggatgcagtgcctagggggcactcggactggctgcctgagatcaagatggatggccgggcatgcgcaagcggtcgaaccccacgcctctactggcgattctccgccaccgagctagcagctcgttgagcctggtggcggcgatgccttgccctgttgcccgccgctcatcgagtctgcaggtggaatggaaagggtgacgtaggaacatgtgaatgcaggagtcccacttggggtcgctgatttcatgcccacgtggattgatagacgatctagattattggtttttacgtaatcctagtacaattctgcttgatatttcggcccactctcgtccatgcctagcgtctaaatctaaaagtagaaaaattctcatatcaatcgcataaaacaatgggcaaaattctgatcatcaccttcactgtactcgagtcgacgaccacgacgccaccattagcgcctctgcctgagttttgattctgcccctcccgttgccagtaccaccatgaaccacaaaattgggttccccatccttgtgctctccttggtttgtcccctcgctaccatcgacctgcaggcgattgggctaaaacaagtagacttgtcgggcttggaaggtgatgtgggggaagaggaaatgtggcgaacaataaaagagttgccgggggattgagctcttgcacccgatggttacactggtctcttctttcaaacctgatggggtataatcaaacaagacttgatgagggctttggacaagtttttccaaggaaactttcaaaatttggacatgcttaattcgacaatgattattcttctttctaagaaggaggcgcccggcccttttgaaggactaccacccgatcagtctaattcacagcttctccaagttggctacaaaggttatggtgactagactggcaggctaaatgggagagctcattccttacactcagtccgccttcataagaggacgttcaattcacgagaatttcatgtttgtgaagggcatggcgttgctctgtcacagggggcacaaaccgatggtgttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56122 - DNA, 8152 bp, Oryza sativa
accctaccaactgtcttgagaaaattgagttaggttcttcaagaaatttcagaaacaaatctttgtttgaacttacaaccctaagagcttcttgtaagtcctttgaatgaagcggcttctctgccatgccttagcatttttttccatgacacttcctcgcaaaatatccactctgttacttgtgttcccagaagaccctcctttctgcgaaattttgtcctgaaaatagctcatccgtgtttgtgcttcagatacttcatacacatcattatattgaactgcttcctgacaaaatgggtggatatcttgtgtcgttgactttatgagacgatgctgctcttgttgctttaagtctttgtttagtgcttttaactggttacatgattgacttttcctgaaaccacttttggcctggtgtaaaactggtccattagcaggtagatcctcctcaaggcccattaatcgggcaacgacacctgggggctttctctttaattccacttctttagtcatctcttttgctaataacacttttaatgaagttgcatttgattttctacgtgaagaaccatcacaggtgcctgcagagaaacccatattaataataaaaaaaagacaagaatcatcacaggaatgaaaaaaaatactagctggatcagcatagtttaatggcataagcatattgcactacatatagttttacacttcattttcatgtgccttttattctcaaaattatttctaccacatttcatatcaaaataaaattgtcacataggagtagaggagcctaagttaaccacacagaagaaaggtatgccacaggatgctcacaggttttctgtccgcatgaaatttgtcagagtcagtggctttctccaaatatgaatagatctgttggacaggacaacctgaaaggattaaaatttaaaattatgtatgttctgcaaatagcacaaaccttagagatatacccgaaaaaactaaagatccacaaaagcaaaatgaagcgagaaataaaaaggaatagcaaaactgccaaaacatctcattatcttggaagagcgtaagaataatacaatgttgtgtaatcccccccccccccccccccaaatagagaaaaatggcctttgatagagcaatactgcaaagtattggcccaatggccctagctaatatttccagatgcatagcatatccaatttcccacacataacataaaactaactagatgtagaacacattcaagaagtgccaaatttctgtttcaaaaaagagaaaatgaagaagaataagtcctgaagggcataataatttgatataatggcaagaaatattgaaatttatggaaaaccctcaaatccctctaataaaatacccacataaatatacataccatctccttgagtttgacccatagctggctttgctccagacatccctcaacaaattgattgccttctggcaataggtagctgcaactcaatcttctggagtatggaatcctgaaaatagtgacatcccatgaaccatgtgtgattttaattttccacaaactaaagccaagtgacctaacttaattacaggaaccatttcagatactagtgggtagtggctggcattgatgagcacggtgaatatatctgaaaagctctcagaatttaaagcacttagggtttgtacttaggggacatgattctgagatattgctgtagcaagatgccctctttccacaaaatttcaagagacacatgcttaaaagctggaattctgcaggcacttgtaaggcagattggtgaaagaggtagcacagttcatggtctgttcttgtataaaatcacaagaaatgagaaatggcgagcagaacgataagattcgacggggacatggcagcacttggcaacatagaaaagaataaggcgggagaaaaaaggacaggataaaagcatatgagcagaaacaattacaaaaaaatatggacccatggcactaacaagatcgtacatacttccaaaaggaatcttgcagcaaaaacataatctctgaaagactgtattttctgtcagaaataaaaatcagttatgagaggtaggaaggcgtattttaccatgtctttagatcagacaaatgtgaaaacacgaaacagaacagaaaccgagcaagtacaaaatacccaggatttctactctacgtacaggcgacagaggaatctctgtagacatcgttccaaaggcttcagaatttatcaggaaaattcgtcagaatttcgaatcttgacagtggaagagaattagggggagggggggaggaaaaaaagactgtaaaaagtaaaggaggagatgtactccacgtagaatagaaaacaacaatgggtgaaactaccgagatgtttaggtttatacatgtccaaatgagcactgcaaccgagacaattcctcaggtctgtagtctttcgcaggttaaaaaacaccaaaatctaagcttggcttgctgagtgtaactagattccactgttacaaaaagaagtgcacaacactgaagtaattacaaaaaccagaacacgacattacaaccagagggtacaggaaagcatccaaagaatcttgcagataagagagacttcgaggtctggtgatctgcgctgtttttgttctattcctcactggaaatttacgaatttcatgaagagtttggaaatttgatcaaacaggtgtgatgtttatgccaaaccgacgaatgttcatcatgactagaccttgtataacagctggcattccattttatttatggtgcattttcttgactgacacaagttatccccaaatcgtatgtcggacacccctagaaaaattgcatttgccacttcccagatgacaatcaaatcaaatgtagcacacattgagtttccagtattgatatcacaaaccgaatacgggagaaaaaaaaaatgcacagcccaaacaatgcctaatcctgcataccaaagctccaccaaatgaaacagaatgctggcattttccatccagcacaacccaaatccaaccaggcacatcacatcacatcccatcccatgggaatcccggcacaagaaaggcccgaagttaagtgagcctgtgatccagagagagagagagaatcgctagtatgcacacctggggtgatgcggcagcggagcattcttggccgccgccggcggccggggaggggagggagcagcttggcttgcgcggcggaggcggcggcggcggtgggttttgggagggggtaagcaacggagcggaggagacagtgaagcagagtggagtagagtggagagtgtgggactagtgggatatgcggaaaaagcctttgcgagccgtttgtttgccgttcttttcttcgcgggggcggggcgttcgcttgtttgttgcttgtgcagctgtgcttctggcccgtggcgcgtcgtgggctgcgtacgtgcgcgcgcgcgccatggatcgccttaactaacaaaaaccagaagttggtggtcactgggattggatcgaaggatattctcgtgcgttcttactgggattggatcgaaggatattctcgtgcgttctttttccttcattttttgtgtgaagactttttattactccctccatctactttcgatctactttcgaatgtcatatttatcttgacacataaatcaaagataagtaattctatttatcatccatttaaacatgctactagttatttctcgtaaacaagcgattcattaatatttacatttctcgatgccatgtagccaatcttgtgtggaaaaatggagagtcacgcatcaaatccgaaaaagtcattaagagaataggttgttggattgaaatatgtctatcaaaaataaatttttcagatttggaaatatgcatatcaaaaatagattaagggagtagctgctatgtcattctctttttattaactgctatgtcattctttttgtgaaacattaactagactactactctctccgtcctataatataagggattttggtatgtattacactgtttgatcactcgtcttattcaaaaaatttgtgcaaatataaaaaaaatgaaaagttgtgcttaaagtattttggataataaagtaaatcaaaataaataaataataatcctaaaatttttttaaagaagatgaatagtcaaacagtgtaagcaaaatgttaaaatcccttgtattagagaacgaatggagtatgttcttaagtacatgtgtttccaaattaaggtgattttttttcttaaaagacatgatccattagtctcaataaatgtgtgatatagtaccagtgatgaaaccaacaacatttttatcaggactacgtagaaaagcctaagcaaccgtccactggatggagatgtcgctctataacgtatcgttatttttatttaaacacggtacatatgcttatatatacatgcgcactcccttctataaatattagtatctactcgtatattatatcgcttataaattttttgaaaatgtaccagtattttctaaaatttatgaagttatcacatacaactcactattgacaattatgttatctatcacaaacaaaagagataatcataaatataaatataaggaccatatcaaatgcaggactgaaattagcgccaatggaagagaaattacacaacacgacataattagtggcatgagagtaattgtaagaaactgtcggtgtataaaagttcggcgacggtgcatacgctagaaaggaaagcacagcattcgctcgagggagaaaaaaaaaagtaaagccaaggcgttcgtgcattagccttttctacaacaacagtatcaatataataaaaactttgtactacaagtgctatttacaaacagaactaatttgtccttactttaagcaaagggaataaacagacgagcaaaacgtaaccgcgcgccattcttcccacaagaagatcaaccagacaaccaccacacggccacaagcccacaagcccaccccaccccacgcctcggcggctcggcgctcacgagtcacacgacccgcgaacacctctgccacctatccgtttccatccagttaggcaccgtcccttaacatttgtcgctgcgcacgccgcgccacgccacggtccaacacacgacgccacctgctgcccgcgcaacagatgccccccgcccccggcccccctctccgcgcaggcgcggctaggcggctagctatagcggcgcatgccccgcgcgcgcgcacagtggatcaaacagtacgcgcacagtgcacgcagcgcccgtcatccacagccacaccgtccgcaccgcgcgccccgctcactcggccgctaaacccaaaaccctccccaccaaccgccaccgccacggctaccaccagcagcagtagcaggcgcggcagagcagaggaaggcatatccgcgcgcgcgaatgttgcctcccgctacgcgacgtcgcgccgggccggacgatgagacggagcagagcagcgcgagtgcgcgacgcgagccatgaccaacggcaggcgacgccgcttccactgtcgcggcatctgcgtgcatcagcgatgcccggccggctgcccgccggtcacatggctataagcatcgaatcgtagcgtagcctcttctctttttttttctttttctctgcgcgcggcagggcagggcagaggcaggcgctttcccggctggctggacccgtgcctttcgggaattaatgaggaggggtcaagatcaaatcgcgagtttttttaaaataccgctgcctacctgtaggctgcggaccgtgcaccagtgcatgtcagatacgtacgtacgtattcaggtccagccgagccagagccagccagccatatgcacagcgccacaggattttattccgaacaaattgtatgagaacatgtacatgacgcgtcagcccaagccagtgtcaggactcaggacgagctgggacgagtaggcgggcgcgaacatgaaaacggctgtttgttccgttgtgcagcaggcgacgtagagggagagggaataatcgtatgatcgtcgttgcgaaatcgtgcgatgcagcgggggagaagagaaggcggtttatgtgtacaacagtggcgcgtgttaggatagtggacaaacgatcaccaggggaaaaaaaaaaactagcaccgtgacacctgaagatgccggcgatcgatgctgatggtgatgggacgcgcggaaccgaagctagctagtccaccgctgccatgatgacgatgggggaggagaacattgatgtgcagcttgatggtgagctaccacaagttctatatagttcaatgttatggcagtaagatggaaacgtgttgtgtttttttcgtgtcatacactggtgcggttacttgtttaggttctcgattgaatgaatctaccaagcatgccaagcaggcaaggtacatccgtacgcatcaggaaataaaggccatttcctaatcactttgtcaatttttttggcataaacctttacataaaccaagtgaatgattattttttggcattgccaattgttttggcttgggtaagtttgggtctgtttggggaagcttttagattctgagaagcagctgtttggtagccagcttctgagaatctggaagagctctgaaacccagcttcttagtttatttttcagaatctgtaactacagattcttagaagctgtggactgtttggggtagcttctagtagaagcagctttttgggaaaagctatagttgggacaagctcccccaaacagggcctttggcacaaaccaaccaagtccaaaattccatgcaaagagcatgaaagtccaaagaatatgtttggtttgctatcagggtttacgattccgacgaaatccaatcggattaagcgaaatttcgacgttccgacgaggcttgaaagtagaaactgtttgagatttcgagaagttttatccaaattcaaatataaattgataaaaaagaaaaaatcaaataaaatcttataaatactatgatattcatagaacctattgggatataatttttttaaaaaaatgatgtattgtgtgtatttactgaaattttcatcatgaaaaaaaaagaatttcaggaaattacctctattacaaattactgatcaaaatttcgatgatttcggttagaatttcgccaaaaccaaccggtttttgagaacttgtcggcaacttagggaatttgtatttaaattttggtttatgaaatttgttcggaatttaccggttttccaccggatttcgcgaaatttcgaattccgccagtgcccgaaacggaagagcatgtaggaattgtaaaccctgtttgctatcttcttgggagcattcaattgaccatttttgacatttctaacaacatgttcatagtcataaaacaaaagcagcatgttcattggattttattatacatttataccacgtaccaactccaaaataagaacttcaatgcgccttcactgaggcaaggtgcacgcacggcagttattgcaagatcattctgtcatgagcatgtcaattattgcaacatcgttttgtcacgtagggaggccaccggagagataaaattaactagcattgggatcgaaggcaatcaattgctggacctgttttttttatggccaggagcaccattccatcgatctccctgcccaactcggcaactctacggcaattcgcagtacagttgcagggtcagggaagcatatgaggctacatgaatctacacattttttttcctctccgatttagcgtccagtttgggagtaaaaacgatatgagtagtggagcttctgcggtaaccgctacaggtcagttgattccatgggtgaaaactggaaaggtaaaaacttgtcccaccacgttgccagttgcatttcatgttgtcccactagttatgatcagtttcactataagtttactatatcggcaatatttctttcttggagctgagattgattcttgggttgttatctcactctatcctttgttatctttagtgctagttcaaaattccttctctccctttttttttcctgaatgaacgtaatagctcaagtaccaagcatcttgacaactccttgcatgtaaaaagcatctcaagaaa

SEQ ID NO: 56123 - DNA, 1854 bp, Oryza sativa
atttcgaaggagtatttggagggattatgaatttatgataatacaaggaactcaaaggatggaaggtcacttatattttttttattcgaggttatgtttggatcatgaatgaatttgaataattttgaatcgacggagaactaaggatttcaaaggaggatttgatttcgaactccaatagtatgtttgggaagggttctcggggattaatgttcattacaaggatcggtttaattgagatctctggcattagatactaaatacacgcaaagaaccaatttttttcgaacaaaggattttattaaaatagttttttaatggttacacggaaattgggatgttgcaattttttaaaccatcaccttcctaaaaaagcaaatatgatacgatatcctgattactcacgggtgaaatgttacaataatatctgtacgcttgcggatttatctgtgatcgtaataaatacaaacaataaatctcgcagtctgcctcggtgagtctgcctcggtgagctagagcaaacgtttgttaatgggaagaacaactaaacaaacattgattagcccttttccgaactccgcaagatgcatgaatcatgacgcgaaaaatcgacggctcactgacgaatccaaaaatatcctgcggctgcgaaatagcaatgttatatatgtttatgttatttttcagcgagcaagattagcaattgccaaaggctagccaatattacaattttaattttttttctagaaaaaacacatcaatgacgggttacaaatatacgctaccatgggtaagcctccctggtgatggattgcaactcaagtacatcgccgataagcatccgtgatcactactacaaaaatgattttcgcaagcaaagccagtgaagattttcgctggcagtgcgatccaagtgcgaaaatcgattttcacaggtggacccttaagagaaccgtttgcaaaaattaattttatcaggtgtacccataagaggaccaccagcaaaaaaaaaatgccaaaaaaattaatcaacatccagaccgccagcaaaaagatttttttttgtcaaaaaattaatcaacatccagagctacaatttcaaatccaatccaatccaaattcaatcaattcaaatccacatcagatccatactcaaacccacctctagagaacaccacatcaatttttcactccatttcaacaagcaaacgtcaatacatgcagcagatgaaaccgtcgaccatcgccctgccaattgttaccgtcaccctgccgattgttatcgtcgtagcgctgccgtgctggtagttgtcagtggagtgggagagggaggacttagctggatttgcgccctaggtcaccgcccgccaccgaatcaaccacctacgcctcgagatgggaggacttagctggatttgcgccctagatcaccgccttccaccggatcaaccgcctgcgccccgagctccaccgcccacgcccgaacccgccacccgtgcccgaaactactgccgacggctggatctgtgggccgtgcccggagcaaccgccacgcacaacccgagccgccacccatgccccaaggtgtcgccggccgaatccatggcctacaaccgagccgccgcatgtgccccgagctgcgtcgcaggatccgtcgccacgctccaagctgctgccggccggatccatcgctcgtgcggccgcgcctcgagctccgccgccggccaaatcctgttagataatgtagtgtgcgtgtgtaatcttatcatgtaatcctgagttggtttggtgcggctgaggaggagtagttagctgtaactaatcattagttgttgtatcttatctagattacat

SEQ ID NO: 56124 - DNA, 18397 bp, Oryza sativa
cgaagacgacggcaaaccctgcatatgaatcctggctggccacagaccagcaggttcttgggtacctgttctcctccttatccaaggaggtgatgacacaagttgctgcatcaaggaatgcagcgcaggcctggagggccattgaggagatgttttcttctcagacacgagcgcgcgccatcaacgtgcgactcgcacttaccacaatgcagaaaggtacgtcttccattgcggaatactttgggaagatgaagagcttaggagatgaatttgctgcctctggaaaaccactggacgatgatgatatggtcgcctacatagtaaatgggttagatgaagattacaattcagttgtctctgctcttgttactaggatagaaccaattactgtttctgagttgtatgcccagcttttaaactttgaaagtagattggaactccaacgtgtaagatcaacgtgtgttttgattcttattctgtgatgaacaattggcatctgtgattattggttttgatatttggagattattgtcgaagtggttttggagataatcaattttcaggtgatgatcggatttgctgttattttatgtggtccggtccgaccgggcggaggttgccggtgtcacgcccggaatttctatccaaaattccaaacgcttacatgtgtgtgaaccctcgtccaggaatcagccgaggcacacaataacaaattgataatagagtacaattattactctaattaataaacgtataaaatgtcattacagaggtagatagttcctctcaatcaataaagatctaagcagcggaaaataaaataaacggcacggacggctctactccacaggcaacttgaccaaggctacacctaatcctccactccatcagcttcactgtagaactcttcctctgatgaatgattgcaaggtgagtatatgacatactcagcaagccacgcagcaaatatgcaagtgcacaggataacaaaggatggcataatagggttccatttgcaaaaacagcatttagcaaacatttgagaattttaataaaacagttgagtaatagttaaacaatattaatccaacgctatacaacataccctgttgtataggcccaaccatactgaacaaccatcccggctgcacagttctatctccaaaccaggaatataccattccaaaccaggagctaaacaaattattaccagttatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgtacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgattaatgtttcacaaccgaaactcgtgaaccggtccttaattgtcatgagcacgaccatcaaaaccatgtgctcacaacccaccattaccaggttttagttggcacattaattaattaactaatcacgattaaccatcgtgaactatcaataaaccatcatgaaataatagtgagtcattagttatcccataagtgtgctaatgtttctaaacagggctaagcaattatatctaatatctagttgaaccaatataaataaagctcaactagtcaaattattataacccaaggtatcaaggaataaggtaatcaagaacaaaagggctataacaaacaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccgacgaaaacggactctccggaaacgacggaatctaagcagaaaagagcaaaatcaccaaaacagcacataaacaagcatgaacaatatatgtggatatttttaatgtgtagatctcaattttagaaaaatttagagacttgaaccaactaaatcggagctaagatgaattagttatgaatttttaaagattaaaccggattaaaacacttatatcggtttaaattgaattatgacgcaataatgaattatttttgaaaaggaaaagatggtttattgcgtcagcgggctagggtttcggtggaccgggcgcacgggcggcggttcacgcgaacggacggccgagattgatccaaaccaaaacggacggccgagatcgatcgggtccacggcggttcacgggagacgactccgatgacgtcagcgatgacgtcaccgacagcggcggcggctcggcggaggagacggctcgaacggcgcacgctcgccggcgaacggcggcactaggacgcaaacggagggcaccagcacgtagaggacgacgcggcgaactcaccggtgaccacaacggcggcggaggaggaacggacgacgacggcgacgaggaggaagcggcggcaaccttcgggtcgacggtgacggcgatgctccggcggtcttcggcggtggcgaagcagcggacgaggacggcgacgacttggcgagcacgacggtggtcttcccgagcgacggcgacggctgaaacgacggcggcgcacggctggagcggcggcggcgacggcaaagctagggcacacggcgctagaacgattccgacgacgagaggcgaaggcgagggtggcggcgggtagaggagacaccgggggtccttttaaaggggctcggaggcggcggcaaaggcccacggcgacggcaacggcgaaggaaacctcggcttggagagagggaaaccgatccgaatcgacctcgaatcaaactcattccagaccgatttagccgaagattccaaaggagaaaaggtagaggagatcccggagattgtttcccctcaaacaattcggccggagaaggaaagggacggccggatttggaaggaaacggcggcggcggcgcgctagggtttcgggcggcggcggccgaaggttgacgaagggcctgacaggtcggacccacctgtcagcgaccgaacgcgcgcgcgcgcggctgcggactgggccggactgggccgaggagagagagcggttttgggccgactttcggcccaaagccaaaagagactttttaaaacctttttcaatttaaattatttcttaaatgcaattccatttattaaaaatacttccttagctcaaataaatcccagaaaaatctaggaaatatagaattaagcaaagtatttaatgaaattttatctggccccattttatattggaatttattaattaaaattagatcttcttttcaagacttttaaaattatttctaaaaattccaattaaacaacaatttataaattttgaattttcagggtgtgacagccggtcagaccggcttgtgttgagcggtcagaccggccggcccgcggtctgaccggccgatgctgtatcggttttggtttcgggttgtttctttggatatccgtgattgtttcatggttatggcttctagatggatactatacgtatgtaatactgttgtttgctaacaatgagtcaagttggagatagcttggtctcggaatatggtttctttgtttgtttcatgtgtaggtgactcgatgcctcgggagagtatttgcggtgatggaccgggagtcggcttggtggtaagacgatgtccgtggtggtcagatatcatgcgggatactaaggctagagttgatgcacgtggttgatggagattccatatggcatacgatggaggtattgtgtgcgtatgggatgcggagtcgaatttggaaggagtccaaatttggtacgattggttatgtaaagtttctttcttgtactagaaggtttcctaaggtgtttaggactcttagtatgagtttggttcgtggctttaggctgcctacctcatgtataaatagagggggagcatgaggcttcccggtatcgcttttgagagcaattgagttgctagtttagctagggtttcgagtttagtcgagatttttgtaaggagtgctgttggtgcactttgtaaacacagagagaagcaataaagttgttatctactttgagagttcttcagtttgtgtttcaccgggtttcggcggtccaaccggcgatataccggcggtcagaccagtggcaagcggcggtcagaccggcggcatacgagcggtcagaccggcggcggcagcaggcacgacaggcgacttcggcggttcgaccgatcgatctacatcggtcaaaccgacgtgttccaggcggtcagaccggcgcgacaacttcgatcagaccgcggtccatcgaattcgagggtaacttttatttccgctaaaagtttttggttttggggtatctcaaccattcacccccctcctctggttggcttagttcttgtgattcgatcatacacaacgtaagggctcctactcatttgtgaatacggtgagcaaagggggccgtggtggcggcttcaaccgtggtcgcggtggtgcgaaccacggtcgcggaaagggacgcggcaatgcgccgcaaaattctggaggaggacgcggtaacaagccgcgctgtcagctgtgtttcaaagtcggccatgtggtggccgactgctggcataggtacgaggaggacttcgtgcctgatgagaagttcgtggcagcagcgacgagctcctacggtgtggactcaaactggtacattggtaccggtgcaacagatcacatcacaagtgatctagacaagctcatcattcgggagaaatacaagggcaatgatcaagttcacactgcaagtggcgcaggtatggctattagtcatgttggtcagtccattattaaaacccctgttcgaaatctttagttgaacaatgtcctacatgttcctgaaaccacaaaagatttgatttctgctcataaacttgctcacgataatttagcttatgttgaacttcatccaaaattcttttatgtaaaggaccgagccacgaagatacctctacttagaggaagatgccaccaaggcctttaccctgttccaccttccaagtcttcatccagaataaagcaagtctgtggtgctgtgaaaccttcctatgagagatggcatagccggcttggccacccgtcacccgtagtcgttgctagtaataatcttccatgtttaagtcagtcaaacaaagagtctgtttgtgatgcctgtcaaaagactaagagtcatcaattaccttattctgagtccattcataagtctgagtatcctttgcaatgggtgttttctgatgtatggggtgctgccccagaatctgcagggagatacaagtattatgttagttttattgatgattttagtaaattcacttggatttatttattaaagttcaagtctgaagttttcagtaaatttcttgaatttcaagctcttgttgaacgcttgtttaataggaagattattactatgcaaaccgactggggtggcgagtaccaaaagctccacaatttttttgcccaagccggcatcacacatcacatctcatgtccccatacacaccaacaaaatggttcagccgaacgtaaacatcgccacatagtggaagtaggacttgccctactagcttttgcaagtatgccattaaagttctgggatgaagcctttttggcagccacatatcttataaaccgtatacctagtaaagttatcgactttgctacacccctagaaaagttactccaacaaaaaccagactattcctctatgcgcatttttggatgtgcatgttgtccaaaccttagaccttataatgtttacaagctccaatttcggtctaaacaatgtgttttccttggctatagcaactttcataaggggtttaagtgtcttgatgtggctgccggccgtgtctacatctctcgcgatgtcatctttgatgaaacggtgttttcctttgctaatcttaatcctaatgccggtgcaaaactccgttctgaaatcctgctacttccatctcaccttcggaattttcagcctgctgatcatgggggtgacaatgtgactgatcaacagactaattcagccagtactgctaatgccgctaatgatttttctggtgcaaatggaagcaataatgcaggatctggagctgcaagcgatgatgggcatgacgagctggagattggcaggaatgacacggcctccgatgacactgatcctgatgatgcaggtactgtcagtcctagcagcaacagaatggaggcgcagacgcaggaggatggcgatgggacttcattctcttcgccgagccaaccccgtgcagccacgtcgccaacacaaggcgcgggtgcgtctgccagtatgcagtcgcccggagcaacgggcccgtcctcggcagcagatgggcagagcacgggatctgctgtgccggcgcctccgacggtagaagatgtgatcagacccagatcaacccgcttacagagtgggattcaaaaaaaaaggtatacactgatggcactgttagatacaagcatgctggtcttactgcttgtggagaaccacaaaatttagatgaagctttaagaaatcaaaattagaagcttgcaatggatgcagaatatatggcactaatgaaaaatgagacatggcacctagttccttcatctaaaggccaaaacattatagattgtaaatgggtctatgagattaaaaggaaagccgatgaaagtttagatagatacaaggctagattagtagcaaagcgatttaaacagagatatgacatagactatgaggatatttttagtccagtggtcaaggcagccactataagaatagccttatctctggcaatgtctagagggtggtctctacgtcagttagatgtgcagaatgctttcctgcatgggcttttagaggaagaagtctatatgaaacagccacctgaatatgaaaataaggctatgtctaatcatgtatgcaagctagataaggcactgtatgggttgaagcaagcacctagagcctggtattctcgccttagtgctagttatgtgagcttggatttacagcttcaaaggcagatacatcattgttcttctataacaagggttctgttacagtatttgtgcttatttatgttgatgatattatagttgctagctcaaccccagacgctacttcagctttgctaaatgatcctaagaaggattttgccttgaaagatttaggagacttacattatttcttgggaatagaagttttcacaagaacaagaatggtattctgttaacacaggagaagtatgctgctgatgtgttgaaaagagtgggaatggaagactgcaaacctgtaagtactcctttgtctactagtgagaaattgtctatcaatgaaggtacagttcttggagaaaatgatgcaacgcattatagaagtattgttggtgcattacagtatcttacattgactagaccagatatttccttctctgttaacaaagtgtgtcagttcttgcatacaccaactacagttcattgggcagcagtaaaaagaattcttagatatctgaaacatacagttgatcttggtctcaagataagtagatcttcttcactgttggtcagtggatattcagatgctgattgggcaggatgcttagatgacagacgttccactggtggctttgctgtgtttttgggaacaaatctggtatcatggagtgctcacaaacaagccacagtgtctcgctcaagtacagaatctgaatataaggctttagctaatgcaactgctgaaattatgtgggtacagtctgttttataggaacttggagtccaagcacccaaggcttcccgactatggtgtgataatcttggagcgacttatctatcgtcgaatccagtgtttcatgcaagaaccaagtacattgagatagattttcattttgtacgggaacgggtatctcaaagattgctagagattgcatttgttcctacgcaagatcaagtagcagatggtctgacaaaaccactgccgctgcaattgcttgaaaagttcagatacaatctagacctagaaaggttaagattgagggaggatgttagataatgtagtgtgcgtgtgtaatcttatcatgtaatcctgagttggtttggtgcggctgaggaggagtagttagctgtaactaatcattagttgttgtatcttatctagattacatctcctccttagtagcaactgaacttaacaaccttgtaatctcctagccggttgatggctctatttaacacgcacacgcggccctcacgagggtatcacgcttcctcattcattcactcgtttctacagatccatccctcgcacggccgcgcctcgagcccccctaccggccggatccgtcccccacgcagggccggtcctgggtttttttgggacccagggcaaaaacttatatggaggcccatatatatacataaactaatatatatatttatataatcatataaacacacaacatttaatattcgatgtgataaaattatctacatataatattttaaaacttcaaagagaaataaatagcggtagcgagcagagaaggcgatcggcggacgatcgacacgagcgtggctactggtgagccacgatttgctgacttgctgtttccgtttgtgagatgccgagaagtcgagaagtcaccgagagcgcaggagcagcgagcgacgtgacgtgatcgaggcggcacgacgcaagtggcgtgatgtgatcgaggtgaagcgacgggaatcatatgaagatcgcttcggcttcgctgaaataggtctcgatggactaaaattcattttctatattgggctatttagctctctaacttaatataaacctatggcccatgaactaaaattatacggtacgtagtatatatactatatgtttatatagagggcccctagattttggggcctcgggcggccgcacggcctgacccccctagggccggccctgcccccacgtgccgcatctacagctcccctaccggtcagatctgggagatgttgagggagaggtggagaagagagttggatccatcccctacatcgtcgccgcctgtgtccttccctacagcgcggctacccagtgctgccgccggagggagggaagggccgggttgccgtcgccactccctgcaacacggctgcccagttgtcatggccacgcgctggactggccgcgccaccgcctcccctgcgtgctgccgcctccctagccatgtcaccgctgccagcacgccgcctccaaagttgtcgagaaagagagagagaagagaggggttggatatggggagccgagaaaaaaaacagagagagctgaaaattttacttccgcgttgtatttaatctctcccgcgattttcgcaggcggtggcttcggtggccgccagcaagaatggatacatcttcgttagagagtttaatagtatagccaactacgggcttcaaattatttatgattcatctaataaactattcatataatagttaactataaaaatatactacaccattaatacccggtcctacctctgatacacacgtaatgtattgaagtccgtgttacagctggctacaaatctatagcccgctttcttttctctcttctcttttcttcttgatatgtggttatagctaatttatagtatgagcaggtacaatagcagactataagccagctataaacatattttaaagagataaaagaggagagaggagcagtgggctacagatctgtagccagctgcagcacggactccaagacgcaatgtgtgtatgacaggtagaaccatgtattaataatatagtaagcaactattgtatgaattgactattaaattggctatacatgatttagagatagtagttggctatactattaaacttgctcttagcggccctcttatcctggccgccagcaaatatccattttcgatggtggtccttagcccctcactcctcgttacattttcactggcggttatcgtgtatggccgtcagagaaaaaataggttgacgccatgaaaaattgattttgtagtagtggataagccttaagcccctaacgtaccccatcaaatgtgatcagagtcatttttgacggattgatttttcggaccatcacatataagtcattcataacgggctgtagtttaatcaagcagaggggtgcacctcatgtcctcatcgatgatgggatttcattaagacccatttaaggtaattgtcataggtgacggcttctcgcccaacatatgatttcatatcactaaaccacttatgtcaccaggccggatccggttcacctgcatgccctagtgtgactgcaagttaagcagtagatcatccaagatattattcatccaaaaaaagtctacattttttactgtagctcggatactgtagcgttaaatctgaacccttcataggaaaactagatggccaaaatctgaaccctatcttgtagttcctagtgtaactgtggccgagttccaaactatttcttcgaacttccaacttttccatcacatcaaaacatttctatacacaaatttccaacttttctgtcacatcgtttcaatttcagccaaacttataaatttggcatttgatcaaaatcccaccaggctttcctccaacacggatgagggttttcgcctgacagaaatgacctgcgccccactaggcgtgtttgtttcgtgcatgtttttgcaccaagaggataaaatatgcacttcttctgtgaggactttacatctgtcctggatttgtgttgatagatgggaaagtgatttcatctctcgaggagatatcctttcgttttgtgcatgccacctaaatagtcactaaaaatttgaaaaaaaattggtaagatagattaatatgaaacatatcactccacaagcatgcatgttaaaatttaacttctacaagttgtaacaaaaataacaaatatagatgcaaatatacgttaactattttcagtttaatttgtttttttaacttgtagaaatcgaatttggtcttgcatgttcgtggagtgatatatttcatattaatctattttgttaatttttttaaaaaaattttgataactactcctatttaaatggtatgcaaacaacgagaggatattcccgcgggataaaaatccatatccttgatagataaagaatcttcagactcgctatatataccactatcccctccctcgttttgtttatcatagacgattttatcgatgaacctgaaatagacatggcttgccacttgagattatttccctttactcaactactagtattggttctgtacaaaatcgccgccgtaggggcagatcctgcaaacgcagaactatccacaaagatcacccaacactctccattgtacaacccacagcctcaagactttccaaacgaggagctctaccgcaactatctagtcatccagcggttcaagaagacaatcacttccgaccccaagaacatcaccgccacctggaccggccatgacatctgcggcaacacgacctacctcggtttctactgtgcagcattgcctgggcgtactaagaagcccacggtcactgtggtgatctttaacggttatggcctgcgtgcaccgaagctggaaggatttattgaccatctccccgatcttgcacttttccatgctgcctccaacgacttcggtggtgacatcccctacctcacaggcctcgcctacaactacaagatcaatgtcgacagcaatctccaaatacaggatgattttagtcgtgacatggtcgggtcgcatgtaacaactaaagttcatggttattgcgttaatttagatctagatatcacatttcacctccggcccggaaaagacgacaagaaaggacgaagcatccccggtgccacagattctaaggcgctcctcctcaactacaatcacctgtccgggccattaccggtgaacatcggtttctccaagttaagctacctggccctcgccaacaacaggctcaccggcgcaatcccgccatcaatcttgcatttgcaagactccctcctcgaggtgctcctcctgaacaaccagctctccggctgcctcccccacgagctcggcatgctcaccaaggccgcagtgttcgacgccggcatgaaccagctcaccgggccgatcccctcctctttctcatgcctcaccagcgtcgagcagctcaacctgggcggcaaccgcctctacggagagatccccgacgcgctctgcaagctcgccgccgtcccagccggccgcctcgccaacctcacgctgtcgagcaactacttcacgtcggtcggaccggcgtgcttgtcgctgatcaaggacggcgtcctcaacgtcaggaacaactgcattccgggcttcgccaaccagcggcggccggcggagtgcgcgtcgttccacagccagccgaaggcgtgcccggcggcgagcgccacccacgtggcgtgccccgccggagctgccaacgctgcggcggcgccggcggacagggtggtcaaggactactccagctacgtgacgtacgccaccctgcacgagtgagcccggcgccacggcacgggcgcacgacgtgcgtgcatgcatgcagtaggggacagctagaagctagcgtctcggggtggtatttgctcttgtattcttgtgttcgtttgttgtgctcgtgagtcgtcattgtggtttgttttctctgcacgtgtggctagctatggctgtcacgtctagatctcacctcctgtactcttgtgtactgtactatgtgaaaatcattggtgattactaaagtttggtgtgtgccctgccctacatgtttgataaagtttacatcatgtaaagcgtatctttcaaaataacggccatatttagttgcacccaaaatacccccaaccttccaactttccattacatcacatccaaaactttcctatacacataaactcccaacttttttttccaaactataccaactttccccaaactttccccaaacttcaggaactaaacacagtcatggctatttcaacgctatttcatcatcaaacaacattttcgaaatggcgagccacgtcaaattgcggaccacccatctcctcgtcgcgctgctctgcttcgctgcagcaacggccgaaccatcagaagggacgagctcagcatcgtccagccccgcatagccgcaggacttctccagcgaccacgcgtaccacgtgatccagcgcttcaagcggtagtgcggcaccatcgatcacgtacgacccgaagaacgtgacagccacctgatcctgaatcggccatgacatacgcggtgtgcgtcgtcgctggcgataaggacaagaatggtgccagagacgggtagaggcgccggctcggtcgttctccagctacgtgacatgatatgccactccgcacgactgagatgccgcagctagcgatgggactttgcgtcacgccaccacggtggtgcgcttggctatttcgcccgtgttcgttcgtagggctcgtcgcggtgtaccactcgtgctgtcgtacgtgcatgctgggttgttggtgctcgatcggtgtccgttgtacgtggcagtgcgtatcgtgcatgtcagcatgtgcgttttctgttcgttgccgtgttcgcggggggattccgcctgcgaatctcatttggatgtacgctatgcggtagtacggtacgcccttgagtgaccaccaatgaagttgggatgcaccatgtgcccgtgaggtgttgatcgcttttcagttttttcaccatggcgtgccgtttagctagaaatgcaagtgtcggtgccaacgacctgtgcataagacaggctgcatcgagaatggtttttccacttgatgtgtacttcaatcctggatggtagagctttcactatgtgaaaacaggttgaatacaaatttcacaaaactatacatattttaaataagctattgtaaaactatgaataatacatcataaaactatagtttcgtacaaaactatcacggaactccaaatttatggcatagtatcccaaaactacagaagcaccgattttatcctgaaactgcatgttttgtaactctggtagagcattattaatgcttagaatttattctcttaatacaacttagttttgtaataacttcctcaggtagttttgagatacttcgagccaggttgtgttgaactgtccccagaggacatccaaatattcgatttgcaaaatgagtcccatttgctagggccaatgggatgatagagctggcccaaacgttgccaggttgtgttgaactgtccacccatttttttttaacgaatcggcgagccaccaatttcattggagggagactagtgcacggcattccgtccgaacgggataattaaatgacacctccacctccccgagcaagatatggataaggttcaaagatggactcagctagcctaacgtatcaatatgcatggctctcaaaaaaatctgcacgtaggaattaatggttggcccccacgtgcatctagcgcttctccttgagtttgtaggtcagaacatgcatgtgtataggtcagaacatgcatgtgtagtgcattatcaactattttattaccacgctgttctactagtactaactaggatgagacgatttctaatagatatcatatgatacttgcgagatatcaccggtgatacttatcaggaatcagacgattccaatcaggtttcgcgtgatttctaccaggtatcaggtaatacttacgaggtatcacctgataccggttaggtatcaggacatgatacttgaaagatatcaggacctgatatatgtttctatccaaacggtgatacttatcaggtatcagacgattccaatcaggtatcacgcgatttctaccgggtatcatataatacttgcgaggtatcaggacatgatacatatttccgtccaaatggtgatacttatcaggtatcagaaactggtatcatgactacctgatacatacttctgtccaaacggtgatactcatcaggtatcggatgattccaatcaggtaccacgcgatttctaccaagtatcaagtaatacttgagaggtatcacctgataccagttagatatcaagtcatgatacctaaaagatatcaagaactgatacatatttctgtccaaacgggatatggtcctgtacaattcccggagtgagaaaagcacaatttccaaagagacgaacgataaaaaaaatactattaaagtgtcatgttttctcagtgtgaacatgcacccataaatatactgatttgactagctttatcatattgtattgtcaccaactcagatactggtgtgacgtgcctgctcgtgtcacgtgcccacgagcactcatgagggttgcaggcctgcaacacactttggttagctgctcgtgtccacgtgtcgctggaggcatgattgtgcacgaaatcagattgacttatgtccatatcaaggaagtcatgaatacttcattaaactattccgttcggacggtatcccgtacagtagtttttctcatttcattgaatatatagaagggataaaatacaacaaaagctgtacaaccaagaacaccatacaagctcgggacctttggtccgagcacactaaagagttagccagatgccgagactttttgcgcctgccaaaccctaagttttggcctcctcttttatttttgccagcaagccaattgccgagagctctttgtgttggaaagttctacagttttttttattccatatctcccaggtcactagtagtgttagggtgcgcaaagccttcggaactccttttatgtatgtcgtgttctcccaccattcaagcactgtcggaacatgtcgcattcgagaggggtttagctggtcacataccgccactgatttcagtccggttcttatgcctgttttccgtccactcaaaaaaaaattagagaagggcaacctaatctaaaattcgctcacatagatatttgaactcaagattttggtgtgctattcaggtcactgcaatcactaggctacatgccctttcgcaaacctaccaaaaatatttaaaatgcattaatatgaatagaagaaataaatgacagatctaatagtattgcttagttacggaatactgattccaattgccacacagcttagaacatcttagaaaagaataggagtgcatcatgaaacatatcgtgtgaacataagtttttgatgtacacagatatcatctaaaataatctaaaaaagattgttcaagtattttcagtagtattacacctatgtgaaagcctcgtctccaaattcatcatgcaaagtgagaaaaatctatcatatttatactgttaaaactagattttttttaacagctaaagtataataaatttagttgagatttcatatatgtgcactaactattggaattacttacacaaaattttcttcttttttatacatttgttagttattgtatatatgtgtgcaccgaaaacttatgtgtacatgatacatcccattgtacaagtataaggctaaaatatgttaatacatggccataattgttacactactgtcgaacaccaaaatatactaaagttggaaatcccaacaagctatttcacatcttttcccaaagttatgcatttctatatgcgagcacccacattgaaaaaaataaaaataaacacgatacaactatcgagaattatgcattttagaatacaggagtgagtgggcgcgcgcggcgcgcgtttataggagcatatacttttttaagtattcgtataaaggaaaacgaaaaaagaatgacagaacctcttgtgtgattacctgctaaggtgtataggctgggcctgtaacatatataaaccattttttagaagcgtctcctgtacttcgtagtatagttcaaccagtattgacgtatccacgctccatgactgtgacgccgcagctacgtatacgatgggaccgtgcgccccgggctctttggcttcacattgcccgtgttcgtgggctcgtcgcggagtacgagcaccgcccccatgcatgttggattgctggtgctcgtcgtcgtccgttgtgcatgtcgtgtcgctgcgttaattcgtgcatctcaccatgtgcgttagggaccgtatgccgtggttgcttgtgatgcggggggttctcgcctggaaaatctcatttggatgtatcgctcgctacgcagtacgcccttggcatgatcattgatcaataaaagctgagatgcaccatgtgcccgtggcccgtgagtgctgatcgcttttttgaagttgtttttcaccaatgtgtagctagaacataagtgtcggtgccaactaacagtgtgcatcagacagcctgcatctagatttatttcagggaacaatacgccttcatatactgtgggacaatgatttttcggcttgtgatgaacacgcaactatgcaagacatctcaagatcgatgcaagctttttggggcatgtcaaaatagattggtgcagtgccggtcttttccggccataacctgaaatcaggccaacgaatgatcatgcctattggacttgggaaggttcacattgcagtaggaataagttcactttgactcccttaactaggtgacagaatctgattatccatgaaccacgacaccagatatctcgacccccaacttttaaaaccggtgcaatttgactccctcggtggtttttgagggcggttttgctgatgtgacgcctacgtggtagtattgacttggtcttcgtttcattggccttgacgtggcgcttaagtggtataagaattaaaatatatatgtgggacccaattatcattcaccaaaagtatgtgtgggacccactgacatgtggggcccacatattatgctctctcttcttcctcctcctctctctctctcttcccttcggcgagccgcgagcgtgggacaggggccagcagcggcaggagggcaggcgggcgagggccggatcccctttgcgagcttgcgacttcgagacaacggcgggaaagcggagacatcgtgacgtggcggagac

SEQ ID NO: 56125 - DNA, 2957 bp, Oryza sativa
atgtgtggacccacatgttagtgggtcccatacattcttttggcaaatgacaaatgggtcccacacatattttttaattctaatgccatctaagcgtcacgtggaacgaagaccaaatcaatactgccacataggcgttacgtcagcgaaaccgccatccaaaaacgccgagggagttaaattgcaccgattttaataagttgggggtcgagatattcggtattgtggtttagggatgcaaatcagattcggtcactagttaagggacccaagtgaacttactcccattggagtacgcctgtatgttagtagtgccaatggacaggagaaccggcccaaatagcggcaggttgtgttcaactgtccagcggtttcagtccggtccgtttgcgcctactcgtgatttgggccgctgatccgtcgtccacgacgaccgagatgagagcgatcccctcgagaatttcaggcgaacgcgcgcgttgagcgagcacttggatctcagagggcctctgctccctcgtgttgcgatgctctgcttcgttgaaacaagccagtcaggccgagagccgataggtcgcgtagaaccatcccgaatgaattgaaaagaaaagaaaagaaaaaaaaatctaactgtgacatcaaatacagagtacaaagatatacagctggtactcgtatcaattatttatatattaaatctaaaaactgtgtatacaatacagaattatatacgagagcatatataagagaatagagaatatatatgacagcataccactttacatgaactttggccttgatctttatagacatggttcacacatgatagaccatgtcgacttcatagccatctgaatgccgtccagattacgggccaatatttttgaactctttccatatttttgaggtgtaaaagacaagctttcacatagaaaatcgtcaaaatcatattctgtaccgaatctacagttcctgataacaccatcgggatggcaacccgaatggttgtagtatttataaactgttatggggaaatgtttatcatgtctcgcgctcaatgtgagtggaggtagcttgccaacacccagcttgccattgaagataataaaagaagtattaatgttaaagtaggttgcaactattaattgcgagtgaatcatgctcgtggttatcttcaatttgacacacctcaaactccaaatcaaccaggaccgctttcgggatagcaaaaattgtcagatcaatggtgccgaaatgaccagtgttgatgtgccatatgagcttttcaaaatctgcatagaaagatggagcgtagatagaatatccatctattaacacttgatcttcttcctccttttgacccttaataattaggcgatactcaattagcacaatcccaactgcataaatgcctcgaggaggggtcatcagaggttggaggcaatgagcaccctgcattgtaattaagatatttttggaaaagattagaactgcaatatgtatatattaattgttcaggaagtagcagagaaaactgtatggcatcatcaggtactcaccggcttaagtttacatgggttttctcttgagtagtcaaagacatagttgcgcagctgactattgcgtgtatctctgaatgcaaatgtacatagatctccaatggaacattactaggagaagatagattcagaccaagtacttgtatagctcgacggcatggttccttcccgtccctatctaaccatcgcctttcccacttggggagtgcaggcactagaagtagaaaatcaaaaaaagtcaaatcagtacatcttgaattattgtttgtgatctaaatgtgattagataaaactagaatattagggaaggacctaatatcaaataattagaaggggtgaggctttaaacccaagtcgtctagcccaccaccttgtggagctagccggaagacccctgggcatttctcaaatgtgattagataaaggagtctgtactgataaaaactatttctacaacagatggcatttggattgttagtacacgaattggactagtggacttactcaaatgatccgtaagtgttaggtttggatctaagttgaatggcccttcaaccacaagagacccctcccaagattctgaaagatcagggatgggaaacttcatttgtctgagaatttgcttctcccatgtctcctccctatcagctgcataataagggttcccgtcttcatacctaaacccatcgccgtatttcatgaaaatgttccttccattgctgtagaaggacactccactcccatcggagtcataatcagtttcgtacgtgtgcggcccatatattttctccaattcatgatcttcaagatgacagggttctccgtgtcgctcctcgatcatcctgcacacgtataggtcgtcttctctctcttgctcgtgtcgaaggcgacttagttcgtcttgctcctcgatctccctctgcaataagtcgatctctttgtcccatatccaggtgttgagtatctcgcgctctgcttcctctcttgtcgccgccaaatcctgatctaactccacgccgtcctccatagaacaacctcacagagtattgagcctccgttgacgacgtggatggacttgagatgaaattccgatcaactgaatccatgccactaacgcgaaccctcgttctatattcatgttctgcgtgtgtatacgagatccaatgggtattccgtatccgatatcaccaacctacagacgtgtaggatgctgttttatttccaaacggaaaacgtacatagaagttcctcaacttatcatcggattatagaatcatcctccaaccctaaaactaatactccctccgtttcgttttatttgacaccgttgactttttagcacatgtttgactgctcgtcttattcaaaaacttttgtgaaatatgtaaaactatatgt

SEQ ID NO: 56126 - DNA, 1302 bp, Oryza sativa
aattcctgcagcccgcaaattatggctgtgttatatttactatggtacctcacagtaccacctagataccatgaggtactaaattttatactaaaattttagtatctcatggtacctcctaaaagactgtaaaattactctatttactaacatgagtcaagcaaagttgaccatgttgcctttatggccatctcaatgccatccaagttgtcggccatttgtgtactcgtcccatccttctgcggtgtaagactcctgctctcacacaaaaattcttcaagatcaaaacgtacacagcccggaaaataatcactaataacaccatcaggagtgtgacgggcatcatctagttggtcttggtacgcgtaaacgtaaatgtgcatgtacccatcatggttcacagggagtgtgaacggtggtagcttgccaacactcaacttgccattgaaggttatgaaggaaccctgaaacatattgtaggtggcagctattgtaagcgaattatattggtggttctcttcaatatggtacacctcaaactccaaacgaaccaataccgctctggggatagcaaccattcttagatcaagagtgctgaagtgaccagtgtcgatgtgccaatggagcctttcaagttctccatagaaagatggagcgtagatagagtagccatcgattaatacttcatcttctccctctatttggcccttaataattaaggaatactcaataagtacaagtccaactgcataaatgcctcgtgaaggggttatgagaggttgcagcttatgagcaccctgcatataatatatttttggatagaaaaaaaagatcaattagaatgttcttcagaaaaaataagttatatgcaacagtacgtatattcttagatggaagcaagggaaaaaaatgtagaacatcaattactcacagggttaagtttgcatgggttttctcttgagtattcaaagatacagttgcgtagctggctgttgcgtacatctctaaatgcgaacgtaccatagatctccattgaatcattagaaggagaagataaatctaaactgaacacttggatagcccgacagcatggttccttcccatccccattcacccagcggctttcccacttcggcagttgaggaactgcaagaaaagagaaaaatatcaccatgtatcagtacgtacatattcacaatccgtaaaatgccaatgtgactaagaaaatatatatagttggtgtcagctggattaatttgtagcatgcagacgcacagagatgctccacagatactcgatttg

SEQ ID NO: 56127 - DNA, 7171 bp, Oryza sativa
gcaataagtacgagaaaaatgaatttttgaacacctcaaattatgaaaaattctacaagtttgacaacacaaaatactacacaaacatataggactaaatttaattctcatataaaaaaatactccataagccacattaatatattatttgccactctacaggggactcggtacccttatttgacattgaaatgctaggtaggaaataaaaatttctataattgtacttttcatgaatggggattgaaatataacccaacatacttatatcgtcgaatctattaatatttattatttgtataacacgcataatatatgaaattatactttccccaatgcaagatatacacacacacacacactcactccaaggtccaaactctaaaaggataagaaacaaagggttagaagaaataatacaaatagcaaatcccaaaaattgaaacaacccttaaccttttcgacgcccctccataatctctcgaggctcctccacctacgccgatcggcggatggactcggagatgattttcaggtcgatcgacaaagaggatcggccacccaggcgttagtagactcgatgtcgtagccgtaaatttaaccgcagccgccgagcaagccggtgcctggacttgtatacgagatattcagatatatatataagctgcgcgtgtgccggcgtatcgtcgtcgtctcgaaaccgagggtaagtaggattagcagcctggacggacagctcgatcgaaacctagggataataggaaacgaacttgttctctctcacgtacgaactcgtgcccccaatttttgtggaaacaaatttggtagatacgggttgtaatcccgtgcagcctgccgcagatcgtcgcggagtggccgcagtatcggttggatctggatggtactcccgctcggctccaagcctccaggcgcgcgacgccgagtctgtaagcgcgcggcactcgatcgggctcggctcgcgtcgaaccagaaagcgtcgagcggatgacatcgacgggcgcaacaccatcagggattcagggccacgtgcatttttcatgccatcaaaaattcttgtatacaggcccaaatagatgatagacttgggctctggaattatattgtttatgcatattcaagccccaacggaaaaaggaaaaagaaaatgaagcggagcttacagtacacacatgaaaattccttcagccgggcattgatagcatacatgatacatcatgaataaaccatcactatcagaacgtcgaaaaccaccatgcataaaccatgcatgcgagagtaacatcctggccattagtagcatatgcatgggaagacatcatactacagtaacatcacacatgcattcatacatgaatgccatctatagtttgtcaatatcagaagacatactgctaccggagcccagcaacatcagaagacatcatagtaccatcacacatgcatacatgaatagcacattctattagatttagagcaccatcaaacgtccaaaacagtgtctcgtagtgttctgattatcttcctttctgctacatgtgccaaacgtgtcgtgggttggagaagtctgatgtttttcgccgggccagcgatagaagccggggtgagtttattaaggttgggaaaacaattgcaatactgcagggttaacatggttgctggatggcaatcttggcgctaagccagattactgaagaagagctaaggtggcgccacggccagcagatatacacacggtaatgaccagttatatttagtccagctccggccaggccggcagctcgttttttccaaaccatcaggtgatcaaacaaactgccaaagtcccattgtgttccagcgaaagaatggtgtttttctcctttgtgaattcaccttcatgtggaagaatttagtgttggcgtcatcatgcttgatgtgggtcagccgagaatgctgacgcatccgtatcctttccaacgatgctagggctgatgtagaaagttaatttctgctacatagctcatagctatgtgttcaaaagattgcaaagataatgtgaacgtacttgtgtcaacctgaacattgctacctctactcaattcccagatctgcagaagggtggcactgtgtaagagttctgctcatattgtaaaatgcaaaagggaaagggagtaacattttgatctaaccttttaagctgaccccctcctcagccttgttgcacaagacgagcaacggatctgttgaaggaaaaatactcattgccttccttttcttctcagcaactagattttcaaataacttcttgtgctttgctttcaattcttcatgtttatgataaagcttgattagaaaacaataattagttagtataatttagccaatactagcatattaaaggtaaattcgtagttaccttatcattttttttggcatgcttttcctttctcattacgttgtatagcttcattttgaatttgggaggattgtgtactcaacgacaataatccatcaacggataatagcaccttaacctcctttttgccctctcttggatccaactttaagtgtgaggtatgcaaaaacatcacaagctttagttaaaataggaagttccccttcaacaatctgaactgctgtggacaaagagctcgcttggagtgcaatctgggctgcacatggtatatttgaatgatgttccaacacgcgatttattccacccattactacaactccaacagaagcgtgcaaacaacctgataaagcaacaagttcacgatccttaacagcaagtttacttccaggaaatgcatcccccttgataaactcaatgtgttttattgccaaatttggatctgttgtccagcaatcgtctgcatagaattccttgcttttgacaagagcttgctcctggaaatcccatacttttgctgcgatatgaagagatcttaagatcaatctggatgcacttgcccagccattgatatgagttgcccccacatagcccaatggttggagctgtgcaccaacccttgaattcaaagatttcaaaataagacgagatatgtagctgtttttcaaactttctgctgagaaaatgatcagggctgccattgctctcttgtgttttgctgagtaattgtatcggtcaaaatgtgccaaatcctggaccatgtttttcattacgctatatcccacctgaaaacgtgacaattcatttggttctttgcctacaaggtcaccatagttgctgttgtgttgtagaagtattgagcctttaatatacttctttggccttggtggcgcattttccttcaccacatgttccttgcttgaacttgctaattcatacttgtctctttgcttgtttttcttatccatcttctcacgcttctggtcctctataataccctcctcccttgttttacctttctcatttatagaaccctccagcatctgcatctcctccttatcgtcaaattcatagatttggccatcagcagtcctaaatcctctcatccacatgttttttccttccactatggcagttacagttgaagcaccatcagtaaaggctacagcaaagacttcaatcccttctggggtaatacagaattcctttctcttggaaccagtacccttcacaatccttctgaacctgcgcttaagttctttgcgggctttatcaattttttgggtagatgatctcaggatagcactgaagtcattagcatgagttaacttcaggtctaaagtaaatagcagttcggatggcatgtcatacactccaaatgactgttcatcacccattctgaattagaaacgagctgatagacaagttgtgttggatatatcactgcaatcaaaatatcgacaacattattaaacacacagatgtaatcaacttagcttttttatacacagaaaaataaatccaccaacaaattaaataattactcaactacaatgtaacatctcaacaatgatatagcctaatccctccagtaatttttcccttccttttattttttctggttcttttggcttttgctgaccaacatataaaagtaatacaatgattcgcaatccatttgcgtattccaaatccctaggcagccaaatcgcacacattatattcttgaaatattatactgactcagaattcatgtacatgcttagtaagcaacaaactgcagataaagcaatagtgacacatactcttgaatcaactaaatatgtacaaacacatacctcagatgcttggagaggatagagggggtgatgtgcctgtacaatgtacttgagctttccgttggtgtctggtcaaaacactgcactgttcagcttctccttgtactgctgcttcatctcaaacaatttaaacttggaatagtggaatagataatgaaggtgcatgtgtgatatgcacccatatatcaataaatatgtacaaacatcttgtgattacttcgtttttaaagaaacacacagtactgccactgtaccgacatttcctcgcatttaagagatgtctgaaacatctactaacaaaaaaaaattctggacaaatatgaagaaactgtgaggtgtgagagaaaagaaaagaaagaactggctagtatagtagtattaattgcagtaccgtcgataacaacagatctttttttttaaaaaaaaacctaaggcggaactttgttccacttttatatttagaagaagagtttgacctagtttataagaaaaaccgggcccaaaaaccatacaataacaacatatcctagttttcaagaaatgtacaattctgctatatgcttataagtctaattaatgaagtttagagccagcaacagcaaaggggaaaaaataacaattagcgtgtaacttagaaataacattaggatctccatcaagaaaagcaatagaaatcttcacaagaaccgacaatctttatcaaaaaaacaagcggattgtttacccctgattatgtaccccgtttcacatcgcaagaggtcaataactttcgtttcgcttcttctataaccagtgccctagaaatggagcgtactggaatttttttgacgcaagggtgcctaaataatcaacagcaaaaccggacggaaagattccagtacgcacgaatcgagtttatagcaagcagcaacatatcaaggcaaacgcgtacctagggttttccgccgtgatgcgtcccctgctgccaagacaaacgcgaccgctgtttgattcgtcccgccgacgcggaggcggagggctgggggcgggcgcagtaggggagagggcggcggcggcagaggcacgcgacgcggatacggcttgacgccgcagaagctcgccgatcgccggattctgaaggtgccctaggtggggaatgcaggtaggcttgaggttgagaacggaggccgacgccgccggcgatcggcggccaaaaaccccacccgcctttcaactctaggagagtccgctcgcaggcaggagggtcccactcctcagcacgcaacaacgtgcgggaccaattatttgttgacacgtcaatgtttaacttaacgtctagtactaattaaaggtttacttctaacccccgtgattagtccatttctagcatcagtacctcacggtttaacttgatttaatcaaatattttgtctcaaagcaaattaccaattttctaaaatatattcttcagctatgtcacgtttttcgatgtccactaataaattatgcaaaaaaaactttgattatactattgcaaaatctcttactattttacttaaaaaaagaaatgtttccttcatccgtcaaaacaaaataaatagccaaaaaaaaaagtccgactccctctcagaaacgaaaaaaaaaagtccgactctaaatccgattctccccttaaaaacagaaaataaaacacaccactcctctcggtctcagtttgagtccgagatcccaggcacagtcctctcggtttcaatctataccgtgatatcccatacatcttggtgaaaaaaaattgatgtgccggattgaaaatatgtttgcaaaaacggaacctaccggaggagagcattccatttttatatgattttaatttttgggtttgtacttttctatttgagtccctgtaatttttatatttacacttgagtccctataatcttgcaataagatacttgagatcgtttttttaagaaaaaataataaaagggagagaacaatgacagacaggtgcataaaaagaaaaagaaaaagaaaaagaaaaactgcaaaaaagagaaacaacaacaataaaattttgtttcccctaagtggcgaaaaaaaccgtagatccgattcctataaaaggcaaaaaaaaaagtggtgaaaaataaaggctagatccgattactttaaaaacggaaaaatgaagtctgattcctataaaggtgagaaaatctgaaaaaacatctaaaaaatttcgtccaattccctaagaaagtggcgaaaaaaagggttcgtaaaaaataaaaagctagttcatacaaaataaaaaatacgcgcgagaaaaaaatagaaagggcaaaacaaattccgatttctaatcagtatatatctcttctctatctctaatctaatctaactatttaaaaagagaaaatacacgagaaaaataaaaacagttcaaaaaaatgcgtgagaaaaaagtcagaaaaagcgcaaaaaaatgctaaaaaggttttccatcttccataaaaaaacgtgcgagaaatattatttccatcgtcggtaatttttttaaaaaaaacatacgaggaaaaaactgtaagaaaaaatgcgccatttctaaaaaatgatttgaaaaaacacgcaagaaaaaaacaccgtctattaaaaaaacaaatcgctccgaaaaacctgtcagaaaaaaaaaacgctaaattgatggacgcttgagtcggataggatccatcgattttttgccatctactacacggcttttatttcgtcatatattcttctgtattggaaaaaagcaaaaaaatgaacattaaaaaaaaggaagcaaaaaacgcgcgagaaaataattgtcaagaaaaaccggcaaaaaacacacgagaaaagaaaagcaaaaaagggagaaacatatggttttcgtcgtcggtaaaaaaaattaaaaaagaaa

SEQ ID NO: 56128 - DNA, 769 bp, Oryza sativa
atccagcagacgacattatattttgcacaagaacatggcattccgattcatcgtcatctacatcagggagaaaagaagactgccctcgggtgccaggtaatgctgattctgaagtggtgtcgtcccatgataaggaacaagcaacagcctcaattgctgaagatcttgagacagcttctgaagaaagttaagcagaaatgtcagtatataaactaaccaatctgagacttgaagaactctaggctggaaactagacttactagcattttttgatgtagtgcttgcagatgattcaggttcattacaactgctatcttcagagggtgcatcaagaactgacgtagggctgggttggtcgcgtgtactatttaggacctcattcagtcctagtttattcaggtttccacttcgacaatccaatgatgcaggtacatcagttaaagcagttgttccctgtaataaaatttctcatcaaattctctgtggccgaacaaatgcattgaacaaatatttcttacaaatggaagaaaggatgtcatagctcaagaataaatgtgcccatatcaattacccagctatatgaaaagaacataagatttggcttgcaagatagatgagatgaagtgcctacctctgaagtgctggttgattgcacagcacaaatatcaagtatgtcctcacaaatggtggatttttcattaccatccaaatcatggttggcatcttgttgactatcaccgccacagtcttcagtattccctgaagacaa

SEQ ID NO: 56129 - DNA, 28764 bp, Oryza sativa
tagttctgtgagaattcgcttggatatatattatgtttttagaaaattatgagctacaattaggaatccgatcgtctcaaattagcatgcgagtttttctaaaaaaaatcattatacaactcctgtatttccaaaagcgaacgaacttaaaaataaaaaattaactcaaatacgaatatgtattttcaaaaacaaacgaacttaaaaaccgactcatacacggatgacgtaccaaagtaccggtaaaaacatctttaatttttataatagtagagaaacaaaaaagagttatatatcaaatttaattgtactttaagatatgttttatcttttcctattaaaaaattcaagatgattgtgtactcacctgctttcgttcgtcacttggtgaaaacatacagcccgatgcatggaaccgtttttattattattgcctggttcaacaaaactcagtaactaattacatccactccaaagaacagatatccagcctaactataaaaccaaaaaattttctttgcaactaaggaaaccatcactgcagaaggctgaaataacattgtcatacatacaaaagaaatctagtacttcctccgtttcacagtgtaagttattcgtgagaaacggagaaagtagttgctcaccaccagtccaccaccgagcaacatggacacggccgcttgatccagatcagcttcgacgaggatgttctatcacactttgcgataaagacggtgttggacatgagcggacaaagcgatcgaatagggacatacgtcttttcttatacgccacggacgaaagacaaaacgaattaagtatagagtcatctataattttttaaataggtaaagatgaaggaggaagtcatcacccttaaagtccacttgtaagtgggataagtccatttgagctccctctaattcaaaacgtggtatttgatatctatcgacatatgaaaccgtttaatttatggttacgtcaaaatggtttttgtctacgtgtaaattccgtaataaaacaacatttggacccacgccagcttagctgtcatcatccacgtacctctcttttttctcttcccctccatctcgatcttcaagttgccaggcactgcacactggggacagatcagagaacttatagatgccagtatgccacctcctacctcctttacgagctccgttgttgcaccgcctctaacatgatctcacgaccgcctcctccatatacttagggggcatttgtaaatttgccaccggttttttcaatattacaaggatgccactcgaatgatggttctagtagcatttttacaattttctagtggcagttttgcaataacgattcaaagtagtggtaaatttgcaattgtccctatacttagacgaggttgtggtactgttcttcaccatggctgggcgagcttgaggtgtctctgtgtgagattgttcacacgacggtaaaatatgaagaaatttaaatgagaagtgattaataagaccattagtactctatcgtaacaactattttgtgacaaattcccagtcaaaaaaaatattttgtgacaaattcaaatcctagaaatacgtataattattatgagatagaggtagtaattgatatgagtacctagatatattgtactctatatttgattacacaattagctttattttttcttttattattattatatttcattgtgtgatggtaacagttcaatttccccccttggattatgcatgggtgcgtgatggttctacacgtacgtatttaggaaatttattacagtgcatcaaaacttcaataaaatccttgttctatacattaaatatttatgtccggagagagtacatatatttgtatggatgtaacacttgttttgtatgtattgaagaacaaaacaaatgaattttatttgcacttccaaaatttaaaatcagtacttgccaaattatatatagagtgttgtttagtttggacctccttttctactaaagttgggaaaattgtaaaaaacacacacaccggaagtaccttcaagtttgacatttcaccctataaagttattttattgtaaatgcacatccactattatgttttattacaaaaaccaccccagcatgtgcttaaccaaatcagcttgttatcgctggtgtagagctccacatgctaagctagccgagtctatcgtgtctaggtgtttaattagacttattcttcatgtttcatcaaattttttctgcataaagcaaagctcagagcgacaacatttaagctttcatcaacaactctatttgtggaatctccaaaaaataagtgtcaaaattatacttctagaagtatttttagttttggtacagatcacattgatgtttcacaaatatacgaaaacatattgattcggttaagcacatgtgcattgggatagtttttgtaaccaaaccgagtatgtggattgacatttataacaaaacaacttaaagagtggaatatcaactttcaagcgacttatggaatgtttttttttttgcattttttctactaaattttcacattaaacccacttagcccatgtttttatttcgatattagtttcgtttggattccttttactctactacttcgtcccaaaaaaaatccaatcataataatgaatatggacacacatgtgtctagattcattgctagagtttatctttgtcggtgatatgggaccgggagtatcgtgaccagaggcttgaggcagacacaatcgcccacgtggcccggcaccctcggggacgtcgggcccgagggtgaggtgtccgccctcctcttgatttccccgaggggggtcgggttactcctgccccggccccgacggccgaggcaccccgacgcctaatgaagtttgcgccacatatatgggttaggtgaacacggcagggctcacctaaccgcatttattgcggactggacaggcacgtcacgctgcatgcagcgcagtgcagcacgttcctttatccggtctgtgaccagtcacagaccggtcagatcaacggttaggtggcgactggcggtctgacgcacgcctcgccccgtcccgtcaagacgagagcctctaggcacacgtctccagccggagctagcgtgttacttcttagagatggcacgttagccctggtcagatgaataccaggcttcatcccaaccattacaggcaagatgttacacgaagaagggcgaaatacatgttgcaaagctgacgcgtggtggacaagaatgaccgatttgtgaccggtctgacactgctcatatcgtcagcagacagcctcgttctcacaacgagcctgcctccggcagaagtggaggtaggtatgtgccgtcccgtcagaaggacgttcggagggcaaccatgcaaatctccgcttcatttatgaagagaagaaaagtccagtttggaaagggaggggtgcatgtggtatccccttgagatataaaaggaggaccttgcccatttagagtgggggggctggagattgacgaacaaagaagaagggagagtttggctcacactttgtaactccttcattcatagatccaccaaaacacaggagtagggtattacgcttcccagcggcccgaacctgtatacgtcgcctgtgtctcttgctctttggataggccgcgatctttccacatacagagagagcctgagatctcaccctgagcccccggccgaaccggcaaaggggggcctgcgcggtctcccggtgaggggccacgagctccgtcatctggcgcgccagatagggggactcagcgtgagtcttctgagctctcgcactcttccgagtgtgccaagcttttcttgttcagcctaatggccgagcaagcaaaggcgcccgacctctctccgagtgtgagtggcgacgacggggagccaaacccacgccgtcgagctcgtactcccccgcctcctccacatcaaagtcctaagcagggggaggcgctcgagagggttgaaagatccgcggcttcaccaatcgcgggcgatggaggagaacggcgagatggggagcgtcgcctcctcgtctacggcgacggcagcacgccccagggcgcacttcaggctgctggcgcgctcctacgtcacccgcccgtcgtccctgacccggagtctccagcccagcgatggctggacgacgtggccaacttggtcatgacggcacagcagcgcctgggtactggtggacggtcctccacccccagggccaccggcgccgctaccaccggctccgtgtcgtcaaggcggagggcgcggcgagcggcggctgttgcacgccattcggctgccactccctcatcggcgcctccgactcgggagaatcagtgtggagagccggatgcccgcctcgacatcgagcgccggcgtaatgatcggtgtactccctatgcaacggagggcgcctcttcgtccagagtgtcacctcgacatggacgcgaggaccagccctccgtgcccccggctggtggtgtcggctgtagagcctttgtggcgagtcttcggaatgtccgttggcccccaaggttccggcccaccatcaccgagaagtatgatgggagcgtcaaccccactgagtttctccaggtctatacgaccgggattgaggccgctgggggtgacgacagggtcatggcgaatttctttcccatggccctgaaggggcaggcgcggggttggctgatgaacctgccacccgcgtcggtccactcctgggaggatttgtgccaacagttcaccgtgaactttcaaggcacttatccacgcccaggtgaagaagcggacttgcacgcagtacagcgaggggatgatgagtcccttcgctcgtacattcagcggttctgccaagtccgcaataccataccttgcatccctgcacacgcagtgatttatgcgttcagggggggtgtgcggcacaaccgcatgctcgaaaagatcgcctccaaagagccccagactaccgcggagcttttttagcttgcggaccgagtggctcgtaaggaggaggcctggacttggaacccctccggttccggcgtggcagcttcggccgcccccggatccgccgctcagacagggcggcgtgacaggaggaggaagaagaggtcggtccattccggcgacgagggtcatgtcctcgccgttgagggcgctccgcgggccacccgaaaggggaggcctgcgagcgacaaaaagaaggaggctggtgctcccagcagggagcgcccggccggcaagtggtgctccgtccacaacacctccctccatgatctcgcggactgtcgcgcagtcaaaagcttggctgagcggacgaggaagtgggaggaggagaggaggcaggaacgccgtgaggacaagtccccggcaattccctccggtaaacggcgaagtgaggctaggcagaaggcccccgctgttgacatcgatgacggcgatgatgacctaggtttccaagaacctggggccaccattgccactgtcgatgggggagcgtgtgctcacgtctctcgccggagcttcaaggctatgaagcgagagcttctggccgcggcccctactcatgaggcgacgcgtcgggcgcggtggtcggaggtttccctcacctttgaccagaccgaccacccaccgtgcgttgcccggggagggcagattgcgatggtggtttcccccaccatttgcaacgtgaagttggggcgtgtcctcatagatggaggagcggccctcaacatcctttcccccgcggcctttgatgccatcaaggccccggggatggtgctccggccgtcccaaccgattatcggtgtgacgccggggcacacatggccgctaggtcacatcgacctaccggtcacctttggtggatcagccaacttccgcacggagcgggtgaacttcgatgtggcggacctcagtctgccgtacaacgcggttctgggtaggcccgcgttggtgaagttcatggcggcggttcactacgcctacctccagatgaagatgccgggccccggtggccccatctctatccatggcgacctcaaagtcgcgctcgcttgctttgagcagcgcgcggaccacctcgctgctgcgtccaagcccgagggtggtgacgagaggcttggcacctccgcccccaccgccccgaggcagcggattgccacatgcgacgaggtcccggtcaaggagattgccctgggcgacggcccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgctgtgcggccgggcgcaaggccggtccggcagaaagtgcggcggcaggccccggaacgtcaagccttcatccgcgaggaggtggcgagacttctggaggccggattcatccgtgaggtcatccatccggagtggctggcgaacccggtggtcgttcccaaggcgaacggcaaacttcggatgtgcatcgactacaccgaccttaacaaggcatgtcctaaggacccttaccccctgcctcgcatagatcagattgtcgactccaccgcggggtgcgaccttttgtgttttctagatgcatactctggttaccaacagattcgcatggctagggaggatgaggaaaaaactgcgttcattacccccgtaggaacctattgttatacatcaatgcctttcgggttaaagaatgcaggtcctacttttcaacgtactactcgaatttctttgggtagccaaataggacgtaatgttgaggcttatgtcgatgacttggttgtaaaaacgcgcaaccaagaaactttactctcagatctagcggaaacttttgagagcctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcagtgcgtcaccggttgcatggccgccctaagtcgtttcatatcaaggctgggagagaaggcgctacccttatttaagctcctcaagcgctcggggccgtttacttggacggaggaagctgaacgtgccctcactcagttgaaggcatatctcagctctcccccggttctagtcgccccggagccaaatgagcccctactgctctacttagcggcgaccccccaagtagttagcgcagcgttggttgtggagcgcgatgaggacaatcctcattccgcgcgcccccaccctgtgctgatttggcccgggagcaagcagggaggagaggcccccgagccgaacggtggcctaaggcccctgacgaccggagtcggccctctgcccgcttgtcagacggtgctgggtgcccccgaccctcaggaaggccccgaggccactgcgggaaggccgcacctaacgccctttgaccccgaggctaaccctgtgcggactcgacccgggagagagcagggagaagaggcccccgagccgaacggtggcctaaggcccctgacgaccggagttggccctttgcccgcttgtccgacgacgccagggacccccgacccccaggacggccccgaggccactgagggaaggccgcccctgtcatcctccgaccccgaggccatcggcacagtagacgagtgcgccccgagaggccacttggacgaagaacgcctcggggacacggcccctagcgaagaggatcggccccgccgaaaggtgcagcggcctgtctactttgttagcgaggccctccgggacgccaagacccgatatcctcaggcccagaagttgctttacgctattctgatggcctcgaggaaactgcgccattatttccaggcgcatcgggtcacagtggttacgtcttaccccctcggtcaaatcttgcataatcgagagggtacaggacgggtggtaaaatgggcaatcgagctttctgagttcgatctgcactttgaaccacgccacgctatcaagagccaggccctcgccgattttgtggcagagtggaccccggctccagagaccgtctcaatccccgaggccagcacggacctttcgcagctgcctcacaccgcccactgggtgatgcagttcgacggttctctgtctctccagggcgccggtgcgggggtcacgttgacctccccgaccggagacgtccttagatacctggtccgcctcgactttcgagcgaccaataatatggcagagtacgagggactccttgccggactcagagtggcagccggactggggatccgccgcctcctggtgttaggcgactcccagctggtcgttaaccaggtctgtaaggagtatcggtgctctgacccgcagatggacgcttacgtacgccaagtgcggcgtatggagcgccattttgacgggatagagcttcggcatgtgcccagacgggataacatgatagccgatgaactctcacggctcgcgtcctcgcgagcccagaccccaccgggcgcctttgaagaaaggcttacccagccgtcagcgcgacccgaccccttaggggagacggatgcgcctgaccggcccccgaggcccgtcggagtccaggcctcgggacctgaagggagcgctccaagatcccttagattgattgcttggatctctgaggtccaaacatacctcacagataagactctacctgaggaccgcgaagggagtgaacgcgtccaacgcatctccaaacgctacgtgctggtagaagggaccctctatcggcgcgcggctaacggaatcctcctgaagtgcattcctcaggaacaaggtgttgagcttcttgccgatatccatgaaggcgagtgcggagcccattccgcctcgcgcaccctggttggcaaggcctttcgtcaaggattctattggccgacagctctcaatgatgcagtcgacctggtccggcgatgcaaagcgtgccagttccacgccaagcaaatccatcagccggcccaggccctgcagatcataccactttcatggccatttgctgtctgggggcttgatatcctgggaccgtttaggcgggccccgggcgggtttgagtatctgtatgtcgcgatcgacaagttcactaagtggcccgaggcttatccggttgtcaagatcgataagcactccgcacttaagttcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcctgcggcgctaccatcagcgccacgtccgggcccgatcactctgcgtcggcgacctcgtcctacgccgcgtccaaacgcgtgctggattgagcaagctctcaccaatgtgggagggtccgtatcgagtgatcggcgtcccccggccgggctccatacggctggccacgggcgacggcactgagttgcctaacccgtggaacatcgagcaccttcgtcgcttctacccctgagggggggggggtcgggtgtcaggttttgggctcgggccaaccccgcacccccctcgggtgtgcagggttggccgggggctaccacacatgcacattctcacttctcttatttcaccttttcaataaaagcagtttcaatttcctaaaggctgtttttgtgccgttttttccttttggagaatcttgacttgaaataaggtcactcgtgttcaaccttgccctcgggggctcggttcggtcagctaaaatcgccaaacggggcccagaaccgagccgtgccccggggcgtggtgaactccgagggggaatcggcaaaaacccacaatcgggtcacccataaccctcggtcaccacgttcccggcctggccagtctcgacatgtggatctccccaggcactagccccgacccgagccatttgaggactgggacttgagcacgagcccttaaatcaagctaagacgcaaaagggccacggcacaaatcatcctcatctcatatgcatagcaaagtaaaattaacgcaaagaatttttcatcatttttgattgcagattaagttgatctatacaaaaaagaggcctgaagggcttagaagaaagaaaaagaaaaactggagatcggagggggcctgggggctcaatccgatgcgcccgggtcgccggcctcgtcgtcagcatcgtccgcgccactggcgtcgccctcctcgtcggagttgggggcaaacgcgagccgaggggccgagccctcgaagctgttgacgatatgttcggcggcatcccgaacccgcgcgcgcgcgtcgtcttcggtcccggcagggaactcatccagcgccatccatggggagaagttggggtccctggcctggtaactcgctaatacgagttccactgctccttgggcgaggtccctcgaggatgacttgatggtcttctcgagctcctcggggagttgttggagagcccaggccatcttcgtgaggtgcggagcgaggccttccagattggtggagtgcgttgtcgtctagcctttccagaggcccacctgccgtccggcgcgatccagacgggagactgcgtcccaaagcgtgccgggccctatctcgcccgccaggcgaagggcctcggcttccccggcggatgagtctagcgcgcgctgcatgtcggcgacggtgtgttcggcagctgcgaggcgggcggctaagtcgctttcgcccgtagccgccccgccgctgcgcgccctcgcgtccagctccttttcccgcgcctcgaggttagcagcccgctgctctagcgcggctctctcggcgcggacgcattccagattgcggcgcgcctactcctcctgcgctgcctcgcggagggacaggctgtccgccagccgttgtgccgcggcctcggactccccgagagctcgctcccgctcagcgagcgcgtcctcgcggaggcggagcgcggactcctcttcggcgcaggcggcctcgtgcgccgccagcgtcgcctcccggatagcggcggcggcctcgcggtccgccaagcccctctccacggcgccggcgtgttcttccagcgccatggcacgggcctcaagggcctcctcgcgccgccgggacgccgcttcagtctccgttgctcgctgctctcgggcagcggcggcgtcaaggatcccctggtgtcgaaacatgaattcggcaataataaaagggggtagcgcacgagacctaaaagtggatggatgcagagacaaatgatttagacaggttcaggccctctcaatgagaggtaataccctactcctgtttggggatttgaatccgccgagtatgtattgatctgacgatcaggttgtctcatgcccctagagggggctccctgccctccttatataggttggggggcagggttacaagatagaagccttaaccaatacggtatcggtttcctaaatctactttacaatattatcaaaccaggactttaggccgttccgtaatatacaaggaaacgtaacacccaagtcatgatctgttacatattacaaaaatataagttatcccctataactagtcggataaccatgccgtgtgggtatggggtacccataatctccacagtagcccctgagaccttcacagtcgaaaagataaccttctctcgaactagattactccaaagccgagtgcttcaatcatcttcgccatggtctcccgagtacttttaccaaatctgaagactgtggaaggctgaaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgggtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctaaaagacacatggtttcaccacacctggaaatatatggtatatgtggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccctatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtccattgatggtagctgacgcagttggcatagagacaagacgaccaacatagagataatattgcccaccagaggtggcaaaaatattagtggtagtgaagataatgataccaatcaaaagtgatgaagttgcacagccgtggaggcgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaatcgtgaagacaaataattggaggagagttgatgttgttgcccaactcgtctaaaccgaaatatttgaagttgttgaagtagaatgtctattccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccagtgccgaagataataaagatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtagctgtataaaccaaatgtagaggcgagggcactagtcagcagcagacgagacgaccggcggtgaagaagataaggccaatcaacgctggcagaatcatgcagccatggaagtgaagaaaccagtcggcagccatggcaaacgtaggcagcttgtgttgaagatactgatgcctattagtagtgacagcgatgtagccagccgtgaagaaggtagcatcagttggcgttataatgggccagccgtgcaggcggtgacaccagtcagcggcggatgcggtgaccggtcggtgaagacgtagacgcccaccaacggcagcataataggccaaccgtgcaggcggaaacaccagtcggaggcggcgaaggcaagccggtcggtgaagacgtagacgcccaacaacggcggcataataggccagccgtgcaggcgaaaacaccagtcggcggcggacgaggcggccggtcggtgaagacgtagatgcccaacaacggcagcataataggccagccgtgcaggcggaaacaccagtcggcggcggacgaggcggccggtcggtgaagacgtagacgcccaacagcggcggcataaaggccagccgtgcaggcggaaacaccagtcggcggcggtcgaggcggccggtcggtgaagacgtagacgcccaacagcggcggcataataggccagccgtgcaggcgaggacaccagtcggcggcagcgaaggcaagccggtcggtgaagacgtagacgcccaacaacggcggcataaaggccagccgtgcaggcggaagcaccagtcggcggcggacgaggcggccggtcggtgaagacgtagacgcccaacaatggcggcataaaggccagccgtgcaggcggaaacaccagtcggcagcagcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgttcaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacgatgaaagcgaagacccccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaaggcgtagacgcccaacagcggcggcataataggctagccgtgtaggcggaggcaccaatcggcggcgacgaaggcaggccggcggtgaagtcgtagacgcccaacagcggcggcacaataggccagccgtgtaggcggaggcaccacttggcggcgacggaggcgggccggcggtgaagtcgtagacgcccaacagcggcggcataataggccagctgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactccccaaagcgaaaacgaagtcggcgactcatgaaattgattccatcgcgctcgttgataggaaactcgacgcaacccctacctggcgcgccaactgtcgaaacatgaattcggcaataataaaagggggtagcgcacgagacctaaaagtggatggatgcagagacaaatgatttagacaggttcaggccctctcaatgagaggtaataccctactcctgtttggggatttgaatccgccgagtatgtattgatctgacgatcaggttgtctcatgcccctagagggggctccctgccctccttatataggttggggggcagggttacaagatagaagccttaaccaatacggtatcggtttcctaaatctactttacaatattatcaaaccaggactttaggccgttccgtaatatacaaggaaacgtaacacccaagtcatgatctgttacatattacaaaaatataagttatcccctataactagtcggataaccatgccgtgtgggtatggggtacccataatctccacacctgggcggcgtcgagctttttctttagctccgcctcccagctcccgtgttggagacggagggtgtcctgcgcctcgatcatcacagtggtggcgatgagggcggcctcccgctcctcctccacctctcgggcgatctccgccagcgccgctttgcgggcttcaagctccgagacatgacggcggtgagccttacggcccacctccaccatgacatccaccgagcgccgcccctcctcgacgcgcgcccatgcggcctctcgctccgctcgctccgctcgcaaggcctccacctgggcgctgaacccatctagcaccgcggtgtttgcggcggccaaggcttgcagaaggggctcggcgctcagcggggcgacagaagacgaggagaaaagccgccttggagagaatgcgacgcggctcggcccgcctgaagacgcgctgagctcagggatgtcccccgaacccgtttggtcctgggcgtcgcccgagggagcgggcccaggcgatgcgcccgcggcctcgtcgcgagccgccccggaggctgtcgcctgagcgtcgcccgagggagtgggcccaagcgacgcgccagcagccttgtcgtgagctgcctcggaagacgccatcgcctcagcctggcgagcccgggcggcctcctccttagcggcttcttcggcttggcgagcccgggcggcctcctcccgagcggtatcctccgcctgacgaacccgagcggcctcccgggcggcctcttcagcttcccgtaggcgatctgcggcctctcgccggtcagattctcgcctttgttcctctgcggccgccggatcttcggcctcggactggccggacttgggatggcgggaggaacgcgtcgggatatcactgaagcgggagaaaaaaccagaagacagacaagatggataagagagaacttgcttttgggataaagggaagatggttgcaaaaggcgtgaaacgaacctgcgagggggtcggttaaacgaccacattggaggggaaatcaggtttccccgggatggttccgtctcccccgtcttgcggagccgcttcttcttgcgctccgtctcgggctgtgatgtcggcgcggccccctccgggcgcctgctgctggcacgcaccgccccgccccctcggggaggagatgggggaggtgttcctcccagtttcctcttcccccgggcgtcggcagggcggctgctccccgagcccccgtcgcggggcccagaagcacgaccccctcctggggtagattcttcccggcggctcccgcccacggcatcgtggcccttaggagcctcctcctctgaggccccgacccccatcataatggtcaggatggaggcgcggtctggatcgatgcaaagggggagaactccttgaggaatgagggatgcttccacggagttgagattcagcacccgttggaccaatatcttgaagtcctcaggagcccagtcccatttgactccctggtgggtcctcatgtagtcctcggacccggtgtactcccatgcgctccgggcgcgccgctgaagcggcgcaatccggcgacggaggtagtcgccgtacaccatggcccctgtgagcccctgggatcgcaggcccgccagacggtcgaggacggcgtcatagtcatcccccagatctaccggcgcccgccagctggagacctgcgccgggggctggcttggaagtcggaggcgcgcttcgttggcgaggggggtgtagaaccagtcgctcttccagtcgtcccacttcttgcggagggcgcaggggatgtagcagttcagcaccggcccccgcggctggaagtagcagccaccaaccaccgacggcggcgataccgactgcacggtgaagaaccaccggaacagccgaagagatgggcgcaccccaatgaacatctcgcacagatgcgcgaagatggccaacgtcatcaccgcattgggggtgaggtgcgccatctggagatcgtagaactccagaacatccataaagaaagaagaaaatggcggaaccagccccgccattgcaaaggggaggaagaagacggaccgcccagggtagtcaggtgccgggcgtccctcgcccagcatcactatctcccggccggtggcagactccggcatgaagcggcgcggcagccccgcctgcctctcgctcacgatgcgagaaggcggtagtacgctaccgtcgagcagagcagagccccgtgccatggcgccggaggaagggatgattgagaacgagcgcgtgtggcgaaggtgaggcgcagcagagagagagttagggcgcaagcggcgaaggcaaggggaataatggcgaaaggaagggagcaaatcttttccacggtgtctttatacccttgccatcgctgtgcccggctcctcgtttctcgcgcccactatctcgctccctcgtttctcgctatctcgctccctcgtttctcgtgcccacgcttccactaatcccattcgcccgcttgcggcgcatgaggtggatatgcggttgcggcagtcgagatagatcgtatcgtgcgcgcgttaatcacgctcgtcgatcgaagtgacgttgccatgtctccaggcggagcaaatcggctcgcccagattcgtgcgctgctcaagagatgtggcagtcttgaagagaccgcccattattgacagccaagttaccatgaccgatgtgcatggtttgagaccgttgggtttctgcccaaccatggagaccggtcccacctgtcaccaggctttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcccggcaccctcggggacgtcgggcccgagggtgaggtgtccgccctcctcttgatttccccgaggggggtcgggttactcctgccccggccccgacggccgaggcaccccgacccctaatgaagtttgcgccacatatatgggttaggtgaacacggcagggctcacctaaccgcatttattgcggactggacaggcacgtcatgctgcatgcagcgcagtgcagcacgttcctttatccggtctgtgaccagtcacagaccggtcagatcaacggttaggtggcgactggcggtctgacgcacgcctcgccccgtcccgtcaagacgagagcctctaggcacacgtctccagccggagctagcgtgttacttcttagagatggcacgttagccctggtcagatgaataccaggcttcatcccaaccattacaggcaagatgttacacgaagaagggcgaaatacatgttgcaaagctgacgcgtggtggacaagaatgaccgatttgtgaccggtctgacactgttcatatcgtcagcagacagcctcgttctcacaacgagcctgcctccggcagaagtggtggtaggtatgtgccgtcccgtcagaaggacgttcggagggcaaccatgcaaatctccgcttcatttatgaagagaagaaaagtccagtttggaaagggaggggtgcatgtggtatccccttgagatataaaaggaggaccttgcccatttagagtggggggggctggagattgacgaacaaagaagaagggagagtttggctcacactttgtaactccttcattcatagatccaccaaaacacaggagtagggtattacgcttcccagcggcccgaacctgtatacgtcgcctgtgtctcttgctctttggataggccgcgatctttccacatacagagagagcctgagatctcaccctgagcccccggccgaaccggcaaaggggggcctgcgcggtctcccggtgaggggccacgagctccgtcaatctttttttcgaatggaggagtatctttcaaagtgtgtcatgtcatcatgatctccttctgcttaggtacgttagcattttttttaaaagaaatccaatgcaaaatattagttaaaggggtctaaaataaatatttggtaactagagggactaaatcgaaattcactcgaaaaataaacccctccctctcccctagaggtggccaaatgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcccgcggcacggcacggcacggcacgccggcggcccgtcaggcgcggacaaggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccctagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttgaggcggcgacagcttcggaaggattttccggaaccgcgagcggaagtgtttcgacacacaccggctcgaagagatcgagaacctccgttgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttatttagtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttcctttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctactttatttaaagaatacgaaaatgatgacattctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtgtagacgcctcttcgcatgttgtggccgaagagttgtccggttatttggacagcgacgccatccaccacgaagcacaagatttcaatgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttacaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaatttttttttcttatacatttactttgcttttttttttaaaaaaaaacactgtgcactgcaggctggtggcctgccttcacgggccgccgtgccccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgcctaaacgggccgtgccggacccgtgcccgtgccgggccgggccgtgccgcccgtttggacacctatactctccccccatcgtacgcaacgaaacccgattgccgcgccgctccccgtggagcccaagtggcggcgagggtttccgccgcctctcgtccgcctcgccgacctcggaccccggcctccatcctcctcgccgacgagagcccaagtgtgccgctccccgtggagcccaagtggcggcgagggtttccgccgcctctgctccgctcgccggcgacagccccacgttctcgaccgccgtccccaggtccgcttccggaatctcatcctttgcgggctgatactgcttcgcgcgtcaagccatcaccagctgctccctccgtctccggaacaacaatattctctccgactgctcacgacgggagagcggcgcttcggcgacggcgatcccggtacgcacacgcttgagaggctcccactttcttcattctgctactgtacggttggattcgtgcataacaatcactcaaatctctatgtctaacctgcccatgattatttattaagttcgagttggttgaagaatccactttgttttgggggaacttttacatgatagagaaatgaatggtcttccgttgtgaaacaccatgcttgattttacaggatggtgctgtgttgtctcgtttctaggtttatagactgtcatttgctatagaacctcatggtttatagttaaactgcacattagatctgtcaagagcagcagacaacagtagtagacgttttatttattaaatgatgaactgttggtctcaactctcaagcagtattttgattatctttaattctaagtgccaatagcagcaatagtaatggacgtttctaaatgtaattataaggtttgtgtgcatatttactttgatacaaggatgcataccgtgcatgcatctcaattatctatgccactaatctaatatatattttggagatgaaggaacagcagatggagaaggcaaacaacacaatgtttttcaaccaagcaactatctactctactccaagtatctaagggtaatgatactaatcatatggatcccttaccctcaatttgatatagcgctattgttcatgtgatatgtattgtctagtgaggcatgctgaaatttggctttaggatcaggttggtgagttattgttattttgggagtatataggctcaagagcatctgacacaaaagaactcctactctctaataaaattattgtgtgctatttatggggctgcctaggtgatgaggaaagaatgagttcacaaacgtgttaaactgttaatccagtatccctgaaaagtaggttggtttaatttaagttcaaatgccttgtggatttcaattggtttttatggctgatcttttgcggactgggatggaagtttggtttaatcattttgtactaggttagcttgtccatttctcttatgctctcgttggcatgttgtgttcttgctggatacttattcatctcagtaccttcatgaaagtggggtcaatgtcatccataactaggtcagtaaggactatgcgcaagaactgagtcgagtctatgtaaaagtagttgtccttttgatatggtagaggaattggtaggactgcttaaaaatagttgtccacgtattcgtttttaggtaaatggtgttataggactgcctaaaataaattggttattatgaactttgattgatcttatcagttcttgccctcttgctatgcactaagtagtcacctcttagcatttatcatttcatttacatgtttactctatagttcagtagttcttttgacatgattggtgtcttcgattttcttccatagaaatgtaagttcgaaaatattgaacatgtttgatgctttaattgtcgttggggcagtcactttaggctgaagaatcattgtagcgaatggattatcaacaatcagatggaatttatgacatgccagatgaaccattgtttacactaaatttgaggttgagccacagcaatgacctggatagagttcataaatctttcaccagcaagattgataaggcccgaacgtatctcacgggtaggttcagaaggattgtcaaggtcaaaggttctaagagaaaggagttcgttcttacccctgaaggccctgatgtttttaccattgctttcactgatggtactaacagagtaactgccataattgaagagagaaatatgtggttgagaggtttccaaactgcagacggacacatttttgagtttaatgatgaacacggcaatgaagggaaggatgctaatctggatgacaagactgatgaaatgaataatcagttcaatggtaatgacaaaacaagagatgaggaggtgaaggatgaggaagaggctataaaggaccaaaaactgaaggttataaaggacccaaagatgaaggctataaaggaccgagggatgaacaagcactgcaaacaaaaagaaaagagcaaagcagcatgtggatccaaaaagaagcaagtgaataggaaagaccaactcaatccaaaaaagtatattagaggatctgttctcttacggcatgatagcaattatggttctcttcttggacctaacagactgcctctgtttcaagtagtatacagtacaatgagggatatgctgcagaatttggctcactttgatccaaacaactattcagataaacacaagcgctcgatggctgcactgatcatccatacagctgagactttgaagaataaatatatatcaagtcttgtgttaaattctttcaatccacatattggtgcaaggcttcaagcactggatgatatgggagcagcacatattaacgggtggtctacagcctctgaattaattttgaaatccattcacctcccatcaaaggtttgggactttcaacagcaagaattttccaagtgcaatgaattttacaaaaatcag

SEQ ID NO: 56130 - DNA, 4298 bp, Oryza sativa
cagtaagctttctgttaaagatggtgatacgattaccatatcacatagtctgtgttagatgtattgtatagctagctgtgtatttactcccttcttgagggtgctttcttcatatttgtattgagctttgtgtatatctgtttggcccagttggcccatttaatctgtggtccaatatttgcaacatggtatcagagcatatggtttagggttccacatccgccgccgtcgtcgtgaagctctctctctcctctcacgtgactggatccctcttctctctcgcgcgagcgtcgccacctctgccctatgacctcgcctgtggtcgccgccgcgccggcagtgtcgccgccgcgcctctgcctcttggggtcgccgccacgccaactggagtcaccgcccctcttgcgggcgccaccttcctctgctcgcgggcgttgcctgcccctgctcgcgggcgccgccgttcctgctcgcgggcgggcggccacgggcgggcgctgcctctgctgccgctgcctgcttctccctcatcttccaccgtctaaagctactgcctctactgtgatggcgccgccctcgggaaaaccgggtgccatttctcttctgaagcctccggtcatcttcaacggactcaacttccgggagtatgcattgcatatgcagatacacatgtgcagccagtggttgtggggctacctcatcggcgatcggccttgcccgccttgtccaaccttgcctgctgagcctgccatctcggcagatgctgatgagaacactaagcgtggtctccttgatgatcttgctgctgctatggaggcgtatcaaacagatctctctctatatgagacttggttagagcaggaggcctatgccaaggctattttggttgggagcatggaggttgacatatcactcgacattgcgggccttgctagctctgagttgatgtggacccgtcttcgctagcagtacgagcctcgcaacgatgccatgtttcttgccgttgtgaatgaggcacaatctcttcgtcagcttgatgccactgtggatgagttctttcgcaagatgtctgcggtgtggcgtcaaatggacctacagggcgctgatgtttgtcgcacttgtacctgttgtcagcgccagagggtccagactgagaccactcgcctctatgagttcttgtctcgtttgaggcctgagtttgagcctgttcgagctcagctgttggcacgacgccctcgaccttcattgttggagaccttgcctgagctacgggctgaagagactcgttgtcgtgaggctggtataggcattgcacagcagtccacctctgtcttggttgcacagggcttgccttctcaggtccatgtctctgcccagcctgttgtggtgccatcacctttacctgttgcggctggtgctcctagtactccttcaggcattgtttgcgggtactgtagcaagacagggcacaccgcctctatgtgctacaagaagaagagagatcagagtcatcgcacctctcagggctctcgacagggctcttctcagtcaagctctcagcagatcacatcgaccgagcaagagcttgtaaggctccttcgtcgtcttatgactacagcctctacctccacccatgggtctgctgctcaggcttctagtcttccaccaccacctccatcctcttcaggtatattgtcctcgtggtttcttgattctggtgcttccttccatatgacacccgattccacacatctttcttctatgagtcctcctgatacccctctcacagttcagacagctaatggcacctcacttcctgttgttgatcgtggcacactttctacttcttcctttcgagttcctactgtctctcatgttcctaagttaaccatgcagcttatgtccgctggtcagatcactgatcatggttgtcggattatacttgaggctgactcttgttgtgtccaggatcgtcgcacagggctcctggtggggactggtcctaggcgccatgactctcagcgtctttgggagcttgattggctacatctcccttctgatgcttctaccagccagtcagtcggttccactgcttcagcgttagctacttcagccactactacttttgctcagtggcatcgttgtttaggtcatctatccggtgctagattatccacacttattggtagttggggtcttaggtcctgtttctggagacaccgctctacattgtacgggttgcaagcttggcaagcagctgcaactcccctattcttctagtgcctcagagtctcagcgtccttttgatcttatacactctgatgtatggggacaagctccttttgtttcgaaaggtggccattcctattatgtgatctttattgatgactattcgagatttacttggatttacctcatgtcttctcgtagtcaatttctttctatttatcagcagtttgctactatggttcgcactcagtacgattcttccatacgggtttttcgtgctgactctgttggtgagtacatttcggcagcccatcgccgttttctagctgagcagggaacacttccccagttttcttgccctggtgctcatgctcaaaatggcactgctgagcgcaagcatcgtcacattcttgagactgctcgtgccctaatgatctcctcgcatctttcgcctcatttctgggctgaggctgtctccacggctgtttttcttatcaatcgatagccttcttctgttcttcatggttgtactccctatgagcgcctatttggtacacctcctaggtacagtcatcttcgatgttttggttgtgtttgttatgttcttctttctcctcgtgagcgtaccaagctgactgcccagtctgttgagtgtgttttccttgggtatagcactgagcataagggttatcgttgctatgatcctgttgctcgtcgcatgaggatatctcgtcatgtcacatttgatgagtctcgtccttactatcctcgctcttccacttgtgatcagtcctccactgtcaaatctatctcctttttgactcttccggattggtcctttccttctccaccaccagttccgtctccatcaccacacctccctttggtttctacgccatctccatcactgtcaccacctccttcgccgatgccatcatcacccatactaccatcaccacctcctagtactcttttagatgctccacatgagctagcacctttttcgctgcactactctcgtcgttcacgaccccttgttgagttgtcctctccctctatccttggaccagctcctgctcctgcttctcggtatgatcttcgtgatcgccatgctattaggcctgcgcctaagtatggctttactgctgcggctattgttgagcccacgacttaccgagaggctattgcccaccaggagtggcaacaggcgatggcagaggagattgctgccttagagcgtaccaagacttgggatgttgttcctgcacctactcacgtcactcctatcacttgtaagtgggtctacaagataaagactcgctctgatggctctcttgagcggtacaaagctcgtcttgtagctcgtggttttcagcaagagcatggtcgtgactatggtgagacttttgctccagttgctcacatgaccaccattcggaccctgttagctgttgcctctattcgtcagtggtccatttctcagctcgatgtcaagaatgcctttctcaatggtgagctgcatgaggaggtctatatgcagccccctcctgggtattctgtccctgatggcatggttcttcgtctgtgtcgttctctttatggtctcaaacaggcccctcgtgcctggtttgagcgcttctcctcagttgtcactgatattggcttcaaagccagcgaccatgaccctgctctctttgttcacacttcttcttgtggtcggacccttcttcttctatatgttgatgacatgatcatcactggtgatgactctcggttcattaatcttgtgaagaagcgtcttagtgaccaattcttgatgtctgatttgggtcctctcaggtactttcttgggattgagttctcttccacgtcttctggtttctacctctcccaagagaagtatattcaggatctccttgctcgttcgggcctcactgataagcgtgtggttgacactcctatggagcttgggatacatctacggcccaatgatggtgagcctcttcaagatcccacccgctatcgccaccttgttgggagtcttgtctatcttggcggggctgcaggaa

SEQ ID NO: 56131 - DNA, 1421 bp, Oryza sativa
ttcctgcagcctggttcctctctgattgcatggaagaccaaaaagcagactgcagtttctcgttcaagtgcagaagctgagttacgagctatggcagccttgaccgctgagatcacttggctgcgttggctcctggaggattttggagtttttgtctctcccccgactccactcttgtcggacagtactggtgcaatcagcattgctcgagacccagtgaagcatgagctaaccaaacacatcggcgttgatgcctcatacatgagatcgcaggtgcaaaatgaggttgtggctcttcagtatgttccttcagagcttcagttagcagatttcttcacgaaggcgcaaactcgagctcaacatagttattttttgtccaaactcagtatggttgatccaccatgagtttgagggggggggggtgttagatgtattgtatagctagctgtgtatttactcccttcttgagggtgctttcttcatatttgtattgagctttgtgtatatctgtttggcccagttggcccatttaatctgtggtccaatatttgcaacagtctgaatgcatctgttggtgtggttgttatgggtggcattaaccatattctgatgcataattgggaggtaccatgtgcagctgaaatttccttaaaggcaagttcttactcagcaaagatccctatcgttgaaggagaggttaaagttttcaccgaccatcacaatcaactatacacctctcatctaaaactaagttcaaaagaaggtcagaaggaggtttaagtgcgtttgtatgttgatggctttttagcattaacagcgaagtcttgtcaagtggagaatgaagaagttttgcgggatgaaaagggcgaaacatgtacagataatgataaggtaattgccattctgctttgagtatgccaatgcaccttaatttatgttcatggaaattttttatctagtgttacaggatccataaagatctgattatgaagtatagggatacaattgataaaatgatcgctgagaaggcgaagagagctatgaatcttttcccctctacagacccgctgctgcttctgtccagtgagaccgagagcatgctaaaattgccttagagggtaaggctatgagcttcttcttcttcttcttcttcttcttcttcttctttttttttttttgcattttataatatcaacagaggtttttacatgtgtgttctttatttccagctatggagatgtgtaattcgaggcacttgttatgatccatttgtaaaatcaaatgtgtttttgattattattctgtgatgaacaattgggcattggagattattggttttgttatttggaatttattcacgaagtggttttggagatgattggattcacaggtgaatatacaggtactgctgtggttttatg

SEQ ID NO: 56132 - DNA, 1122 bp, Oryza sativa
ttgagttttgagttagggttttgagtttagtcgaaatttttgtaaggagtgctgttggtgcactttgtaaacacagagagaagtaataaagtcgtcatccactttaagagttcttcgatttatgtttcaccgggtttcggcggtctaactggcggcgcaccggcggtcagaccggcggcatcgcggcggtccgaccggcgaacacacgacggtcagaccggcggcgacaggagtccacggcaggctttctcggcggttcgaccgatcgatctacatcggtcagaccgacgttcatcaggcggtcagaccggcgcaactacttcggttagaccgcgatccatcgatttcgagggtaacttttatttccgctaaaagtttttcggtttttgggtataccaaccattcaccctcccctctggttggcttagttattgtgattcgatcgtacaagtggtatcagagcctcgttttcttttttggatttttatcgatctaaagttttttttgccatggctactcccgctaggttttcaactaagcctcatattttcgatggaactgattttcctcattggtgtagtaagatgcaatcttacattatggctgaaaattatgatatttggaggaaagtttctcatccttatgtgattcctgaagccattaatactgatgctttaaaaactgaatttgaaaataattgcaaagctcgtaatattcttttgagtgggatttctcgttctgattatgatcgtgttgcacatcttgaaactgctcgtgagatttggaatgctttgaaaaactttcatcaaggaacaaataatattaaagagcttcgttgagatctttttaaaaaggagtacattaaatttgagatgaaatctggagaggctttggatgactatctttctagatttaataaaattttgagtaatcttagatctgttgattcttcttatgatgctaattatccacaatctaagatttctcgtcactttttgaatggtctcgacatgtctatttgggatatgaaagttacatctattcaggagtctgttaacatgtctactttgactttggattcactttatactaaattgaaaacacatgagatgaatattcttt

SEQ ID NO: 56133 - DNA, 4206 bp, Oryza sativa
taatattcttttgagtgggatttctcgttctgattatgatcgtgttgcacatcttgaaactgctcgtgagatttggaatgctttgaaaaactttcatcaaggaacaaataatattaaagagcttcgttgagatctttttaaaaaggagtacattaaatttgagatgaaatctggagaggctttggatgactatctttctagatttaataaaattttgagtaatcttagatctgttgattcttcttatgatgctaattatccacaatctaagatttctcgtcactttttgaatggtctcgacatgtctatttgggatatgaaagttacatctattcaggagtctgttaacatgtctactttgactttggattcactttatactaaattgaaaacacatgagatgaatattctttctcgcaaagttgattctaaatcgagtgctttggtttcttcttcttcttctttggttgttgatgtttcttcatctatgccttcttttcttgctgcttttaatgccacatccgatgatcaactcgaacaaatcgaggaggaggatttggctttggtcgctaacagaattgctcgagctatgaataatgccaggaacaggaaaagaggtggtccaaatcgttgctttgaatgtgattcaattgatcatcttcgttcgcattgtcctaagcttgggagaggcaaaagagaagacaaagatggtgagaagaccaataacaacaagcccaacaactacaacaagtcaaagggttctaaccaagggaggaagatggagaatcttaggaaggcttttcaacaagtttgcgccgctttcgagccactaagtgatgtagatggtgaaagtggagatgatgataatggaaagaatgtctctgatgtttgcttcatggcacgtggtgaatctgacacagagtaagaagacaatgaggtgagtgcttttgaggaagctattaatattttgagtgcaaaaagtaaatagtgtgagaagatgtataaaaaacaggaatttatcattgaatctcttaaatatgaaattaatagattaaaatctcttattccaaatgatgatgattgtgaaaattgtgaggttttaatgaatgatatttcaaaaattagagatgttaatgctgcacatgatttgaaaaatagatcttctcttgcttgtagttttgctttgcatacacgcactttggatgagttgtttttaactaaaaagttgttgcaaaaatatcaaattgcttttcatgctagtttgatgtttaacatgatttctgctaaaaagttaaaacaacctcatgatgttttggattgctcaacatgtaatttaaataaaatgaaactaaaagatgctttaggacgtgttgagtatatggaagatgttgtaaaaaacaatgaagtgctttctttccccaaatgtcgtaaaagcaaaggtgtaatggtagattgtgaaaattgtgctaatttggaaaaagaggtttcttatttgaaaaattccttgctaagattttctgatggcaaaaagaatctcaatatgattttggatcaattaaaggttagcacaaataaccgtggtttaggttttgatccttatgctcataactctagacatcctcctgttgtgttaggtgttggtgctagaggtggtgagattttgattagacatgatactaataaaactgtgtttaaatctgctggtatcatgtctaccatgaatgcatcttcttcaaaatccgatgttgtgcatgcaaaacctcttgtttctgcttgtgttgctaagacttctagttctagcaatgtgtctacacaacgtgagaaatatacttgttctttttgtggaaaagatggacatattgttggtttttgtttcagattagctcataaacagaaaaaggagagagagattgcttttgcaaaatcaaattggcaaaaatctggttttccctcgaggaaaccggtcagaccgcagtgggtcccgcggtcagaccggcgaccggtcagaccggctgaacagcctcggtcagaccggacaccggtcagaccggcggtacagaggcggtcagaccggcccccggtcagaccggccactgtacttcggtcagaccggcctcggaggaatttttctgaaaattctaaaattgattttgcacgtggatatatgcctattggatcttctggtcgtgtgtctcagtactggattcctaaatttttattatctaaccccagtactgaggcttcgacttctgctgttgtgtaggctttggtggcaaggaaggagaacgtgtggatcgtggattctggttgttcgcggcacatgaccggtgataaaaattggttctcctccctcaaaaaggcatccaagactgaatcaattgtctttgctgatgcttctactagtgccgttgtcgctataggtttggttaaggtaaatgaaaaatttgaattgaagaatgtagctttggttaaggatttaaaatacaatttgctttcagtttcacaaattgttgatgaaaattctgaggttcactttaagaaaactggaagtaaagtttttgattcttgtggtgattctgtgctgaatatttctcgctatggaagagcgtttaaagctgattttgaaaattctgtttcacctgtgacaacatgtttggttgctaagtttgataaagatgtgatgttttggcattgtagacttggacatgttggttttgatcatctcactaggttaagtggtttggatcttgttcgtggtttgcctaaacttaagaaagatcttgatttggtttgtacaccgtgtcgtcatgctaagatggtttctcttcacatgctcctattgtttctgtgatgacggatgcaccgggacagctattacatatggacactgttggtccagctagagtgtaatctgttggaggaaagtggtatgtgttggttattgttgacgatttttctcgatactcttgggttttctttatggcaactaaggacgaagcttttcaacactttcgtggtttgtttcttcgattggagcttgaatttcctggttctttgaaaagaattcgaagtgataatggtggagagtttaaaaatgcttcatttgaacaattttgcaacgaaagaggtcttgaacatgaattttcttctcctcgtgttcctcaacaaaacggtgttgtcgaaaggaaaaatcgtgttttggttgagatggctagaacgatgttggatgaatacaaaactcctagaaaattttgggctgaggcgattaacactgcttgctatatttcaaatcgagttttcttgcgttctaaacttggaaaaacttcttatgaactttgatttggttatcaacccaaagtttcacatttgcgtgtttttggttgcaaatgctttgtcttgaaatctggaaatttggataagtttgaggcacgttctaccgatggattgtttcttggttaccccgcacatactcgtggctatcgtgtacttattttagggactaacaaaattgttgagacttgcgaagtttcctttgatgaggctagtcctggtactagacccgatattgcaggtacactgtcacaggttcagggggaggatggtcgtatttttgaagacgagagcgactacgacgacgacacgaggtcggctcggccggtcagaccaggcaccaggccggtcagaccgccggcacacctccggtcagaccggcccatgaggagcggtcagaccggccaggtttgtcgggttcgggtactgttgatgtagatcgagatggtcctccagagaattcaacttcgaccagtactggaacaaaacgtggatcaacttcagaagttgctgctcctttgtacattcaacgacgacatccgccggaacaaattattggtaatataggtgagcggactacaaggtctaaggtaacgactcatgatgtttgtgcaaattctgcatttgttgcttcttttgaacccaaagatgtgtcacatgcattaactgatgaatcgtggattaacgccatgcatgaagaacttgaaaattttgagagaaacaaagtttggactttagttgaaccaccttctggacataatattattggaaccaagtgggttttcaaaaataaacaaaatgaggatggtttgattgtgagaaataaagctagacttgttgctcaaggttttactcaagttgagggtttggattttg

SEQ ID NO: 56134 - DNA, 12256 bp, Oryza sativa
tgtgtgtttgtgtgcgcgctttcaagcttctcctcgtgcttcacatcgtcaagcggtcaaacgaataatgaggtatttgaatcatacacttgagtttggaatttggtcttctacttcatcttctatatgcttaagtggatattccgatgctgattttggaggttgtagaattgataggaaaagtactagtggaacatgtcattttcttggtacatcattgattgcatggtcttctaggaaacaatctagtgttgctcaatcaactgctgaatctgaatatgttgctgctgctagttgttgttcacagattctctggcttttatctactttgaaagattatgatcttacttttgagaaagtacatctcttttgtgataatactagtgctatcaatattgctaagaatcctgttcaacactcacgcacaaagcacattgatattcgttttcactttttgagggatcatgttgagaaaggagatgttgaattgcagtttttggacacaaagttgcaaattgctgatattttcactaaacctttggattctaatcgctttgcttttcttcgtggtgaattgggtataattcatccttttggcatggtttgagtgggagtttgtatctcatggttttatcaagcaataatatgacaatgaaaaacttgagaaaagagagctttgtttatgcatatggtattttcttgtgcatgctagcaatactttgaaggtttatttgtctctagcatagcttgtatgtattctagtcttttcatgagatttagattttgcttttaagggagatgatgcatgacacttaaattctatacttgaattaagcaaatatgcaatgttgatgctaccatatggtttgatctataaatgctttatatatatgctttattgacttgttattcctcaaatagctttaattgctcattgtgcaaaagagaataaaactatgaaaaaaatgaataccgaatccttggaaacagtcttgacgacaaggacgtattcgatgtgagcaaaataatgggtgccgaatccctggaaacagtcttgacgacagggacgtaccctgaataaaaagagaaaaatatgagcaaaaaggctcaagaaaagaaaaagttaaaaaaaattctcttggttattttgtgctaaaaggttatttgagaaagagtgatcaatgcaataggtatatgtgtttagtgtttgttcttcaacctatgtgcttgttaaaatgttgtattataaatcgtatgaaatcatgaattttgattgttgattcaagcttaattgtaaaatctttggttcatggttttactttaatgcatgcttgttttgttatagatgggtttatcttctttttattgcaacacatgacttgatatgctatatgtatgctaagctcttgaacattaatgaacataattcctatgcttgatgaaatcattgtcaaagggggagaagtaatgtaagtaatgtgaaaatttttggatttttggaaaattcactttcttttcaaaattcactttgaagtaatgagaagagcatgttgttggttcaattgggaatttctttcttttaaaaagggggagaagttttcttttggatttttgagcacgatgtgtacatttgtacgaagtgtgctttttaccaccaaatatcaaaacatttttataggtttgccaatgtgttcatcaagggggagattgtaaaatcaaagatgtttttgattattattctgtgatgaacaattgggcattggagattattggttttgttatttggaatttattcacgaagtggttttggagatgattggattcacaggtgaatatacaggtactgctgtggttttatgtggaccggtcagactgggctctggtagccggtcagaccggcgtgtaatgcgcagtcagaccggcgcagcccgcggtctgaccggccgacactgtgtcggtttcggtttcgggttgtttatttggatatccgagtttattccatgattatgacttctagatggatactacacgtatgtaatactattgtttgctgctaatgagtcaagttggagatagcttggtctcggaatatggtttctttgtttgttccatgtgtaggtgactcgatgtctcgggagagtatttgcggtgatggaccgggagtcggcttggggattagacgacgtccgtggtggtcagagatcatgtgggatacttaggctagagttgatgcacgtggttgatggagattccatatggcatacgatggagttattgtgtgcgtatgggatgcggagtcgaatttggaaggagtccaaatttggtacgtttggttatgtaaagtttctttcttgtactagtgggtttcctaaggtgtttagaactcctagtatgagtttggttcgtggctttaggctgcctacttcatgtataaatagagggggagcgtgaggcttccctgtatcgcttttgagagcaattgagttgagttttgagttagggttttgagtttagtcgaaatttttgtaaggagtgctgttggtgcactttgtaaacacagagagaagtaataaagtcgtcatccactttaagagttcttcgatttgtgtttcaccgggtttcggcggtctaaccggcggcgcaccggcggtcagaccggtggcatcgcggcagtccgaccggcgaacacacggcggtcagaccggcggcgacaggagtcgtcggcaggctttctcggcggttcgaccgatcaatctacatcggtcagaccgacgttcatcaggcggtcagaccggcgcaactacttcggttagaccgcgatccatcgatttcgagggtaacttttatttccgctaaaagtttttcggtttttgggtataccaaccattcaccccccctctggttggcttagttcttgtgattcgatcctacaccattatcagcttagcaactgcaatctcatcgatgatgtcttcactgtcaagaaacttccttttcagctcaggaaatgctttgtaatttgagtctcttggctatgatacaccaaacaaggaagcagtgcaaaactcttgtttacttctgtaatcctagttcatttctgttaatgtaaatggagggcccaggccctttagtcaaaaaaagaaaaaacaaggaagcagtgggcgacctcatttattatttttactgtctcataagaaaaatttccaagtcaatgtacgttagaaattgacgtacttttgttattttgataacactgaggcgctggttggtatgttgttgaaacttaaagtgtagtccgcgtaaagtgtatcatgttacgttgttgtgatattgtttgcttctaaggctaatcattcgacacgattactgttgctgatcattagatattgagttaaaagcataacctaatcatattgctattactccattagaataaggagagaactatataaaggagctcatgtaccatattacgtaccagctatatctttgttcttgtcgacagcaaagctctccatggacgctgtaaaaagattatggaattgctaaacataagctgagtaaatttttttgttttcaatcgaatcccttcctgtttgatctgcgttttgataatgctttgaatttttataatcatttccattccgaacgcgcgttgcatcacgcatggcgagatgcattgccgtgcgcaaccacgaggggattagcctcttagttttctaccgatctttccgtcaacgcctcgcgttgacacgtacgccggtacgctcgcagccgggggttggaccctgggtgcctagccagacgcccacgcactaggtgggccatgtttacgaggcttctctgctcacaactagtaggaacaaaaagaataaagtccactaatatcccttaagtataagtcgaattcaatttgcgcctctcaactgcggtgcaattcaactcacaaaaccaatgcaaatatagtactttggcagtccgggatagcggtttggcacgttaatttggtccactcatgctaacgtgttgcttgcgtggcaattttatcataaaaaagaattcgtgggccaaatgtcgaggagggtaatttcttggaacaagttcacttgttgtccctcaactttacgccgagtctgtataacatccctaattgccaacagaaatatctacccctcaaataatcaaaaccgtgtaaaatagatcccatggcagtatatatgggtgttttgttgacgtagcatcctacttggcattctagggcccacatgtaagtgggaagaagaaaaatgtggggtctgcatccattctttcctctcttctcttttctcttttctcttttctttcttttcttcttcggcgagcctgggaagtcatcgtcgccgggcggaattcgctcgccgctgctcctcctacggccacctccatcgttgttgccccctccttcgcccgttgtctgctctgcctcgcctacctgctttacccgccgctaccccaccaagcgtctaccccctctgccgcccgctcgctcgtgtcgtccctcctgccgccagttgaagagaagaaagaaaagagaaaaggagaagaaagaagagatgggaacccacatttttttctcacttacatgtggatcccataattttttgtattattattttgatgactaggatgccacatcagcgaaattagagatcctatattgctataggacccaaattacacggttttgtaaaatttagggggtgaagatttctggtattagctgatgagcttattcttaaattctttcaccccatgggcccttttcctcttttgatctcctcctcgctgcactattgtaacattctgaaaatgtgtcattttctaatcttgcatcatgctgattcttatgttcttaataaccttctaaacctaggaaaatataattagagggacctcctaaaactaactcgcataaaacctctctggtatttaatcccttttgtgtttttcatttaaaaacatatttggtatttcttgttgaaattctattttcaaatattaaaccttctttcgactaaaactcttttattcaaatttagtttaaaaaccatttttattattatgaattatggtccaagaaatcctccaatttttgtccttgaacctagaccaaagtaattccaatctcattggaattaattgttagcccatcctttgatcttaaacccatcctttgattcttgatccaaatatccaaattcctccttttgatctagccaccaatttaatttctgtagcttgatttcctctttggcacaagaattgtattattgcaaatattgtgaataattgctcttgtgctaagaaaattccaatttatattcttcactcaacttccccttttagccacaaatatacataacaccaattttagagttcaaatcctatttattgccttcaactaattcccttctatattcccaaaaatattttgaggaatattattaatttccattcctatttgagtgcttccaaataaattccctcaaactccacctctaaatattgcactcaaataaattaggaaatatcttttgtgaattctttccaaattcaaattctttgcaaaacctagttatccaaatcaagtattcaaattaggcttctttctttttgtcatcgggccgaaactccattctttcttcctttttggcccaatcccttttcttttatcttctattttcctcctccttcttgggctgccggcccagctaagccgagccggcccaaatcggcccacaccccagccgagccgccgccgcctcctggtgcgcgtgccgtgcacggcgcacgccgccgcaaacgtcgccgctaagaaacataaatcggcgccgacatcctcctcctcacgccactgtcgtcgtcgtgttcctctttccctcctcctccagaaccgcctctccccaccgccttctctccctataaatagccggccatccctccccttctctacatacaatcagagctccatctctctttctctcccatgtccggccatggccgccaccacccgatctccctcaccggagcttcgcaagccaaaccatcgcgccatcgagttcgcctcgacgaggtgattccatttttcctgtttcccccttctcccccaccccatagcaaccaccaccgccacctctctttgccgccgaagataagctcttctactcgccgttccggccatctccctcactctctccgccagccaccgccctccccgggtgcgtcgtgctcgggaacatgtgtggccgccgacgtcgccgcctttcgtccaccggagagccggcgcccactctctccctctcctctgtagccggcaagaaaaagaagaagagaggaagaagatgacgggagaaagaagaaggagaagaaaaagaaaaagaaagactgacaggtgggcccctgcacagtgacttttctcattttctagatttaattcaaatcctattctttagaagcacatatctcctaaaccgtagatccgattctagtgaaacttggacctaaattcatctaaattcaactcttcattttgatatcaaatttgctattttaagattttatttgaatttccttaatttattcaaatgccatttgaataaatatttgatttaatcttataattgaatttacaatttaaacttatatttgcttttcaaatattttcttttatttccaaaatgcccgttagccactaaaaagccgccggttggaactttacgccttccatggggacgtttgcgcggtctacggacctcaacgtcggaccgttggttgtaaagcccggcaaaaaccaaacctaaggtcgaagtgctgctcctggcaccccacgccttgatgcgtacagcggtcggagcttcactatcccctcgacctccattgcacgccgcacagttagctcttgagctctgtgtgatcctagccgctctgccgccactcacggttgtcggagtaacacttccgccccactaaacctgcacccacctcctattcttctagccgatatgttgtctatcgacacggctagaaataataccaaacctagtcgtcatgttgtccaactctagcgacgactagcaaacacccaaaaccctagccgatatttatcctacctcgatatcggcctaaacaactaaaccttagccactattctatcaaagccaaccttaacccatattagccacatgcctatttaaccatatcaactattcagtatatttcctatcgtccaaaccacgagagcctccacataaaatatagagcctagccgagatactgtcctactccacagtcgactcccatataactaaaccctagctattatactaccaaaacctaccactagcaaatactagccccataatccctataccctataaaagagataggttataccttaaaccctagccctcttagtcgtttatcgttttcttattattttatggcttttattgaatttggttcttcctctttctcagtaaagactattgtcttttggatggcaacctatggtatttcgagaatcgtataatcaggttgcctatcttggattcatttgcgttggagcaaggcaagttattattcctccccttgagcataattatcctatattctatatctctattctatgcattagccattcatgattttgaatgcataacttgaacatatagcaaaccagttatatgctagcttttgcttagccctgcctagttagattgcataaaacataatgaacttagattgggacagtacgcaagatttggttgatttccgggtggctagtactgtctcggtcgatataagtttaccaagtacttatgtcaaacgaacgagtacgaccgcagcttctagaatggggacagacctagatattatgttaattaacagtgtggtacctctgtacagtggttcttatgtaagtcctcgcgaaggaggcaaatatatgccgcgaagggcaaatgtgatatttaccgaggcgcaggtaaatatcttgattatcgcgcgatgtgtgtgtgaatttatgaaaacctggttgagatgacatggggtctctcatccagttctctctaaaaaccccgggaacgccagaactcctctcgctgctgataacgttacattcagagcgcatggggattagagttcatggaacaagtgccacaattgttaataacctaatactgggccatgactaagctaatgattattggcaagtcgtggactgcgggtaaagcgtacatctactgcagtatgaatatccttgaatctattcgaatagccgtgctcacggattgagcatcgggactcatatggtactttggttagaaatataattcaagattttcttaaatactgttgcatatcaagcatttcaggatttctacctctttattctcagctttctgcaagtaaacctagctctacacagatattaccatttcatatattcattattggttaatataatagcttgctgagtacgttgtactcacccttgcttcaacccctctttttcagagtttaattggagtttttgccgaagctgggagttcaatcacataagttagttccctttaaacctaatcttcaagtctagtgtagttagatggtttaattctatagtaaaacggcagagttgagtcatcgtatagcctctgctgtaatagttagccacaaacttgtgaatgtcctattattttatataaagatatctcctttgaagtctttaccaaatgtatgcgatgaagatccagattgttgaacctgtatcaatctactgatccagagcttgatacagttaaacatgtcggtttctgaatcgttagttttgggatccgacaactatgcattagacgaacgatggcggcggcctaagtttgttcaaatttatagtactataaaatgttatatctaattctaagtttttatattttgagatggagggaataccagtatttggggggaaaaaattctaaagtgaagtaaaggtaagaaaaaacgtgaaaatattagttaaaggggtctaaaataaatatttggtaactagagggactaaatcgaaattcactcgaaaaataaacccctccctctcccccatcgtacgcaacgaagccgattgcctagaggcggtctcgccgcgccgcttcccgtggagcccaagtggtggcgagggtttccgccgcctctcgtccgcctcgccgacctcggaccccggcctccatcctcctcgccgacgacagccaacgtgtgccgctccccttggagcccaagtggcggcgagggtttccgccgcctctgctccgctcgccggcgacagccccatgttctcgatcgccgtccccaggtccgcttccggaatctcatcctttgcgggctgctactgcttcgcgcgtcaagccatcaccagctgctccctccgtctccggaacaacaatattctctccgactgctcacgacgggagagcggcgcttcggcgacggcgatcccggtacgcacacgcttgagaggctcccactttcttcattctgctactgtacggttggattcgtgcataacaatcactcatatctctatgtctagcctgcccatgattatttattaagttcgagttggttgaagaatccactttgttttgtggggaacttttacatgatagagaaatgaatggtcttctattgtgaaacaccacgcttgattttacaggatggtgttgtgtcgtctcgtttctaggtttatagacggaaggacctgctttttatgtgacctgtcgtttgctatagaacctcatggtttatagttaaactgcacattagatctgtcaggagcagttgacagcagtactgaacgtttctcgagaatgttgaaatgttggtctcatcagtattgcacatttgttgacaatccataactattagtggccaatgtgaacatttcttgtaaaatgtcaatcgcagtagcaggctagcagcagtaatgtacatttcttcaaaatgtaattccaaggtttgtgcactatttacttcaatataaggacgcatagcatgcattcactgttgcacctcaattatctatgcgactattctagttttattttatttttagatggaggagcagcaacaggaggagaacagcccagtgcttttccgccaaaatgcaaattcttctcttggcttgctacccagaataggctatggacggctgacagattggggaaacaaggctggcgaaatcaaaaggtttgccccctctgccgcacaatcgacgaatcagtgcttcaccttctggccaaatgtagagtcactaagaggatttggacagaaatccagagatgggcgcatactgaccttcaaatggacaaatgaaatgactgcccctcgatcgaacactggtggaacctcgtcgttgaatcccccaacaccccaagagcccctctgcgaactctactgatgctagtcacctgggagatctggggggagcgtaatgcaaggatctttcgaagcacagcctcaacaccagcctcaattcttgcaaagatcaaagaggaaagcagagcttgggtcaaagccggagcggctaggctgcaggagttcggatttttgggagatatcacctaaagaacttctctcctgcgggccggtcttctgactggccctgtacatactttgtataattttttccctctctattaatatatgaggcaaagcttttgtcctcctttcaaaataaaaaacagcccagtgcttttcaagcaagcaccgatggcaagctgctatccaatgtgctcaagtacatgtagatcatcacctcctctactccccaagcatccgagggtaatggcactaatcatatgtatcttaggggcagatccaggaaagaaaaatgggggggggggggggggcgctgaactgagcaccaacataaactcattatctcacatacaagtcaaacatggctgtaataatttacagtggtttcatatgaaaacattgagaaagaaaaggcaaaatacatcacacgacagtccaatattcacttggctctaatctcaaacagatactcacaattagtttagcactcctagatcactaacaatatctgagcaacaaaactgcactcgccattttaggttgccttgtattctcattgttctctatagtaggagtactactgctgcaactttaataacattcaacaatgttctttttgacatgttgcaaacttgcaattctaggagcagccgagtagagatgatagattactagctgacacacaaaattttaactacgctaaatttccaatgggttgaatcattccagattttgaaaatttaaagcaaaattaagcatactttcttgcctttcttcaccggctgggttgtcgttgcagctcgccggcacaccgcacgccctcagcaagttaggcaagtcgcaggcagtagcttgccgagttgtcggctagccggaatgccggttattgcgctgccagtaccgctgcgtggcctgccctgccttgcacaacagccctcaccacaggcccatggcacaccggtgccttgcatgccgcgtgccgctgtgccgtcagctcgcattgtctgtgctcgctagggttggggatgccgccatgccggatgccatgtacgggattggggatgacctgactggatgggagattttggatttatgttagttcggctgatggctaaggctgtgttcggcaccccttgttcccaactcctctctctcgttttccgcgtgcacgcttttcaaactgctaaacggtgtgctttttacaaaaagtttctatacgaaagttgctttaaaaaatcaaattactccatttttggaaaaaaaaaagctaatacttaattaatcactaatggaccggagggaatgagttcccatcgaggacatgtgaacgtagcctaagttgaaagcccaattagtgaacaactggacgtgtgcacctagccacttggcacaattgacattgcattactacattcactgggtagtctggcccaatcgcgtgtcttcttcaaccttcagccatcaggcagcttcagcagcccctacttctcagtgttttttttttctggggtaggggggggagggggagggggctccatgggtccagcgggtgtaggggggacttgagcccctctgcacccacgttgatatgcccttggtatctcttgctctcaaatgatatagtatgctattg

SEQ ID NO: 56135 - DNA, 1759 bp, Oryza sativa
agagttttcatagggatatgctagtaaagaaggcaatagactgatagttaacatgatagaaacatggtaggcatgtaaagaaggcaatagactgatagttaacatgatagaaacatgtaaagaaggcaatagactgatagttaacatgatagaaacatggtaggcatgtgatagactgatagtaaagaaataagtacggaatccatttatacaacaaaagtttacttcatacacaggaacagtatggcccatttgtagtcattcctaaaattatttaaactgatttatcatgattgtttaaattggatatatgaaaatgatatgtttgggtttgttcgaatattatttccattatattataatttaccatgctctatgttagtgccatagtgcattctctattttgagtttctaataatatgtccatgtttggtcactgtcaattgcactttaatcacaagtgaccatctgcctgctgtctaccattgttatctggattatgtatcaatatgttttagataattaaattcattccagcctttgcttcacagaagctacgtgtaataatatatgactatgtgcacgtttaatacatatcacctttaaaaaaatgaatgttttgtgtttggaatctgatatcgtattcactttcttccagactgttgtattctgcttggtggatatctacattatgcttgggaaagcatttgtaccatatctagaggggcttaatagcacgcagctgcgcctagtaacaatctatgcaaacaggatatcacaggcaaggtctggtgcaccgattgatgctaaccactagatcatattgttttgtgtatcatatgggtatctctttggatgagctggtttcattcattcgatctgtatataacagacagatgccgttcatgtattgagcagttggcttttcgtgtgtgtatgtattccttttatttttgtttccttttccccttgtgtgcagaggcattgagttatgcgttaacttgtactaccatcacactgtacaaagataacaggatgtagctgactgttttcccttgtttacctgaggggtttgttggtgggcatatccttgtgctgtaaacattgggtgtgccggaaacagagaatttgctcaacagatccttgaatggttttgcttactactccttccttccatgaatgtttgacgctgtttgacttttttaaataatgtttgacgccgttggcttttttaaacatgtttgaccgttcgtcttattaaaaaacttttgtgaaatatgtaaagctatatgtatacataaaagtatatttaacaatgaatcaaatggtagaaaaagaatcaataattgctgaaattttttgaataagacaaacagttatacatgtttaaaaaagtcaacaacatttagggaaggagggagtacatgtgaaattatcgttggagattagacctcgagattgtttgcaactgaaatgtatgcattccaagtgccaatccagatgctccaggtgacccggtcgagtctcctctacaatatttgtcatctaaagttggttactgatatgtggtgggtctgccggatatggggcttttatatgtggcagtactcccaaggtctcttgtgtttgctagatggtattggtagatatacaatgtcacgttctttgtcaatgctagtgctacatgcttacattcttcaaccgtattgatatcgttatgtaaaaaaaaagtttttgattgtttatgaatgtaaaattt

SEQ ID NO: 56136 - DNA, 3601 bp, Oryza sativa
atgaggacatggcatcctattaccagccatcgcacaaaattaataggatgccatattctcgtcctaggtgtaacaaccacgtcatctcacaggtgaatccatttatttactaaaaaatatatatacttaagtgccaagtatcaaagtgtgtgtggttttttgcaacttgatcataaaacgtgcagttttgtgaaatttactcaaataataatgatgatttcgttttgacgttgtgaaatccctgggccctggcaccggacaagctaattctgtctccggtcgtcgtccctggaccgtgcacgtctgatcggacggctgagatgcgatcgacgtttttttaataaggctcgtggacgaatccgtaaggctgatactaacgcgaggaccaaacgagaaaattgccaaagggcgaaggcttttcctcgggttttggcgcgcaccgaccgaggcggcggcggaggcggtggcgatggatcgcctccggcgtcggaaccctaaaagtgtcccttccggctcctcttctatgaagcccccacggcccccgcgtggcccgtccttccaggccccagcggtgccgaggccccttccagagccctcctccccaggtatcgcccagctccatcggtggcgcttcttgtttctttctttcttggctttagggatctttttattgccggtgcatgatgcgagctaggttcgtggatcgaggtagaagtttctagtttctgggctggttgagttgggattgcgtgggattgggggttcgtgaatgaagtcgccgagttcaattaatccgcggttcaattctaaacaactcgcaatgcgattccttgcctcttgctgaatacaaaagagaggcgttcatggcttttatgtgtagatttgggatcatttcattggcaatttggtacgatttggtgttggtttaagatcgtgagccgctgatctccacttttaagtttttttaaaaaaaattaatctgccctttcaagaaaaatatttatttgttattagctatactgtttcggaattgatgagctttgatttctctataagtttctaataagcattttttttggggtgcctttgcttatagtcctcttgtagtctttgttaatttccagctaatttatccctaagtactatcatgttggttattgcaacctttattcaatgagattttctccagaaaattagtccgcatttctaatttgattaaatagttgagtatctaatgacaggtgggaggccaaggaaaagggttcgatttgctagtgaagccagcagtcatcagatatgcgtgagacaggatgctaacacaggcaaaagaccccaaggtacatttccatatggccctggcctcactgtaattcctttcttaacagtctggattttgataatcccctttaggtttcatgacgtatgaaaattctatcagaaggctacccatttccgtatcttcatgttgcgtgcttcggcttgcagggggattggtttgtctttcaaaatatattgtgggctccatgccattgtagtcttctcaatgttacagggtccttattttctcatccatattcccagttgtaataaccaaacagatctttctttgaggtgtggtgagttgcgcaatttccaagcatgaatcaatggtggatgaatgctacatatccctttgaagttcttttagtattttctgcaatgccatcagagggatgaagcatggaagcaccactctgtaaatattgctgttaaattgttgaggccatttgcttgttgttccttacgatagtgattttaatttacatttacatggttttctttgtgtttctatgtctttattctatttcacatcattctccatgcaggttgtgatgcgaaaactactgaatacaaattctttaagaaattgtgggagcagtcaggctgtagacctcattctttctccaaacaaaacgaagaaaaacagatgggtttgtaactctgtatacatttccatagggtgtactatactcctgttctctttggcgctcttactaaatgacttgaaacagatcattcatatgtatcttatgtgatttttctgtgccttgtagaatcgcataatgtaatgccaggcagaaagctccctgcccagaagagcactttctcttctgaggagacccccgctacaccttgtaagaatgaagaaatctaccatgagcaagtcaatgcgaaagcttcccattctggttgaattcgttttctctgatctcctttagccatgaatgatgcagttttagactcttctaactattaattgtcttctctgcagaacatggcaataatgatacacctcagttgaacccacatgattacttgactgttcatgttcacacacccataactcaggtttcgtttgaagccgtaggaatttcaagaaacactggtgagacattttcatctttcaataagaaatacatagcatagtgactgactactatactgctgttgccggaaattgtcactatgatatatagacatttcctgtgtatggatgttaacttgttttagaaatgcactattttgtagggttatcattccatcataaataatggcgcccatggtagttgaggtttttcttatatacatatactctttgaatgaaaataacagaaattactatcaggcaaggcagtaatcctaggctctttgtattatttatgtttgttttcctcatgctgcctacgacacatcttttctgaagtgtgttggttgctgatatttggtctgcaaccgttggctgatacaagaacatgttactgattcaccatgcataaattagtattgcgagatacatatgattagaagtgttctcacagcaatttacgtctgctatatttatctaatgtgctaagctcatattcttttcacttttgatgatagacatagaaccttggagtggacggatcttttcagaaaagagaggaaaattattaaagctagctgcaaaaactatgtcaatggaaagttctgagtttttgcagagaaggttgacattacatattgaagaactcctttactttatattttcatgttgtccgataatggttggcctgatgacataaatttctcagatcagaattttttgctgacatcctgcaaaggctaggcgccaacagcatgataaaaaaggtatcctttgctgaacctatgtaatgcactatcacccactcaaaaatgtttgtctattatttacaagttccatgatttgatttgattttttttttttgctgtaatgtagcaccgtaaggagtccatgagaatgatgaaggtctgtggccatactcctactggcaccggatgccattttgaaaatatgcttgattacaggattagtgactttgatttgcgaactaaactgagaacagaaaaagagtcatcctcttatgcaacccaggaatcccgtcaattcatggctttgccatggggatacaatcagggcccttcaggttctcttgattggaaaattgatttacctcacaggggcaatgaagcacgtgagagcatggcattaccatgggtgcacactgtgggtcttccaaattctggttggaaaagagac

SEQ ID NO: 56137 - DNA, 714 bp, Oryza sativa
tgtgtaaacctaagtaatagcaaagtacttatttaggtagtatataattcgcatcaatattgaaatatgtttcagctaggagcgagttcacctcttgttgtagtttctttgcacggctacgtgtgatcggtccttgaaatggtgtaacggattgtctctcatcagcggctaagtcagatgattgtcttgagtgttcatgtgacagggctggggcacatcatcctcccccctcttgaaaaggagtcgttctcgactctgtttcatcaaaaccataatagggtaagatcggcaacattgaatgacgcacttacaccatattcgcctggaagatcgattttgtatgcattgttattgattttggcgaacactttgaatggcccatctcctcgtggcatcaattttgatttgtgtctttctagaaatcgtttcttacgtagatgaacccaaacaagatatccgggttcatagaccactttctttctatgcttgttcacctttccagcattactgcgcaccttcttttcaatttcttcattagtcttttcatgaatcttcttcacatatgcagcacgctttgaagcatccatgttagttctttcctgcaatagaagaggtaacaaatcgattggtgcagtaggtttgaactcataaacattttcaagtggacacatgtttggattaatttccctaatttcaatggacggttccaggaga

SEQ ID NO: 56138 - DNA, 1169 bp, Oryza sativa
ggtaaatcttgcaacctaaaaaaaaaatctgataatcaaaaccttaatatttatgtttataatcagattttggaaaggcacctccatgggtaagaaatatcacgagagcttccacactgcaaacatggccaataaatgtacttcaatttgtatttgtaacgcttctgaaaataatcaaccacagttgtagtaaaattttctttagcgccctcagcaaacctaaaaataatataaggaaaaattttagtaagcataattaagggggaaatattttgttggatagatgcttagcgtatgagatcaaaacttacatgaggtcttccaagggaacgacagaaagccctttaatcttgtatcttatggttttgtctgttcgatgggtggtttcaacaaaaacaccctgcagtgctttctctacctggcatttacaagaacagcaatacaaaatttaatattgtctaaactgcattataatagcaacatgactaatgattaaaaattaataccttgtcatattcctctgtagaaaatagttggttgacatcagttctattcaaaagctcagccacaaattccaccactggaagaggtttataaaatggtgctgctggtatatctaaacagcaacattatacctaaattagtcttcaaagatagagacaaaaaaatagatagaaaaattaaaaggcagcatttgttactgtacatccagaaaatacggtgtttgatgatggacaccacaataacgaagctttgcttctggacactaccaaaacatggcctttacaacaggacactaccttcatttttcttaatcatttttgtcatttagggctggtttggtttgtggcctaaattggccttaccaatttatgtcaatgtcaaattttggtaacttttggcatggctaattttggcaaaggaaaaattgtgtttggattgaagccaaaatagcctaaattaactattgaaatggcctattttcttaggcatgccaaaatttggctccaaaccaaatagcaataaacactattgaaattgccaaatattggtaaggcccaatataggcctcaccaaaccaacccttagagagatctttgttaaaggacaaaaatgcccctagcccactacccgtcctcttgccttggcctggttcattggacccagat

SEQ ID NO: 56139 - DNA, 2695 bp, Oryza sativa
aaaacgcattttccaagcagcaaaacaagccgcttgtgagcaaatgtatgtgaaaatggggattttcacaagtggttggccagcccgtacgtgaaaaatcaagctttcatattttgattagctacaccacttttttttgatgaaatatatacgacttatggtgtataggatttggactcgagacctcatagtccacacacatccatttaccatctcattttcaagtacttgttttgaattaagatgctattcttttgacttcacctccccgaaacttgaaatgctcatttgatcttctaaatgatcttaaatgaaaatatcatcacttacgaagttgtaggtctggttgagctcgacatccctcattggaggtcgtttgaaatatagatttgagatttataaaaatagatctataagatcttgtcgtaactttttggacctctaaataatctcaaatgaaaaagttgtcatttataaagttgtaaacctcgtcaagatgtacaagtttgacataaagcttatattcatcgcactttatatgaaaaaagttaggtgtagatatgtttttttttttggaaaactgattttcacaggtaagtagattaagccgctcacctgtgaaaatgctacgatgtacacttaagctacctgcatgtgaaattgaggtcattttcacatgtgtgcggcttaagtgtccacctatgaaaaccggttttcttataagtcctgacagaggattctcttcacatttttacaagctggttttcttttggatcgtttatgaaaataaagcaggggtgcctgcagaaatggttttttattagttcaacttgcatataatacaagatcatgctaggtacaacatcattatctacgtatacatatactattacattattgaagtaatatattgttataaataaaccatgacataaagtcacaatcaccaatcttcatattatcaccgttagaaggtacgctttggtgcttcatattatcaccttaattatcttaacttctaacacacaagaaccattttcttcttgttggactatacacttatcaatatgttgcaattgttgtgcgcgactcagggtcgcctgtaataacgcgtggggtttcatgcatcttgttcattacatgccggaccatatttcttagcttccaatccaacatatgtcgtcttgattgaatgcatcttgttggctatttgtttcatgttcatgcgatcacttggtaatttgcgcgtacaagaaagcgcaagttgtagcagagatatcaagcactggtggacagcattttccagtgtcatatttgtttgattggagtccatggacttttctgcgagtcgagcatcaatcacttgaaatatctggtgtggaaagttactctcgacaaagctgataatgtcgagtccgtctttgaacataggatcagtcggtctttttcctgttataagctccaggatcactatcccgaaactataaacatccccagaagtagatggatgaccacctcccgcgtactctacataggtatgaagagaaagtacagttatctatttagctgtctataacaaaagctgaaactgaactcagaagtagccatattaattacctggaggaatataccctatggtacccttaacaccgactgtactattcgaacctgttgatgtcgaccaagagtcgatataaaatcttgcaatgccaaaatctcccaaaagagcattcatgtcatcagctaaaagtatattgctgggtttcaaatcacaatggatagttgttcttccgcattcatggtgtaaatagtccagtgcatcggctatgttaacacatatgctaattgtttgtcttaaacccaaacgtccgggagctttcccaccctctttgtcatgtatccaagtgtccaagttgccattaggcatgtactcgtaaactaaagctttgaaaacgttgcccgtactgtccacggtcgagcatgcagttatgattggaagaagatttctatgttgaatgcttctgagagcttcacattccgatatgaagcttctttcggcacctcgcatctcaaggtcaaaaaccttcacggctacttccaacttacattccttcaacttacctctgtacaccgtaccatagcttcctttgccaataaggttagcctccgagaagtttcttgtggcttgagctagatcattatatgagactttaaggaaattctcaccaaaagattgcgaggatatatatttttctcttggcttcatcttctcaagaagtaagaagtagaccactaatatgagtgacatgaagccaaatatagggatcaatactctaatcaaatagtactgtgtttttcttctctgggaaacaacttggcatgggggcatacggagatccatcactcctccacatagtcctatgtttccctggaccgaaacaacagtaggatttgcaaatattccagtcattggtatttttccttggagacgattgtatgaaaggtccagtttgctcatgactggtagatcatttagtgtagtcggaattgtgcccgacaagctgttatgggaaagattgagtacgcccaggctctttaggtcgccaaaagttactgggatattgccagtaaggaagttattgcccatttggatgtttgccaggtctttacactggctcaaagtgccaggatctcc

SEQ ID NO: 56140 - DNA, 18824 bp, Oryza sativa
cgatttctggatcactcgatccccacaaagattcgtgccgtgataatttacatgatatgaatcaagcacgacaccggatcgggttagctaaaattatgtcgacacatgctataatcgacttttttaagccatttacacagaaattacacctcacttacaccacatttacatcctacttacatatatagttagtatgtaatttttgaatttacatatgtaattttaggaattacatatgtaattttgagacttacattataaatacattaaaattacatatgtaatttaaggagttacaatgtaaatacataccgactattttttggtgaaaaatatggcgccataaatatagctacaccctagaaaaaaacatgtccaactgacacgaaggccatatgcaagaaaaaagactaggaaacaaccacactgaatgcccctgatttttggtagccatgtacatacatacatatacgagaaaagataataagcaaaaatacctcattaaatattgattatatttttgttagcattagatcaaatcttaaatctacggtccacctgtttactgtattatataaatttttttttaaaaaaaaagtcttgaaaggagacaccatattcgttgtggaagctataaattctcaaattaattagagaaaaaaaagttcaggtagaaatacattaaaaaataactaaaattcataataaaagaagtaatactgaaaaaggagtccatataaaacataattaaagattaactaaaatttagaataaaaataaaataaattctgaaatttgaaaaataaaaataagagtttaaatagaaatacaatttaaaaataactaaaaattcaaaataaaaataaggaataatgaaagaatagtacctgcataacataatacgagattaattataattaagaattgaaataagtaaattttgaaattacaaaaaaaaagcttaagtaggaatacaatttacaaataactaaaattcagaataaaaaataagaattgttgaaagaagagagcatctagaagacaacatgagattaattaaaataaatagaataaatttcgaaaatagaaaaataattataagagttcaagtcggaatattttataaatagaaaaatattggaagaaaaatatggaattttcaaacacaaaaattcatctagaacacagatgacaaatgacaaataacaataaagataggagaaacaataggtctgtaaaagagtagagtggtgacagttgatgggatatataaaaactataaataaaaccccaaatagaatcccaatgacgattaaaaggagtgacgacaggcatgccgttaaacaacatgatcacaatggttggcaggacttctaaaagtaaaaaaaataaaataaaccccaacaatcatcatgtttgattttaaaatcccaatgacagtaaagagagaaatagcgggcgatccacggaggagtacaatggcaaagccgctgatcgtttggcgagacatctagaaagtaaaaaaaatgaacctaaacaataattttgttcattttaagaccccaataacaataaagaaggggcagcggacgggtcatagaggcagcgtttgaccgtacttctaaaaattataaaaatgaaaaccaacaaaacaataaactctaaaaagtacatggtccgattttaaaggtttgagacttctaaaagtaaaaaatatataccacaatgataatcatgtttgattttaaaatcctagtgacaataaagagatgaggcaacgggcgagccatatatagtggcgaacccgctgacggtttggcgggacttctagaaaataaaaaaaataaacccaaacgataattatgttcaatttttaatatcccaataacaataaagagagtagacagcggatgtgccgtagaagagtatagtggcaatgtttgacgggacttctaaaaattgtaaaaaggaagtccaatgagacaataaactctaaaaaccataagctccagattttaaaggttacaaggagaatgaataaaaacagtggtagatcgagaaagcaaagaaagaaggggtgatagaagtaaggggtagcgactagcgtgacttttacaaaactataaaattagatatacaaggatgataaagtttagtctttcaaagtctgaagataactagctatttaataaattttaagcaaaatcatattaaaaatagataattttgtatgaatgctagccacgcaattgcgcgagcaacccagttagtttataaaacctagtcactttgggtccttacacggttttgaccgcggttttatctgacgtgtcggctgagttagcatgagaccccacgtggaccccacatgccaagatgatacgtcatcatctctctttccctcctctcactctctcccctctctctctctcactattctcctctctgggcagactagccggtgggtggggaggaggccgacgggagaggagaaggtccggcggccggcgacgccgtggtggtagcgatgacgcgggagacgagatcacctcaacctcatcgtgggtacgtacggcgtcgtgccggtcatcgtgccacgggttgccggcgtcgacacattggacgctactcgactcattcgagcccatccatggcgtgcttctatgagagtagtgtgtgtatcctcacctgataacgagccagtcgacgacgatgaacgatagtggtgttgtttgtggccgcgagatatcgtccacttgaggcgctgtggagcatgaggatggggaagccgttaaagtggagtaatccctccatactcgtaaagaaagtcgtttaagataatgtttaagtcaaaccttagaaatataaattatgaataactttcgagttgttaagtttgaaaatgtaaaaattatatgaatatatttgtcttgaaaaatactttcataaaagtatacatatatcacttttcaataaatatttttatataaacaagaagtcaaagttgtgttttggagaccgtgtcgctgtccaaaataacttcctttacgagtactacgagtacagagggaatatgtgcaccgccagtagcggatctaggatataggatatgagtggtccgacctcaatttgtttttctaaacaaagtaaatctaacgatactaatatatacaatgcatataatagactaaatcaccaaaagtttacaatgatatattaataaagcatcttagaacatactccctccgtttctaaatatttaacaccgttgactttttagcacatatttgaccgttcgtcttattcaaaaacattttgtgaaatatgtaaaattatatgtatatataaaagtatatttaacaatgaatcaaatgataggaaaagaattaataattacttaatttcttttaataagatgaatgctcaaacatgtttaaaaaaagtcaacggcgtcaaatatttagacggagggagtataaaattagtaattaagtaatattttcatttaaagaagcttacacgactatgaaagtttaaagaagattaccatactattttttacttatcgggtctatgcgggcggacgggcgggcggtgcactgcagccaggaggttaggaggcagttctctgtgagtccgtggcttcgttttccagttttcctcggctcgacgacagctccttgtggcggcagcacacactgcagcagtgtggcactgcggcggccaaggcagcgagcggattggggtggtcgagcggcggcgcgacgctagtctgatctgatcgcgtgattccaatcgcgtcggcagctcggcacgtcgctagggcgtcagggcgaggaggagagaggcacgtctgggcccggcacaagtcgcgcgaccgcgacgctacagtttctttccttcccttcgatccacgcgcgtggggggctcctaagagcatatacaagagtgtctcgaaatcttaactctccaaatatctatttagctaactctccgttcaattagcaagttaaatttttttatttacttcagcctctccattcatcctctctattctgattgcatgatagtgggacccgcatgtcagcctcaaccttttcttcttcctcattttctcccctttttcccgagcagctacacaagcagagagcacggcggtgaggcggtcccccgtggcggcgccgcgggtggcgaacggcggcggaggagggccgcgcggccgccgcccatggtgccaaggctctcatgcccccgccgccgccacaatgctccgcttctgcctccgccctacgcccctacgccctcgtccgcctccacccctacgcccctcctcccctacgcccttgtccgcctccgccttttgtttcatttggaagcagctggtactgtcggcacaaaccaaccaactaggcgttgcgagtgatcaaagatactgtcttttgttatcctctgaaactgaaaggaatgcgatatgatttgatctgacgagatgtgttttcacctgtcacttggacaagatcgtagggctagatgtccgattattcaccagctgtgcaaaccaaaccatcacacaccgcattcaaagttcacaccgatcacaagttcacaaccatcagtcgtcggctacaaccttgaacaagaaaaatgctcgatcgaagctcgtttgactgacgtaagtagatgacaccaacctgaagaaaaaagacgtgtagagctaaaagctaagggcagggaaaagaaaatcgatggctgctgttcgtcgcagtcgacgagcttagccatcctccaagcgccgccgcccgaaggtgctccccgtcctacctcgccaccccctccgtctccccctccgcctccacctcggccctcgccgccgccgccaccaccacctcctccaagcgccgcagtgctccccgtccttccccgtcctaggtcgacgaggacgtcgaggccgcgctctcggtcgacggtggtgaccgtgccacggcggatggggctgggaccgtgcgctaggaggtgacgcggcgcacttttttttttgacgctaagagcacttaacgctaactaagagcgtctttcttctttttcttaagttgactaaaacaaactttcaattccagatttgaactcagatttaaaaatttcaagtcaagatttaaaaaattttcaactctgatttttaaatttgagttaaaagttttcaaacctgagttaagttttcaaatcttgacttgatgtttgtaaaatttgaattgaaagcttcaaatcttcatttgaaagttttcaaatccgagttgaaagttttcaagtccgaattgaaatttttcaaatccgagttgaacgttttcaagtttgaattgaaagttttcaaatccgagttgaaagtttttaaatctaagttcaaagttttcaagtttggatagaaaattttcaaatccgagttgaaagtttttaaatcttgacttgaaagtttttaaatctgagttaaaattttttaaaaaatcttgagttgaaagtttcaaatcttgagtcctgctcctacacgcgtgcggtagtcaacagcgaaaagaaaaaaaaaggaaacaatggcagctacgaaaaaaaagaaatgacgtcacgaaaaaaagaaagaatcgcgctcgcgcgcgtgggccttgtgggccagaagtgcgtgccagcaatgcgcgcgaattagcatttgtggcgtgcgggcgccaggatcgagctttattctgttcttatttttttaatagtagggtcgatcactgcacggacgaccctatggatccgccattgtgcaccgcccacgcctcatgcacggacgcacggcccaaccgcagggagacgctgctcccatcgtcatctgcatagaggtacgtgccgtgggcgcggctccacagccacacatgatgcccattgtggaactgctttattgcctccggcaagcagcggaagtggcgcggggctcttggtttcttggtgcttcggtcagcgagcgggcggaggagcttggtgctcttggtttcttggcgattgggtcggcgaagcgacagagatggcgcgcgcgggggaggggggagggggggtcttgttttattggcgctctgatcggcgagcggaagagacagtgacgagctctttgtttcttggtgctccgacgaggagagagcgcaaagaggagagaagttcgttgcgacggttactgcacagggctctaggcaccaagaggggagaggaccctagccagcgatggcggggttgcgccgccgccatagggattcgatggtgccggtggaggtcagatggcgctggggatgacgagttggtaggcggcggcgaggtggccataggaggagggctactcttccgcactaccataggctggccagtgaggaggaggggagggtcctcaggcaaccgcattgccgggcaccgaccaccatgcgcctctccccaccacacgccaccccctgctcgtcttcagccgcgcggagagaagtaggatgggagatgaggggagagaagatcgaggtgctaacatgtggggcccacatgggtcccacgctgactcaaccgccacgtcagatataaccgaggtcaataccgtcttaaggacccagagtgacccgattttgtaagataagagatgtcatatatttgtttttcggttgagtgacgattttataattcggtgacaagttgaggaacctttcatgtatttttttcctttccaaactcgtaatccagttgattttaggtgggctagaattggatgtcctggagtcggtataggcccagagtaaagcccatcgtgctcccaaatcctcccaagcgtcaagtccgcgaacagctgcataaatggagagcagcaaatgttaccatgatgttgacgctctgctcccgtctttgtgatattgatgctagaggctcagccttcaggcaatggtggtgatggtgagttagctagctagaggttcattcaaaccgtcgatctccacaacaataccacactcctacttcctccgttttatattataaagtgttttgagttttaaatagatgttatatgagtcaaaattcatatgaatgaatattagtaaatctaagcaagagatgttgaggtcaaaacgtctaatagtatggaaaggagagagtacaaccctaggagacaggtcaccacagtccacaagcatttaacagtagaacatcacgcctaggacacgatcagcaatctttggaaccttcagaaactcaggcaactcagaagacacttcattcctgatgcttgatccatcgccaaacttcccgagatagcttcgtcctcgggctgcagcaagatgagcatagtatagtgggggaactgcatagcaaagttaaaaagtttatgacttcaagcctaatcagtagccctcaatagtccaaataaaaagacacacaacgttaatttcagaaaagttcacaaacaagtttgtccagaaaaagtacagtacacgaaacctgagaggatagatcaaaaaggctacgatgtttagaaggggcacaattatgaccctcattcgtgtctcaataaagtaagctatcaaatggtaccctatctatactttgttaaccaccctagataaaagatattatcatcaaacataaaccgaaagttgactcacctatagaaacagcacgggtgcatcgtgcatacctacatattgaaaagattagagttaaatggcaaaaacaatcaaggtgagcacaaaaaagtaaataaaataaccaaaggtggacgtgaacttacatgtaacataggttgtgtgtaagcaactgaagcccgtcagcagtgaaatgattttcatcgaagataactgtataatgcgtaggtctactgtttccctgaaaatgacattatatacaatagattataaacaaatattcattaatacttataccatcatggaagtaccgaatcatacaaagcaaatttcacacaattgtaaatatgaaaactataatttagcttcaatttcaattggacattttgcggaactacaataataatacacgatttatcaaagactacaaccctacttgtgttcaatatgtgggcccaatgtgattattgcatgtgggaataagttcatctgaggtcccttaacttgtcaacggatctgattttcgtccctcaaccggaaaaccagacacaacggatccctcaactatcaaaaccggtgcagatgagatccctcggcggttttgagagcgattttggctggcgtggcgcctatgtggcgaatttgactcggtcttcatctgacgtggcactgacgtggcgcttacgtggcaatttgatctcgaaaaataataaaacccataggaccgacatgtcagttccacacacaaaataataaaaaaaaatggtaggacccacgtggaccccacatgtcatcctctctccttcctcttctctcaatcccctttctctctctagccgatggagcagggcgagcggcggtcgacagaagcgggagacgggcagagcggagaggctggccggcgaagcggggcgagcaacggccgacggcgggctaggtcaggtccgcggcacatggggccatagagcgcagacggcggcgactgctggcgttgtggagaagggcgtcaacggcatcgtcgggagtatctcctccggtcacgcctcatttcccttctcccctctccctccctaaaggcgagcagcgagcaacgggatagaagctgggcggttgcgggtcacagccgggagaggacagcgggtggggcagggagggaggaggcgagagggcggcgagcggagcagggagggaggaggtggagcgaccacgggggaggcctgcttcattgcggcagcgatgctgtcgaaggtgtctccaggcgacggtcgcgatggtgggcggaacccggagatggaggcagcagtcgcgggggagtctggccttcccgcccctctcgctggcctccttcctcccccgcccactcacctcctccctcttcgcgcgcttggctggctttggttcgccgacggagagggagaagagcaacggccagccattctcccacagcgcctccttcgtggggagggcagcgaaggcggcctccatctcccatatcgtcattcggattgccagcaacggcggcggctagtcccgcccccgcggtgaggtccatcgcgacgccaaatgcagccccgccccgctccgccccgcccgtcgctcgcttctgccggccgccgctcgcgccgctccatcggccggagagagagagaatagagagaggagggaggagtgaggatgacatatggggcccacgtgggtcccacgggttatattatttttggatcaaattgccacgtaagcgccacgtcagatgaagaccaagtcaaattagccatataggcgccacgtcggccaaaaccgccctcaaaaccgccaagggacctcatgtgcaccggttttgatagttgagggacccgttgtccggttttccagttgagggacgaaaatcagattcgttgacaagttaaaggacttattccttgcatgtgtgcatgacatggctgcccaaacttgtgacattttggcccaattaggatatggcttgtgtagcccatgagagctgtgtgcgcatgtttagtaccaccttgctagtctagcaagggtggaaccaacttataaagcatcatccctccaaccatatcactcccgggttaacccttttacatgaagcgaggacgaaagtgtaagtggattagtaaatgtaagtagacccgcccgtcggacaggctggctacacggacgtacggacagttgggtcctttgaattaggatatggcatgtgtggcccatgaaagcggtgtgcgcatgtttagtaccaccttgctagtctagcaagggtggaactaacttataagacctcatccctccaaccatatcactcccgggttaacccttttacatgaagccgaagcgagaacgaaagtaccaccttgctagtctagcaagggtggaactaacttataagacctcatccctccaaccatatcactcccgggttaacccttttacatgaagccgaagcaaccttttacatgaagccgaagcgagaacgaaagtataggtgcagtggtatgtgtaagtgggctcagttgtatgtgtaacccttttacacgaagcaagaatgaaagtgtaagtgcagtggtatgtgtaagtgggcctagtggtatgtataagtggacccgcccttacatgaagccgaagcgagaacaaaagtgtaagtgcgaagcaagaacgaaagtgtaagtgtagtggtatgtgtaagtgggcctagttgtatgtgtaagtggacccgcccttacacgaagccgaagcgagaacgaaagtgtaagtgcagtagtatgtgtaagtgggctcagtggtatgtgtaacccttttacacgaagaaagaacgaaagtgtaagtgcagtggtatgtgtaagtggacccacccgacggatggtggtatgtgtaagtgggcccagtggtatatgtaagtggacctgcctgatggatgggcttgctacgcggttctagagggagggctgtcggatgggctgatttttatctaacaaacagaactaaagatttttgaaatgaatagcttaaattgcagacaaaataggtatgtttttctgacatttatatacctgagaagtatggctacacaaataaaaatcaaaacccgaaggatggcatatgtcttggtcaatcacagttcctgaaaatattcaagtattacattgtgttctcaataaacaaaaataaagaacgaatatacaatatttatagtaaggtccttctgcaaaaacataagataaaaatcctatcttgctcaggtgcatgcgttctatttggctacaggggtttcccttgcatacatccagaactaaaagttagcaaaataaacctaataaaactacagaactactaacttgctctttctgagttagagagcttccactgtgcctgaggttaggttttgtcttggcagcttatagggctaaattaggctgttgccaccatgaagattccatccagcacgtgttggtcaagtttttattatttttattttgtggattttatgttgttatgtataactgcatgtgtgagttgtacagatataaccatgtcatacaaataaagtttttgttgtattaaaatcactgagataaagttttaatttagaaccactgagtttctgaaattgtttattgttgggtttgaaaatatttaaagtcacccatttcaaaatcttgaaataggacaatctggagtaataaactacttaccagagggaatctgtgcaacttgttcagtataattactgcaaagtgtgtgagggaaaatcctggtgtgatgccttttctggacaatcactaatgtgattggtggcagataatcctcttgtagagagaggcatgccttgaaaaggaaatagataaaatcagaaataaatttagcggacaaccagaattacacaaataaatgtgaagcatcaccttcctgatggcatctacttcatgaatgataacctggctgaattgactttcgcttattccatctctagaagcaacaatgaccagtcaaaagacatcatccaagagaatgaataaatatatcactattttgcaatgcacacctgtaaaagattatcctttcaggcttacgcctattcctctggtagaagttcatcatcagttccctacagcaatcaaaacacatgtcagattccaaatcaatcacgtgagaattaataatagaaaagtcaaaaaacgcagatagagaagatacttacctgatcatgccatcaggtttaaggcacccttttggatctcgagtagaatgaaatagacctcctataatctcctgcctttcaagttgggcagagattagctctatatgtggtgacttctggccagtcgattgatccaaccacctaaaagtatttgacaaagtaatgtattgacccacaacaaaattggagggactaatcctttcaaaaaaaaattggagggactaaggagtaaagaggttgagttcaatttcaagttctttatataatgagccaaaatgtttatttccctataagaagccatagtagtaaaacagaaacaaattctaagcaacagggaaaatcttactcctgcaatagatgacgagtacatccctggtgggggatggctaacatcagcaccaaaaatgattgtcggtatgtctgacacgaacggtattccattatgaacaaacgcttgctgaagaactgtattctgccctccaacctagttcaagatactgttgtaaataccagcagtacaatacatggaaaaatgtgtagcaaagtatcgatacatatgtaccttgacatttatcttaagggcaatattctcgaggtattttatatttgtatctgttttaacattctttggtaagcagcactgagaaaccagtccaagcttggtctcacatacacgcttaatttttcctatagaaacatgcaaaatgacacctcaaagctaacagaaagcacagagttttttagcattaataatttcataccatagttgcctctttcttccggaagaatgacaattaatagctggagttgttcttttgcagtgctgtgaatagacttcaatgcagcagctatgttcagatcattaatagaccataatggtaccaatggccactctttgaaatccttgcaaccacaaaataaagtgattgttaatgcaatatgcaacaatttgaataacttggattataaatcaatgcaggaaatagcataccattccaaggaagttgcacgtcttgatcatttaccacagaatatcttaactgttgaagcaggtacttttgaaaaatttaaacaagcccatctctcgacttttcctccatttaccaatttctgaaataacaatcaattcatactcaaaaaaatatagagcagaaaacatgcactctaacaattttgaattttaacttcaattaaagggaatatggcactttgttgcaatgaagcataggtgatatatacttatgaccctgcacactatatgatgtatggatatttatgcatttcgtgtttgttgtttgttgtggtgactgaaatgcctggttcatattcaatgtatgaaacaaatggcctccaatacttttcctccaactagctaaacagagatatgacaaatcacagatgtcctaatattaaccaaaacaaagaaatttgaagttttatcaaatgtgcctttcacttgtgtgctacttgagtatgtaattacactatatgtgagcacattacgtacatactgccatgttgaagaacaagggtaagtaataaaaaatgcaatgtacgaaataggatggcagattcacagcctaacaccataattagaaataaataatgatgcatataatcactttatgacttcacttgtctatggagtttgtagaggttaggttgagttcatgaggcttccatttcctttctcatgtcatgtgggggcgccactaccaccgcaggagcaggccggaggcacagttgcagcaagcagcatgagtcaagggtgcaaacttagaaagaatcatgcaaggaaagtattaattaggaggaaataaatgtcattccttgtattagatgccaagtgcctataaggcatgtaatcagcaacatttgaagataagcaatttgagatcaaaattcctaatctccctccttcttccctaacctccctctgttcaccattgagcgtgcagggaagaaccctgccgccgcccctgatcccggctacgaactccgtagccgcggtccggctatcctcggtgtcaatgcacttgacaacttggtatcagcttccaggcgttcctcttcccgcactgccacatcctcaccaccagccgacgcgccaccatcgccaacgccctccatttcttcagccatgtccgagcccaccgccaccgagctcgccgcgctcatcaaggcgctctcggccaacgtcgacaagctccaggcatctgtcaccacactccagcaggcgtcctcctccaccagcaagcactccggcgagcaccacaacgaccgaccgccgcgattccagaaaatggattttcccaaattcgacggcaagtccgaccctctcgccttcatcaactgttgtgaatcctactttcaccagcagcggatcgcggaggaggagaaggtttggatagcctcgtacaatctagaagacgccgcacagctatggtacacccaggtccagcaagacgagggcacaccgccatggcgtcgcttcaccgagctgctgcacctccgtttcggccctccactgcacaccaaccccctcggcgagctcatggcctgcaagcgcaccggctccgtcgtcgactaccaagacaagttggaggcactccttccgcgcgcgggcaagttgacggaggaacaacgcatccaaatcttcacggccggactgcaactgcccctcagcctcgacgtggagattcacaacccgcagacgctcgtcttcgccatgagcctcgcccgcaagctcgagctgcgcaaccagtgcgtcgctcccgccgcgcctccgcgccacaaccagcgtggcctcctgcccgcgcctccacagctgctggcactcccggcgccgccaccaccgactgcaccgtctccagcgacggtgaccgtcgagggccgcacggtcaagcgcctctcccaggcagagatggaagaacgacgtcgcctcgggctatgcttcaattgcaacgacaagttttcacgtgggcataaccgcgtctgtcagcgcctcttcctcctcgacttggccgcgcccgacgacgactacgatgacgacagcacaccagaggagacaggcgaaactgacccgcacgtctcgctccatgcgatcgccggcgtccgcttcagcgacaccatgcaagtgcacatcaacatgggcggcgccaacctcctcgccctgctcgactcgggttccacacacaagttcgtctctatggcagctgcaagtcgcaccaagctcaagctcctccctcgcggccagatgcaggtcacggtcgccaatggagaacgcgtgccgtgcccgggcctctaccgcaacacggccttctccatcgacggggagacgttccacgccgacttctttgcactgccattggcagggtagaacgtcgttctcagcacacagtggctggcgtccttgtgttgacgcgaaaaacacacactggcctgagagatctgcttagctcaagtgcaggtccaaaacttgatgagatgcgggcgtgccagtcagtttgatcttgcaactgataagatacgtaaacagtagatcaaatagccgatcggctgaaaagccgatggagcaattccagccgatgccgataccagccgatagtgatagggttttgagcaatcggctatatgtccaatgtagataataatataaaagcaatcgactgatgataataaaatataccaacaatataatccagtataaaccaatcggctagcaatacaatatgatagaataagcattgatctgaaggttaaagcatacatcggctggaggtccgatgtcataaaatccaaaagattagattaaacagtgaaacctttgttgcgatcggctaaacccaacttgtgtgtaatccttataagccgatgcaacgtccatataacttatcggctagaaccccgataaaacattagcatgaacctatcggcttagcaagacttatattatcaacaacaatctagtagatcgaacctaaccgatgcagcacgagattgtatatgataatataatactcgatgagccgatagatctgtctaatgtgatggatataacaaatctatttagaatagcattgtgattgtagagatatatcggctaagacagaagatcggacctaaccgagacagtcccaactaaaccgatgcgtctctaaacacaatggaattagagataaacttgagatatcaggaaggcaaatcaatcaaccaaatcagagcgatccaagagatcagagcgatgcagccttgaacgatgccgatgtagatgacagattcaccagggcccgatggaacgtaggacttaccccttcgccggagatcgaaagccgatgcagccccgcgtcaggtgcccaaattccgccggttgataagtaaaaacctcagggaagagggtggcgatgcgccgagagtagttatattgatcgagattgatagattgcatagaccccgggtgtacatatttatatccatgggttgatacaagtccttgtcggacaagaaagaaactatcctaaagataaaaggaaaacatgaagtccttatcggacactaaacacactttcctaaagataaaaggaaactaacaaactatttctaattaatagataaactgccatgccgcatcttccttaaactcgtagtcttctagataagcttccttcgattgatccgactccaccaagaacacgatagcatggcgacttgacaactcccatcagctgtttctagagctctgaaaccgatagtgactttcagccgatgatgactttgggcttaccaaatttcgtcgttaacaccttgggaccgatcttgtgggatttcggctccctctccatgtccttttggcggcatgaccatcgtgtgtgctggcacggcgtggcaggctccgctactccctcgctgaaagccgtcgcgggccaagacatcatggcagcactgcttgacgagttcactgccgtcttcgccgagcccaagggaatgcctacaccgcgctcaagggaccactacatcaaccttttccccggctcctcaccggtcgccgtccggccctaccgctaccccgcctcccacaaggacgagttggaacgtcaatgttccgacatgttgacacaagggctgatacgacggagtacatcggcgttctcgtcaccagttcttcttgtcaagaaagccgacggctcatggcggttttgtgtcgactaccgcgccctcaacaccattacgatcaaggacgcataccccatccccgtggtcgacgagctccttgacgagttacatggcgcccgcttcttcacgaagctcgacctccgctccggctaccaccaagtacggatgaacgccgccgacatcgccaaaaccgcgttccgcacacatgacggcctgtacgagttcatggtcatgcctttcgggctttgcaacgcccccgctaccttccaagccctcatgaacgacgttcttcgaccgttcctacgccacttcgtcctcgtcttcttcgacgacatcttcatctacagcgactcatgggcggctcatctcgggcatgtgcgcaccgtcctcgacaccctccatcagcaccgcctcttcgtcaagcgctccaagtgcgatttcggcgtcacctccataagctaccttggccacgtcatctccgacaccagcgtcgccatagatccggccaaggttcaagccgtctccgactggccgcagccacactcggcccgcgcggtgcgagggttcctcggcttggcaggctactactgcaagttcgtcaaggatttcagcacgatcgcggcgcctctcaccgctctgctgcgcaaggaggggttcttatggtccgatgaggcggcagctgccttcaacgtcctcaagtcagccattacctccgcaccggtccttgccctccccgacttcgccaaaccgttcgtcgtcgagtgcgacgcttccacccatgggttcggtgcagtactcctgcaagaccaccatcctgtggctttcttcagccatccagtggcaccacgacacagctccttggcggcatatgaaagggaattgatcggcctcgtcctcaccattcgccattggagaccatacctatggggctgccgttttcttgtccgaactgatcatttcagtcttaaattcttgcttgatcagcgtttggcaaccatcccccaacttcattgggtgggcaagctcctcggcttcgacttcacggtagagtacaaggccggtgctagcaacacggtggctgacgccctttcacggcgcgacaccgatgagaccatgctcctcgccatctccgggcctcggttcgacttcatcgactacttgcgccaagcccacgactccgatcccacactggtggcactcagggaggagctgcaggccaaccagcgtagggccccatgggccttgatcgacgacatggtgacgttcgacggccgcctctacatttcgccggcttcaccacttctccaggaaatactcactgcgatacatgctgatggccatgagggtatacagcgcactctccatcgactacgccgcgacttccactcaccaaaccatcgctcaatcgtccaggaccatgttcgtgcgtgaatcacttgccaacgctacaagtccgaacatctgcatctggcgggcctcctccttccgcttccggtaccaacagcggtttgggcggacatcggccttgatttcatcgaggcgctgccccgcgtcagcggcaagtcagtgatcctaacggtggtggatcgcttcagcaagtactgccacttcatcccactggtgcacccgtactcggcggaatcggtggcccaagcattcttcaccgagattgttcgtctccatggcgtgccgcagtccatggtctcggatagggacctggtgttcacctccctgttttggaaggagctcatgcgtctcatcggcgccaagttacacatgacgtcggccttccacccgcaatt

SEQ ID NO: 56141 - DNA, 888 bp, Oryza sativa
atccttcttttcagctcgcggacgagctgctcgtcgagggggggagagatgtcatgtgggggcgccactaccaccgcaggagcaggccggaggcacagttgcagcaagcagcatgagtcaaggttgcaaacttagaaagaatcatgcaaggaaagtattaattaggaggaaataaatgtcattccttgtatcagaggccaagtgcctataaggcacgtaatcagcaacatttgaagataagcaatttgagatcaaaattcctaatctccctccttgttccctaacctccctctgttcaccattgagcgtgcagggaagaaccctgccgccgcccctgatcccggctacgaactctatagccgcggtccggctatcctcggtgtcaacgcacttgacatctcaataataatttcatgacttcagctttattttctaattagactttatgactagaaaagaagtatagggatgcacaatcaatatcaactatgtttaagaagtgccaattactcatttgcatgtcaaaattttggattccagggtcaaactaaagttgaggatttaactaagcaagttgatatcaccttattgatcatgttccatcgtccgccagtaggcacacacgttttctcattcccggagacatggtacttcagctgaagattgaacaattaaattttggaataagtgacaaattttttcttcaaagttcaaatgaaatgcatctaaatgcagcataaatacctcaggtgtaggcaagatgcggccacacacaatggcaggaagaccattaactctaattccaaactcctccacacacctctcaacgttacagttgttgcgaacctgccagaaatccaaaatttgagaatacaagtatcgggcatg

SEQ ID NO: 56142 - DNA, 1838 bp, Oryza sativa
  unsure (1)..(1838): unsure at all n locations
accattagacatagacatcaactaagcaggacaatgatagcaagaaaaagaagttatagaaaaatcanatttgatcagcttggatttttnttcgttttttccattctacctagataatgcaggtgtagggctggaaaacatggtttttcaacagtgaaatcatgatctgggcaatggggaaagcaagccttacaaatcctaaaaagcagagtagcagagggttacgtaacctgtatgtatattcaaaggttaaaaaatattcagaaatataattgttgttgacaaacacaggttagcattaacggtacctattcttgattaaattctcaaagttacccaaagttgttgtattcatgaaattgggatttgtagtatgtaatgtatgagtttcttcattgctactttggggttaccggcatgcaacatactattatgccctgaaaatttcaggttttcagttagccctatagttgtcatgctcaacatagttttatccagttaagactgagttattaccattggctgaattcgtcaagaaatatatggatagctatacttatcgggctttctcatagcatgtgcagtaaaccagaatatgaaaaacctccttcaaagacaaaatccctgtggtgctgaactatttataacagcaacattatgagaaaaaaacagtgatcgacaaatcgacacatacatttcttaagggttgaacacaaatgaggtgttacatttcctaattgctgacatatatacttgatcctaacatgtttgacaattcttaagggttgaacacaaattcagttactacaacagaaattcagaactcatgtgaatcctcctgaacttggatgcattttgatttttgaaatgtattatcaaatttcataatagcattagcatggggagagaactcatgtgagtactcctgaacttgaggtaaaaggaaatgcaggagtcatatattacaaattaatgtcctctcttgaggtgctaaactgtcagatatttttccagaacacagcaatatataaatttgaattcctcagattacctcatagcagcctagcatgtagccttagatttaataaatctccaattgcttcagctggaaccacaagttgaaactacaatgcagaaaacaaacaagtcataatagttgcttgaagtgcttgaagatcatactatttattcacaaggaacatgatgttctgaaattaatgtgaatatcaactttcctaagctgttctcagagttaatctcagaatcttatttttaactctcattagtgaagtgattaacaggaatgtgaagtgattaacatgaagaaaatttgattcagaaataaatcaagaaacggttgctgattgaaaaacataagaggaaatttgattcagaaataaatcaaatggttgttgattgaaaaacaaaagaggaagatggtagcagaagcaatgccgcctacctgtggtgaggtagggattagacacggagtcggcgtgggaagaaggtggcgtagacctgctgcggcgaccgttcagcggggaaatccctctgcagtgcaacgccgacctgcggggcgacggcgattgacggcgacctgccgggacggcggttagctcgccggtgggttccgctgcggggttgctgcgtgaggcgcgcagcgggggcggcggatggggaagcgacgtggcgaggaagggatggggacgccggggaggcaagcaggcggggcggcagatggggaagtggcgcggcgaggaggggatggggacgtgggggagggaggcagcacagccaagacaggggcgtgacggcggcgtcgtagatgagagcgagca

SEQ ID NO: 56143 - DNA, 7883 bp, Oryza sativa
attcctgcagcccttagtatagatgaatctggatatatacatgcttagattcatggtattaggttgcgtcaatatcaaatagtaggttcagtttttttttaacggatggagtatggcataattactgcagtgaattaaatttgggtcatggaggttgagaggctaaatccttacggagctatcgtttctcttattcgcaaaacgacatatttacaaacgaaaaataacttgtgaataaaacttttatatacgtgctcttagcgatctaaaagtaaatgctgaaaaataaacttcaatgaaaaaaaacctcaaaatcaactccaaatttaagattgaatattcaaaatttggttgataagcataagcataagcataagtgaaaaaacgaggcctttacttcatgcaattcttaatcgatcccggcgagcaggtgttgaggaagggtgaggcacgatggtcgttgtcgggccaaaggcggtcatcgtagctgctggggaggctgggctcattgtactccggctagagcggctcagacgaagacggcggcggggatgactccgacgaccctcctggccgcctctagccatcgatcccggtgagcaggcatcggggaagggcggcggggcacgggggtcgtcgtcaggccaaaggcagttgtcgttgtcacaactacgggggaggctgggctcgtggtactccggcaggagtggctcggacgaagacgacgacggcgatggtagggatgactctgacgattctcctggcctcccgcccccctcgctagccacctccctcttctactcgcttactggcctcctggccgccagttggcttcaactcaccgaccgccgccctttctctgtccccagctctccgcacgcgctcgtccgtggactcgtggagccggtgatgacgtgcccaagctagagacagagaggagggtgggacccactgacatgtgggccccccattttgttttattgttttgtttttatattttgtttttagtgtcacatcatcgccacgtaggattacgtgatgatgaccaagtcaaaccaaccacgtaaacatcacgccagccaaaaccgtcatccaaatcgttgtgggacctcatctgcacagttttgagacttgagggaccagttgtatctggtattgtcgttcagggacgaaaatcaaactcgttgtcaagttaagggaccttatataaacttagggctgggctttccgaatcgaaagtcagtccattcccgtgcctaccgatgacgcagtcctccctcctttcttttcggtccacgcggcccgcttctctagtccagctcgcgcgtggctggcacacgcagcaacgcgtgtcgttttgtgagtggcaaatacgggagggccacggatcgctacacggatcggcaatattagccgtccgatggattccgatcgaacgggtagaaccgtaggagttctctcccgttcatcacgcgggcggcatcgacacgtgtagttttgcgaatggtcagcgcggaagcgccacggatcgccacgcggatcggcagtatatgccgtcggatcgcttctgatcgaacggataggagcgcaaatgtgttttcccttttcctcgccgggatccagcggcgcctcgccggcaaatataaatgtgagctccgacggcgacatctgccgtacctcctcttcgttaggtttagccagtgaaacacgatgccctacgtcacgtcggaggcgcaggcccgcgccctcctgcaggtcggcgggtggcccgtcggaactctggtccatgtcgtcatcgtcgacgccgcctgccgtgcccgccgtctcgaccacacgctgcgggcgatggtggcgcgcagggggtgggtcgtggtcaaccgccacgccgtgcttcgagtcatccgcgtcagcgacctggtccacaacatcctcgacatcaccctcccccgcctcctcgacgacgcctacgacgccacgcagctcactcacttccggaggcaggcggcggctcttcgtacgatggcgggtgtgatcggagggaacttccgcaaccgcgcctacgtcgtcgtccgcaagattcgcttcgtcgccagcagcgcccgcaaccactccatggcggcggcgaggctccagcagcgtctgctcgacatcaggcgtcgcctcagtggtctcgtcgaagcacctgttcacctttgagcgtttttagggtgaatgttttgtccggtagcagtgtggtttcaccttcgactcatgtgcagtagttttgtttgatgataggcctgagtttcatctaatggttgcataggcggagcacattctcaccttaggaggagtatataggtactatatgaaatacagatagaatcctgcatatattaggagtaaacatagaggagattcgaatttcgaaatgctatatgaattgtggaatggtatatcggaaaggatcccgtaatgttcaattgtaattgccttaacaatcatgtaaggaatggatatgatttgaacagaaatcgagttaatatgacacgatgcatttatttctcgtttgtttttggtctctgttcagatttttgctgaatgctgtttgtactttaggatttgaacctattatcatcctgttttacgatttccctgcttactatcctccctgcaatatccatgttgaaattgaggatcaatggaaatgaggatgatgcatagtggcactgttagttgagaggaagatagagaagacagaaaaacagggttaaggccttaagagacaaaattggagtaagaagccaggtcgtggataaaagatcattgcattctgataactagaagtggtcgctctgttttcaggatatgaacttacaaaggctttgtgcagactgctcctatctaataaatcaggtgactgcaataccctggagtgaactgtttttagtttttcttcttgttgctataattatctaataataccactttgcagattgctggtgaattgttggctcttcttgctgatgctgcttttgaaacagttagtatcccctttcggtaagattagaagaccattttattttgcatgttgttcttcatacatgttacagagataagatagccaaaagaaagattctgagataacctgcaattgttataacttctattgatattcagctagatgctagtatatgtcacctagttctatattctgcaacctgtctaggaagtagggtatataaaccagactaattcgaggactcattttactggtgcaaatcacgtgataagatcactaaaccctactagttggccatatgtccaaaggctatgccggtgtggtcagcatttagaactgtctagggagacaactagaaatatagtgaacgctaagttagtacaacaagaagactatccatgttccaattaggaagtccagtgcgagaggactatcttaagccttactggtgctgtttattgtggctaactggtgatacgatgaaaaggcactgcattgctatgttcgttaagcactttatttattttctttgtcaactatatctacatttgcatacaatgagttgaaattattttacactggatatttattgcactgttgtttgtctgtcatacaccatgtctatttagttgaaaacatttttcatggttctcactggtgctacaagaggtattgtagaactacaagaaagtagttctgtagcacacccaaattactagggatctgaagtgacaaatgcatgtagttttgctggattcagtcccacattggatttgctcaagtgtagcccctaggttgttgactaattttcacctaggcctaattttgtataccatggcggtttcttcttaatattgtttgtgaagccttgaaaaagttgcagagttatgtggaatgccttctccacatgtacatgtggctacatgcactaacatcactgacaattgtgctttaagattactgtgacttttaatatggaaaccaaccaaatattcaaactgaccagattcatcataatctctttggcacaaatacataagcacttcagatgggtacttgggtaggataatgcatgtacttgtaaggcctgtatataaatttggagatgcatcttgtatttttcccttcctttgtgtcttggttttggctggtggttagttggctgatgttgtacattcttctggtctggtttaattttaatcttcgtggcaatgtttatcctgcagtttcttggctgtttgaaagatgatttgaattctgaggtgccttgggcactgtaacaaatgtcacggaggcctgtgtggctgtgctgtttcgctatacatatttataaggatgaagactaatcctctggtgtatgggatagcttgggaagaggtatccttttcttcccttgttcacatcttcgacgacttgcataagcttattctggaagtacgtattttgtagtgtgagttgactactgtgttgtatgctaactttttatgcattagcagttgcggtagtgtgacatattctgtgtattactgatgatcatttctatcatgcgacaagcaagataattgtctttgttatggtacttcattgcactattgatactcatgctctggtttttgaatctaaattgaatctttttgcaactcccagtttcatatttgccaaggttattggtgattgttccttggttgccaagcaaagagcgtttattattcatgctgcatgtgcgctagataaagctatgatggtgcggttatgtgaaaagagcggcaacttttattgcacagaacttggtcgaattgcaaaccacttttaccttcagtactccagtgtggagacttacaatgagatgctttggcatcacatgaatgagagtaaggtgataatatatatttttctctttttatttatatgatgcttgtaaatttgcactaaccttttgttagaataattgggctaggcccaatttattctattaaatctcaaaggcccataataaatgttaaggataataataccacctctggatttaagcgagaaatatctcaacctaaatagggagttattagaggctccctgttgaccagttgaggtgggggtcggaatgccacacgcgcgcgcgcgccgggccgggccggggcgtgggcgagggcgaggcgagggcgtggctggctggcggcgtgcgtgcgtcacgtcgctatccttttgcagccactaacccacgttccacgattccctccgcaacagcgcgtccacgttctttctcctgatagataaggaggccgcgagtccgatccgagttcctcgcttctttcccggtgttagtttctccttctccgcgcctgagttgctctcgcttctccgcttctgatctcttgcgcgcacgagagattggaagaagcagtgcctccgaaaccacaccttcgcctgagatgggtgatcaggtttttgggggagtgcctcctgcacgactgctcatcgccatgtctggagttgctgccgccgctattggcggaggtggtgcgccgccgccgacaggagctggtgcgccaggaggaggtgccgtgaacgactacaacaacggaggcaattctgcctcaccatccagcggagggccattctcggggtataatcttctccttctactgctgttagcgttactcctgttcccattgttagcgctatactgtgtgcgctatgttcttgttcctgttctacatgatgcctttagcatgttatcgcattattggtatgttcctgattctgacattcatgatgcgcttagtatgctactggttatgttaagatcaccctacactgcttatgccatgatcatagtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcactcgaggccaagttcggagtctgacgccggcagtgagctgtatgtcatggagcagttctatgactacaagatggtcgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacatccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaaaggagactgctttgtgtgtggcaagtctgggcattgggccaaggactgtcttgagcgcaaagacaggaagtctgccaacatgatcattagcgagggcggaggaacatcggggtacggtaaaaaattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcggttgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtcaaagttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatctttttgcgaagagtttggaattattcatgagatgacgcctccctattcaccccaatcaaatggggtggccgaaagaaagaaccgtactctaactgagatggtgaatgccatgttagacactgcggggctttcgaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgttt

SEQ ID NO: 56144 - DNA, 1549 bp, Oryza sativa
gaaacgcctgaggaaaatcctgaggaggacaacattgtagatactcgcaagagtaagagacaaagggttgcaaaatcctttggagatgactacattgtatacctcgtggatgacaccccaagaaccatagaagaggcgtattcatctcctgacgctgactactggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacagctttcctaaacggagagctggaggaggagatctatatggatcaaccagacgggtatgtactagaaggtcaggaggaaatggtgtgtaaactattgaaatccttgtatggcctcaagcaagcacctaagcaatggcatgagaagtttgacatcacgcttacatctgcaggctttgttgtgaacgaagctgacaaatgtgtatactatcgctatggtgggggagaaggggtgatcttgtgcttgtatgtcgatgacatactgatctttgggaccagccttaatgtgattgaggaggtcaaagactatctgtctaagaattttgaaatgaaggatttgggagaggctgatgttattcttaacatcaaactacaaagaggagatgagggtgggattacacttgtgcaatcccactatgtggacaaggttttgagtcgctttggatatagtgactgtaagccagctcctactccttatgatcccagcgtgctattaaggaaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaaggatatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggctgagtggcttcgtgaactcctgatggatttgccggtggttgaaaaaccagtgccagcaatcctaatgaactgcgataatcaaacagtgattattaaagtgaacagttcaaaggacaacatgaagtcatctagacacatcaagagaagactgaaatctgtcagaaagcagaaaaactccggagtgatag

SEQ ID NO: 56145 - DNA, 3886 bp, Oryza sativa
catcgccatgtctggagttgctgccgccgctattggcggaggtggtgcgccgccgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgttcctgttctacatgatgcctctagcatgttatcgcattactggtatgttcctgtttctgacattcatgatgcgcttagtatgctactggttatgttaagatcaccctacactgcttatgccatgatcatagtttcaatttcttggattaaaatatgccgaataatgactatatttccaacacctttctggatactgggggtcccattcctctggattcgaaaatagtgtattaagagaagaagagcaggatgaattagaatgcatgcccacaagatattaaggggaagtttgggaggggggacccactgacaaacataggaaaatttcaattctcatacaggtatctattggagaaatgctgtttatcaataattcttgagtctaacaactttctttaactgagcacttgtatcaactttgcaggtttacatatcacgtgctctacttgataactcctctttgcactctaatgctcaaagcattagtcgaagcttggatcatgttatgaggacattatttgagatttgtctgcgtcaaaggtggtctgagatgacatccttattattagagtactgcaagggtgttgaccacaaaatatgggcagtttgtaatggaccttcctaatgaggtttttcatcagttaccgcttgccatttacatttttatgtgtttgctatttttttatgtgttctctgaattagatatgtaaaatagtagacttgaggatgaaaatatctatctggatcgtctttatgggatagaagaaaatgatatcggagctctgattcactcttctcatccaggaaaggtatgccctgacttaacaagtggtacctgtaactttgcaaagttcatacgaatactgcaattactgaaaagtactggctaatgtaatttacaacaatcttttgctgaaggtctttccatatgtcaacttatcttcttgtgtgagcccaatcaccaggactgttcttaaagtaagggcttttggaagccatctgcagccttttttgctgagaaaggtgaactcccaaagagatttggtttagatcagctacactgggaatcctcctgcaggtgataaactgtaccagtcttcctttttcttctctaaactgatatttctaaagaaatgtttctttcaaataaatgtatgatgcattaatccagaatgtcttctgttgaaacctcaggatattgcacagcggttcctctcttggtcatactccctgtgctagagagttaaggtacgcagaaattcagcactgcagacctgtattattaattgcacctaattcaacataagggcttgttagtgcctttggacattattatgcttattattgcaataacttcacttcaacgagattgttttatttacaaatgaggatagtatcacaaaggtagatatgctaagcaattaagcacactcatatagaatcagtaataacttgttatagtctctatggtctcctactttcctaactactactttcgcaacatattaccttaatattgcttcatagtattagctaaacggagaaacatgtgtagggtgtactaaatgctgcttgtccacttgccacttgcattcacagatccatcttagtggcattgatgtgctttgtctttcaggcagttgctcttagtggcattgatgtgctttgacttgtacaaaacatccttggatattcttttaatccatcttgagttatctgtccatgtgtagctttctcatctgagagcagcataatattcttagagatttattgaacaactaccgtaataggcccaacagtggggctaaatcttcaagaaagtgtaatgataggactgtagctttctcaaggagactttaggtttgtggtgtttacattggcaaacaattcagtgattatcaattttctctctcttttctactcgatcatattcttatttctattttattagctaccatcgctggaatttttttttatccctgtaggaagtttctaggcagtgcggtttcaaaaaggtttttaagcagaaagttttttgtattgttatagaaagtttatgcatagtaatgtttatttcttgtataaactttttgactagaagtttctgagcacaaagatttgtgttctagaaaatttatgcgtaataagcttcgtattcctgtagaaagtttatgtattcctgagcagacaattttttatcctgtgggaagtttctgagcacaaagcttcctttgtttatcaatagacttggctataacacatgcatacaagttttaatgacaagtctcacgtactatatggctgcacattgctataatgagaagcactaccctgaaatcaaagctatcacaaagaaatctaacactgaatctgtataaatatgtgaaccgcactgtcggcacatcgccacctctacattatgtaaatctgtattgacagttacatggaaaaccaaacaaattctaaccgagatgagtgaacttaagtgaaaatcaagcataaaacactgtattttttctataaaatttggttttcaaattaaatcatcaccatttcactgctgtcttgtatgacctctacatttgacctatatcagaaagaaacaggtcatattgtactgccagtatctttctgtttttctcctgcagttctacctaactgagacactaacagtatacaggatctgcgtgggatgactcaagcacatatgccaggctgttggtttcttggtatgtacctcaaacttaaacatgtttcttggtgtgtagctcaaacttaaacaagtggatgtttatttatatgtaaacaacaaaattgatggaatgctgactgatttttaattacacatgatctttcatagacaaaatcttgatgaaaattgtggccattcttggcctcacgtcagataaattcttacatgggttttctggttgtattttgtgatgtgctgcaggtcatttataaaacattcaggatttcatacatggaaacgataaatgatctgctcacagtaagtacctataagctaacttcgcaccgtctcgtgcgagtcgttcaaaaaaaatgaaatgcttatacgtactcaaggctaaaccaaacattagtgtaaatattagacttttacagagtagtacactgggtgtaaaagatgataggtttagtaattattggcaagttgttggaattaacagtgttcttaatgcagaccatttcaaattgtagtgctagaactgtgcaagctgtatgcacattcaaagggaatagcgccctagcccaacataatatcttctctgtttttaaagaaaatagtgcagtttgtgggtatacattattagttactttttcaatctattgcaaatcctgatttttactcaacagctagacattctgaccaaatggctgttcttctatatgattgtttgattctattttcatagattttcatttttacaataagtggttactgtttttaatcatatatctttcctgcttgccttggtcatagcacaggcatatacatgatacatttgtatgatcatacattcaaattttgtcatgcatagagcacataagacggggaaagcaacatgtacattctttacaatcctgcaccagagagtttgacgatgaagtttttcattaa

SEQ ID NO: 56146 - DNA, 2285 bp, Oryza sativa
ggcgttgacggtagcgaactcaccgtgcagcccggcagtccaccaccaccgttggttgctgctagcgctgtgtgtgtttgtatgtattcctctacgtcgcaatgaagcctatggcgatgggcgttgtggcatacaacgtgtacacaaggtgtacggtgctatgaagctatgaaggtggcgatcttgggcaggaggcacaaaggcaggagacgccaccagtaaacatgtgtggacttattagctagcgtacttcctcggaataagtccgcttaacattcgtcatctttacgtggaatttagttgaaatccctaaaccgcaaaaccaaatatcttcaccttccatcgtagcaaaaccgtcttagtcgggtcccatcatagtatggatggttgttttaacttatgtgcatcctagccaatagaaagaaaataaaaaacatttgagatccatatatgttaggagatctctatttcctttgatcgccctctctcatctattcccatctctcccacttcttccttctttccccatccctctttagggcgacgaccagtgttgacatggggagtggcggtggcgggagagaggagacaagacaatggtgggggctagacacatggaggtcacaccaatgacctcatcgtggaggtcacaccctagcatgacacatacaaaaaggaaatggaaagctagaagattgcttcgtcaccgtacaagggcggaagggataatcaaaattggtccgtgctgcctgttgtcagttgtcacaccatttatgcctctgcggatcataacaaccatctgctacaactgttgtccgtcatcatctaaatccccttatgctgtcgcccgtattttgaacgctcctagtgcaccgcgaagccactttgcagcgctaccattcaaactcaatccccttatgctgtcgccgtattttgaacgctcccagtgcaccgcgaagccgctttgcagcgctaccattgtcttgcgcagatcgtcaaactcgtcgtcgctcctagagtgttgctgcaactgcctttattgccatgagatcgttggagatgctccactgtcatccacacctcttagcaatcagatttggtgtcgacgctcgcttggcaagtgatgcctctaggacactgccaccagcctcatctgcattaggcgagctgacaacaatcacaccgtcagccgaccctgtcaccaatgaccaccgtcccctgttctcgcctggcgccgatgaaggggcggagccagccagtgtaccttgctccaatcctccaaatcttaaccaagccagtgggagacaggtaaaataccacctgttttcagctttcctacagtttcatcaatgaacgtaggatggtctggtactggcactctggtgatgaattaaccaagcacatggctgaatagaccactgatgacttggataaaagcacgacacacctcaagttacacaagtctgttattaataactccaaataaattaatggaggcacagacctaaataatggacaccacaccactaataactcaaaacgtaaagcacgacacatctcaagttacacaagtctgttattaataaattaaccaaggcacatacctaaacaatggacacaacaaataacttaaaacataaaggacaacacaccttaagttacaaaattaaatactgggtaataatgatccgacatccaagttaccaaccatggcaacggctgcaaggctcccggacattgaacttgactgtagagggaattttcccctcgatgtatgttcggatagccaagagcgaattatgcactcccttgataacatcctgatccaatgggaggcagacatcgatgttgccgtcagaacaccgaagttgagtgcaaagagtgtccaatgtaaggcactcaagggacgttgtattttccataatatgacatattagctcagccaagcttcttgtggcactgaaaccagtgatcttcacattcttaagcttgtcgtgccggtgttcggggatttgccttagacatatgggatccttaaatgtcaagtcatgcttctctttctgtgaaatctgaagatgaaaaatcaatgatacttcaataaattataaatggtccaccatagttattagataagcattgcataatgaacggcaacttacacataggatgaaagtctccaaggaaggagaagcatcaagaaaagatgcaagagaaaaataatcataagcccaggaaaatctccatgttgcaaaagtaatcctcaagtatctaaggtggaggaattt

SEQ ID NO: 56147 - DNA, 4516 bp, Oryza sativa
  unsure (1)..(4516): unsure at all n locations
gttagtagcatgtgtagcaccccagtagctagctggcgccgccccgactgctgccgtcgctcgccgcgtgcccgccgccgtcgccggcctccctcggtgcgtttcctcctaatccggcgcaagggacggattcccggagtcgcgtagatgctctagctcgcccgaatcgatctcccgtcgcgccgtcgccgtttcccccttccctcgccgccggttgccgccgccgcaatccgctgccgtcgagctccctccggcgaatccaagccgttggctcgctccctctcgttctccctcgtcattccggtgtacaccccgtcgcccctcgtcgtcgcacggcgtcccggagaaaccgccgccgcccgccgtccattcgcggccggcgccttcgtcttcctccagccggcccgcgtggcagccacgtaggcgccacgtcggtgccacctcagccgcgaccgggtcgagccgacctcggtcggccgctcccttcggccctgctcgcgcgcgcggtccaccgcgagccgtgaggctgcgcgtgggcccgccgcaccgtgtcctccgcaaaccgcgcgcatgcaccgcgcctcccctccccaaaccctagcacgccccgcgtgcacctcgctcacggtgagccgagccgccgacaagcgggtcccacccgggaccatgcaaggtgaacccggcccacccgctccctctctcctctcctccccgcgagccccttgggccgtccctcaggccggccggcccaatggcaaggccgggccgcgccaacccctctcgggccgcgctcaagccgccagcgaaatctaattcccgtccctctttcttttcttttcttttctttttcaaaaaggatttaaataaatccttttcctttagaccaaaaatccaataatcttagaaactcaatatcttcccaaccgtaagtccgtttgactccgttcaacttccaaaattcctcaaatctcgagatctatctaatggcatgcctagaggtcaataatagggctttattttcgccgtttgttgagctgtcccgtttcgcgtgtagtttcagagcccgaagacccgcagtgcgaggatttcgaggatcaagctcaagatctcgagcaaggcaagtcacctttgaacatcttgcacctataatgtaaatctaagtatttctttttcgcaaatattgcatgaataggatttacacaagtaattcggccgcggcttgtgagatagcctgccggccccccaatcctaattgctgcaattaccctccttgaattattgaacacttaaacctcctttgtcaactgttgtgcttcgatgcacgggccctcaggtacgtgtaccggaacacccttccccccccctcaaaatataaaatatccaacgatgggtaaaacttgggttttacaaaagacttggaaaacccgacacctgggtcggtgcttgcgaactaaataaatttccaaaatcgcggaccggggaacgtaccgggtgcacggtttcccgctctcgcacttaagaaccgtttccttggaatttcatccgaacataagacaagtgcgaccacatgggtggaatgggacaccccgattgagtaactagctaatcgggggagccttgatgccgagagacatgtggattcaacggggtggtgtcggggagaacccccgggcttcctggcacagtatggtctgggacctaacctgttgttggtctgggacccctctcgtcggcatatggcaaccctgtgtctgctctcgaaatgccttgtcatgaaaacctttatgtcaccagacgtggccgttctgcacgggctgggtgattcgggttagtaatgtcgtgtgggtaaagtgtaccccctctgcagaggttatcaaactgttcgaacagctgtgcccacggtcatgggcggatgtgaggtgattcataaggtanttttgtttgactactgctttgtgaaattgctgttggggattgggttcgacgtttggaaaatctgcggcggctgatgggatcagccaggcccgggtggccgtttgaaagttgttggccgggtgccaaccttgaaaccaattcaaagactgatacattgcacatactccgaccggacgagacgcactgcctcatccgtgccgtttgagaagcactcacttagatgtttcaaaaaggagtttgaataaaatcatttgcaaaaacaacagccttcccgttgaagcctgcattaaacacttatttcccatggcttgctgagtactcctgtactcacccttgctctatataaataatctccccccccccagttgctgaagaagatgatgtggatcccgctgacgaggagttcttctaggagcaagtcggttacgacgagttttagggtttcggcctagttcccaagtcgcgcctgtgatgattggtccaagtctcggcttccgctttcccttttgtaatgcagttgtgagctcgggatctgtccgcagcccaacatgactgtactcctactctgtaataaagagaccactgttgctgtgatattctgtcttcccgtgataccagcactgtttcctgggactggtatcgattaacaggttaatttggagcgtcacgggctagttccgttcggggctagttcgggacgtgacaagatagatgcaatcttgtcaggcttctcaagctaacaaggccaactgttggacagaaggaacaatgaacaagtcgaagagactgaatagagtcgccactctcattagataaaagtgagcatgggaaattgtacttttcctcatttgaagtcaacacgagagtgagttctttaatcccagatgtaatagcaatctcaagccaactattgagatgataataggtgttggcattggaaaaaggatgtaattcaaggctaaatgtctttatacctcctgagtgatttttcattatgcggtcaactttgttgttgtaatctctaactatcccaccctttttatgtggcactttattcaaacccatcgttttccaactgaaaatgaggttgggatgacacctccagaaacgtagaaaagcctgagacacgcaagcagcacgggcagcatcttgcagtggcaacaaggaatgtatatggtgccatatgtcctgcatccacaagcatttagaaaaatctcaatattggaattcaagagtaaataattaacacaattagagaaagcaaaaaaaaaaaagatacatatatagtggcattctataatgttgctctacacatggttgtataaaatgcatatggcattcgaatggagtctgagctcatttttcagtttgtgtttgtgtattgtgcacgatgtgattattttttaagttgtagtagaaccagtttgtttgacaaaccaaattttggtgcaaccaccctcactagggaatggtccgttgccatccctatgtaggaccgtacaagattgcagtattgcaggatttgttcacaactcaatattttgctaacgatcaacccaacggtttgtggttagagcaataacggtgacattagctccctctgcttacaaaaagtcttttggacattgacacggtctccaaaacagaacattgactaataatttacattataatctattgttagcctgataagattatgataatatgaaattactttctgagacatccaaatatatgattctggcatttacggcgtacctctggaaggtccggacctgaatatctcattctcttcacacattgagaattatcttgttggcagggagattcctttcttttagcacattgagcaagaaattgatctgcaacatgttatgctcatgatattacatacaagaagaaaacaacaagaccaaggttgataccagtcacaatgaaacacgcagagaacaaaattggatccattagttacagacaagaatttcagtagagggaacttgttacagtatataaaaaaaaacgtcaattgagcatttgaggtattattgaaaaatgatgcaaccgtcccaaaagaccatcagacaatgagttggaatctccaacctcgtagttataacatctaaccctgctcactgttgtgtttggctgaataattcttgctcctcttaaccatgatagcctccaccatggaaaggaagaagcgtgctatatatccaactaggtatgttttgaaggtcacataaaaaatggacaaacagcaaaacacattaaaaagaggatttttcttcaacgttctgtaacgtatataagcttaggaatcggctttaacagtttagaagtggtatagcacagcacgtcatgaatcgaataagaaaaagcatgtcatgcggatagcacaatataggactagatgaattatatggacctaggagccaaataggtggcttacaggtttcgatttggagacggcgctgctcccgccttagggacattaaccgattcagctcatgtagtcccctggcgcgatgatatctcggatctagtcgagaaatcggaggcatcgggtcgggggcacctcaga

SEQ ID NO: 56148 - DNA, 2468 bp, Oryza sativa
ctacaagtttaaaaaaataataaatttaactgcaaataaacgtatagtaatttgagctttgtttgttatttttattacaatttatataagttgattttttaacttgcatggttgtggagtgatatattacatattgatttatcttgtcaattttacacggttttaatagttgaaggggtcgatatatccggttttgtgattgagatatacgaataagatctgaccaccactacccaactctatccttatccacaaccgaccgacacatcccgttctctcaacggcgcctcctcttccaccaccgtaccgctcttcctgttccgctattgcgccgacgccgcccctcttccgccgcagtggcgctgctccccctgctgcccatcaccggtacacttctcttccacctccggtcttttcccctcgttttatctgctagcggtgatggtggaagggcccagcatcacctctccccccttcctttactgcgagtggcgacggcggatccccacaacgacatcgaatctggccgctggcctctcccttcccaccctctttttgtggtcgaggggctcacgagcttgccagatccatcaacctcgttggggaatggcgatgcgaccacaacagtggcgagcggtagatttggctgtgagttcgctggatccgacgattggcgaccacaacggccgcggtgagagcgcgatgatgaccacggcaagccctcctcgacctctcctttttccccaagcacatcaagaggctccggttctccccaatgcgtggccctaaacagtggtttcacacctcaagagccgaagcgtgccgaggcaaccatgacctctacaagcacgacaagggcttatggaacaacggttctaatggggaggattgaaaccactattcacagtggtgtattgtatatggccttataactaaaaaaaactagaggatgccttgcgcgttgctgcggaatttggttaacatcaatttgttagataagagatatgatctcaagaagaaacagaataaacagatagctttcttagagaaattttttttagcagacctatcaataatttgtagataatttaggtagcacatgtcaactgaaggagcgttcaaccataaagatcttttatacggttagacgggttggatacatgtagatgtgtgtagagatgggccaatgtgttcatgtgggctacatttagcactgaagaggcgaaaagactcacccgatgactgatgggttgggctctatcctgtattgcatcaaacgtcttagaagcaatctaatacattcatccaacggttcagaatttgatgatgacgtggaagcacaagatttgagcttttggccttaattttatataaaaaaaaaggattacgatcatttgtgctgtgtcctctctattctctccctctctcactcttggactattggtcctcccagcgtcggcgaagcgaggcggcgagcgaaacaatactcccaccaaagccccacaattgttttgccctttttttattcttttcagagcgaagaaaaagaaaagaaaattataaatgagagaaacacacagcccgcttggacttggagacgagacgacggaaggcatccgtgtggtggtgtgtgccttgtgcttgtggggtcaaaaaagtcaaagcgctgatgctaaccgctcgcctatctaggcaaacaccagtcaaaaagctgacccacccacgccaccaccacgctgctccgctccgactcctcccacctccacccccaccacccgtcatcaaacgagtaggagtatcaattatcaaacattcaaacccatcaccgcatccccaactcgccaccaaccaccaccaccgccgcacgaacccccgagcgcccgaatcccacaccgcaccacgcgccgcgccgctgcggccccgtccccgcgtcccctgttccgccccccggctccggatccgcttcaccttcacgtggcgcaggcgtccccggtttaccccaccgccgtcgcccgggtcccgccgcacgcaggcgcccgcgtgtgtgcgtgtcctgcggcccctctccctctcgtcgtcgtcggtgaaaaaggaaaagaaaaacagagaggaggaggcgtttttaaccgcggtgctcagcggggtggtgaaaaaatctccgacccgggtccaaatccaggtgacggccgttgaccgcgaccgtgggggcagtgaagtggtggccgggagcgagcgggaggaggaaggagacatcgaggggaggagtgacccggaagcaagcggagggcgagcagccaagccagcagcggatgggggagtgggggcggtggtagccatctcgcgcacgcctttccccgtacaagctgctcctctctttccttatctctccccccctgattactacccagcagctgcagcccccgccctcctcggcggatcggaggggcagttgattccgggcggcggcg

SEQ ID NO: 56149 - DNA, 24929 bp, Oryza sativa
atgggttcgaccgccggaaggggttcggcggcggcggcggcggtggcggtggtttctaccacccccggtacagggagtccccatctccgcgagggtacggcggggaccgggcgatgcaccggtccgagagcttctcaggcttccggcgggagttccccaaggggttccgctcggagcgcgaccggtctcggcgggacggtggcggcagctcggcgtggaggcggcagagcggcgggtggagggattcggaaggtttggacgggtacagggcggcgcccaggcggtccggggcgtcgccgccgacgccccactgcggttgcccagtgagtctagcaggaggtttgatggtgcgagggtggagaagtccaggaagcagagctttggcatcagcgagatggaggaaggggaggttgcgccagatcccgagaccaaggcccgcgctgctgcggtggatcaccggaagcagatcgagttttctgggcatgccaaggagaaaggaccggagcgcggtgaggtgaaaaaagtggaatccggtgtgagaggggatttaggagctcatggtaaaggagtggctggttcatctgctgctcgcaatgcagggagggaagaagggaagatcaaggatagtatgattgcagaagcaggaacggtaactcatacaaggcatgaaaaatccacctcagatgccgcagtatcaacggggagaggacatgaggtgcaagggcaagatgaggctgccaatgctctcaatcaagttggacagtgcgtttcatccagtggaagtcacaaggtgccacaggaggaaacgatgatacgggatgaggctgccaacgttgttgatgcgattgggcagagcacttcgtctgatatccagcaggaagctgtttgtgagaaggcggctgtacgagatgaaactgctaatgctgctgaggaagctgggcagagaacttcatctagtgtacatgaggaggctattcatgaacaggcaactatacggaatgaaactgctagtgatgttgatgaagctgggcagagcacttcatctaacatccggaaggatgctattcagcaaaaggcgactatacgagatgaaactaccaatgctgttgatgaagctgggaatggcacttcatctagcaaccaggaggcggctattcaggaaaaggtgcctgtacaagatgaaacaaccaacgctgttgatgaatctgggctgggcacttcatccagcatacatcaaggacttcaggaggaagcgatggcattagatgaagctgttgatgctgctgatgtggttaggaaggtcagtttgtgcggtatgcatcaagaagctcttctggggaaaacgagagatcaaactgccaatgatgttgacagggttgaatgtagtacttcatctggtcttctgcaggtgacaccacaggaaggaatggcatcaatagatggaactgccaatgctgttgagccagagaagattgattctgatatgttgaaggaaacgattgaaggagagctggtgctagatggaactgctgatgtggtgggagagggaaattcacctagcactgtaaaggaagcaatgcatggaaaaataactgcagaagacggttgtcccagtagtgctcttgaaatagctaaaaagtgcaagcagtcggctattacagaggaactggtacatgaaaaggtggcgacctctccaagccaaggggccccagaaatgaaaaaaaatgaaaaaggtactatatccagcaagaagatgagtgaatcatttgaacctgatgcgtctcaacatgtggaagaggcactcccgagggatggccgtgaaaatatagttgcattaagtgatactgaagtcccagaacaagaggcagctgctgagaacaaaactatcgagaaggaagtaaaaggtttttgtttggaagcaaactcagtaggtgctaatgtgttccttcaaccaagcaaggaatgtaatggggataggaaggaagagggtacagctttaaatttaattatggggaaacctagtgctgaagataaaggaaagggtatagcatttgatgtccttagtaaagaagaagacataggggtaggaagttcagtaggaagatcatttgacttagcactgcaacctgacattgaccgaacagaggtgctaaaatctagtgggactgtttctgtaaagcaggaagatgacacacctaagatagggaggcttgacctttcacttagcttatcaggttgtttacagaatcctgaattcaaatgctcagttcccagatctgaatctctagaccttgcaacatgctcccaaatgttgccatcatcatcgttccgcacaaattcagaagggttcacaggttctgtatcattgaccaattctcaaacatttgttcacaatcctagttgctcacttacccaacagtcattagacaactatgagcattcagtcggcagtaaacctttatttaagggtgttgataagttgagcgacagcacaagatggcaagctcagttgtcgaatgaatctactaagaagagggaacctaccgcagttcttcagaatacagtaaaatatggtaatctgccagacaagacctttcttggtgtgaatgtgcagaacaatgggatttccaaggacattcacaggcgcgcagggatctcaggtgttttgtcgccaactcatagtcgggattctcatgattcaggatttgaacaaagtagacatagaaggcagctcacaagagagagaagcagcagcagtcttacaaggggtgagcggcaggatgggcaacaacttgtccttaatggtgctggtgtcatcgaaaggattatttccaagatagtatcagaacctttgcatcatacaggaaggatgcttgacgagatgacaagcaattctgtaacatacttgagggaggccatttctgatatcatagctgatgcggataaaagagggcaggtggtagcattgcaggaggcacttaaaaaaaggtctgacttgaatagtgaaatgctgcaaaggtgtccacgcgtattgctggagatactcgttgctataagaactggtcttccagattttatgaagaaaagtaatagcattggtacatgtgatttggttgacatttttctgtatttgaaatgccgcaatctctcatgcaagagcattctaccagtagatgattgtgattgtaaagtttgccaacggaagactggtttctgtagttcttgcatgtgcattgtctgctcaaattttgacatggcatctaatacatgtagttgggttggttgtgacgtatgtcttcactggtgccatactgattgtggcctgcgccactctcttattcggaaggggggaagtggctcgagggcatatagtactaatgagctgcagtttcattgcgctgcttgtgggcatccatcagagatgtttggttttgtgaaggaagtcttccgaacatgtgctatgcaatggaggatggagactctggttagggagcttcagtacgtagaaagaattttttcttcaagtgatgatgcaaggggaaagagagtcagggactttgtaaaacagatgataattaaactggaaaacagggcctatcatcctgaagtagtgaaatatatcatggcgttcttttctggtaagctactaatcatagttcataataaaaaaaataatagttatcattttcatgcttgataaagatgtttgttttttgttttgttgtcctgtaagatattttatatttctggaaatagaaataagatttctatattttacacaatgctatagcagaagtatcagctatattggcaaaaagattatgtgatccatgttctgatatcatgttgttatattagagatgctaatggtcttttggcaataaaaccaggctaatgctcgattttccctgttctagatgacaattctaacgctggtagtggtacatcagtaccactgaagggcattccatgcaacattgctgaaagaatagatgggattcctagttcaagtcgaaaggcaccatcatggctaccatcggtgaccctggagggagttccatttttagaaaaacaaggagtaatttcaaccaccgggagcccattaacgcttagaaaatttggcggaactgacttccagacagttgataataagcctactgttgatgaactggatgccctaatcaggttaaagcaggctgaagcaaatatgtaccagcaacgtgccaatgatgcacgcaaagaagctgagactctgaaacacgtcaccatggttaaacatgcacaaatagaggaacattatgctactcaaataggtgaactccacataaatgagttacaagagcaacgcaaaagaaagattgaagaactgcaagtcattgaaaggacacaccatcgatttctcagcatgaaaacaaggatggaaggtagtattagggaattattgttgaagatggaagcaacaaaacaaaattttagcacatgagccaagataacagctctgggttgaagataccaggatttactcaacttgcctaatgaaggttccatgtgatgtaagttctaagacttactgcacgattatcaattttctagtattttgatatagtttatgtttctgttgttttatttaacaatctgttattgagttttgatgatgtgcaataaactttagctgttacagtatatacttcacttttatttactgatctgctgttataagtctgtgtggagttaactgtttttgtggctttagacttaacagtcaagactgaagacaatgacctatgacttattgtgcgccaatttggcactggctttgttcttttgcatacttatctttaggtgcaccgcatcacatcccttaattgaaaataaggggaaatagtgacgttttggagtttatcttgtttacaggagggcagttcttatcatcgtggcgtgccttactacatatctggacagttcttatggaagggtgctagactgcaaatctgcaactttaagcatcacaatgaagatgagcatgaatgttctcttatgagaacaggcgagtggatcataatcgttgcaaaacctgtttggtcaaatacaattctgaatccagtatggattgttgttgcaagggagaacacaaactgaagcacagtaatcaggcctgcaaggtcctcgaagcagaatttcagaacgtagctagacagcatctaaattatgaattgatgttggcaatagtataggtaggcatgaattatttctcgtatgtaaattatgataaggtttatggttctgatcttcagtgagaagatgcattaccagtttcctttttttttttatctaaattatgcagcgtttgtacgtcggccacgtacgtgcatgggaatgcgccggcatggaatgagtgtgaaatgcaatccggaaatgtgtcgccagccgctcctgctgggatcacattgctgatatacagtattgaactgtaccctcaccgtcaccgactatatgcataaaaccgtcgaatttcagagctccagaattaaaatttggcaaaaaaaggtgcagatatatggcattctgttctgcaagttacactgaggcgccaactcgtgtcaggcttgctcggagaaacataaaaggatacaactcatacaacaaactacaaactcaagaagcactccgaattgaaatactcgccattgcttgcagtacgtacagagccgaaattgctacactacccttaagtttgcatgccgtcgctagctgcttatcgatcaatctcacatggccacgcatgagctgatacatagcatcggtgtagtttctcaaccgtgatttgatcagtgagacagtgacatatatatagaacagttcagcgactaaattaaacggtggcgccgttgctcttcccgccattggggacgacgtggtgtttgtcggcgtcgtccatgaagcgcttccagaaccagtgctgcttccacaccctctcggtcatctcctcgatggggatgttcttggtctcgggcaggaagaagagcacgaagagcgacatgacgacgacccacgcggagaagaaggcgaagatggcgtacttgaggtggcagagcatggagaggaacgcctgcgcgatgacgaaggtgaagagcaggttgacgcacacggtgacgctctgccccgccgaccgcgtctccagcgggaacgtctcgctggggatgagccacccgagcgggccccacgaccacgcgaaggaggacacgaacgtgcacaccatcaccaccaccatgatcgcccacccgtggccgaggttgtccgaccggtccgtcaccttgatccccagcacgacggcgatggccacctgcgacaggaacatctgcacgccggcctccagcagcagcatccgcctccccaccctgtccaccgagtagacggacaccagcgtggacagcacgttcacggcccccgtgatcaccgcggagtagagcgacgcgtcggtcttgaacccgagcgtgttgaacagcacgggcgcgtagaacatgatggcgttgatgcccgtgaactgctggaatatctgcagcagcacggcgatcaccagctgcggccggttccggcgctggagcaggttgcggaacgggtgcttcacctcctgcgccacgcggctcgcctccacgatctcgttgaactccggctccacgttgtccgtccccggatcttcctcagcaccgccttcccttcctccagcctcccgcgctcgatcaggctgttgggcgtgtccaccacgaacagcgcgcccagcgtcagcagcgccgccgggatgccggccagcgacagcgacagccgccatccccacgggtggatcctgcatgcgtacgtaaaatgatgcagctcatgtcagttcatcatcatacgtacaatgcattgcatttgtatctgaatgtgtgtgtatgatgatgtgtgacgtacttggcggtgccgtagttgacgaggttggcgaagaggatgccgatggtgacgttgagctggaagaggatgttgagcccgccgcggatcctcgtcggcgcgatctccgacaggaacaatggaacggcctgcacgtattcacctctgttattaaattcagatgggcttgacgaggcccattaggcccaaagtgacacttgattcgcctttgtttagcgtgcagatacctagctcatcattcaatagtaataataaacttacaaaggcaccaactctgccaataaattccccgtgcgtatttctgagtataataacaacccaagctaggttaggcgttgaacctaatacctaatcacatggcaatacggcatgacccttgaattatgtagatagttttgttattcagagaagatagtttttgttatcttaaccataatcaagggggctgatcggtagaggtggaattaacaaaccgtagtagttgtacatatggtagtattagactactactacgagtacgatagtgtctgctgactgctgctaccactctaatgtttgttgaacctaggcctccatcaaagtcttgttaggtggtgactgaataactgatcacatgaactctgtcctgtactaaacctcttgcatatttagtttattgtcttggcagcttcataattgagtctagacgtcccatatgttggcgagtgtgcgtaatatgtaaactactgtttcatctattagacacgaataaattcagaagaagccaagcaaattaagtactactcctactctcctaccaatcaagcacactagcagccaactagtactttgcagcccaaaactcagtgaaccaaaccaaaggtctacatattgcgacccgtgtggcatatgcgtggacagccatagcagcctctgcttaaaaatcaaaccagagcaagccaaagctgcaacagcatgtgtgtattccaagctgcatccattgaggacttgacagttgtggctgtaactagctagaagttgctgtaaagatcagtcaacaaagctgaccaatctccaacaaacgtgacaaacacaagtctgttgctacactacacaggtcgattcctccgttgataacaactgcgacggccagatagcaggcagccacacgcaaaactaccggctgtaaaatcatgcacacctatcgcctcttggttggctgcaacttcttcagacgtctcgactacaaacttggacaacaaaaaatgggtaatttagccaggttcagtaaggattaattaagaagcgtggctaatcctaaactaggagagtcacgaggacatcggaatcttggaacttaaaaagtttatcacacgcatgctgctgccaatggaagatgtcaacgtagacgaacacaagtcatgcacgatcaagactctctcggcaccggccgaggtgtccataaatccatgtatatatatgcccatacttctacgcgtttgaccccaaaattacggcaattacgaagggccccgtgtttaagtacagtactaactaccccagtatccgacgccataagaaatacgtataaaaatataatttttagtaatgtatatgctcgactcgagtataaaaattctaatcaggacggtggttcatataggagtattaggcaggcaggaacgcacgtcgttttcatggaagcagaaaattcggcttgcttgtgatgcaaattctcaaaccagccaccgctttatatgtttgacttaaactctgtgctaagacttttggactcaagtgagtagtatcagtttatattagtactagtcaataatatatggaatcaaagaagatgatgttgcgaagaaagtacaggacgaaaaaaggaacatggaaatatccgtgcaaattatgagtgaaaacaatagtataaggcgtaatgactttgtttaactccatagcttattatatgaaatgatataatgctgtaagcctgtaacgataagattattggaaagttgcttgcctggttggcaaagccgacgccacagccgagcaggatcctgccgactatgagcatggcgaggttctgggcggcgccgttgaagatgacgccgacgatgaagaagacgccggcgatgagcatggtgaggcggcggccgagccggcgagtggtgtaggaggcgaagaaggtggccgtgaggccggcgaggtacagcgacgaggtgaacagctgcaggccctggttgtcatacttgcagtagttgctctccttgtcctcgtgcttcttcttcagcaccgtcgggaagaactcgcgcaggaagtcatccatcgatgtcactccgcctaaccaagaaaaagaaattcacaagattttcaacggatattatttagtttcataagtcgtaaagttcgtcatctattgtggcaaaaatggcatgtataagtatgaacttggaatgttttaaaatgttgtgttagtgcgccatggaaaaggttgaatcagagagtggataagattttttttccgttttaattggaatttattgtcttagatgtaaaaagggaacatggccacacaaaattaggaaagaaagctgagagagttgcaagaaacgtgatccgtggataaacaaatgcattgacttaccagcctgtcaaagcaggtggctagctcataacactcgattccttctctaaaataacatctaaaaattttaatgctttgggatcctcaagaaaatcatactactagctggactgtaggagcactacaagccggaaactaatgaaaaaggataaaattgcaccaaatggactcaataaaatggcaagatcttttttgatcctctgtaaatggtaggtatttaatgacaaggataaaatcatccgtttcgctttaatctttgcgcttatatgtgcttatccatagcaagataacacaaatatgtagacagatcaaaccgataacacacacgtgcaagaggaatctcactcaatttcaagcaggagacaccaatatgaataatcgagatgaaccaactaatcaacagaaggacatcaaagccggccatggccatgttcggacatcgccggcggccggccgtgcgtagatatatacctgagataccgacgtcgtagccgaacatgaggccgccggtggccgccatgatgcaggagatgatgacgatcggcgtgatcttcgcctcgaactccaccccggaccccgacacagagaaccctcccgccatcttgccccctctctctctctctcgtcgtctctctcctctccggcgatctccactagctagctaccaagagcaagcaggagatggagacgatgaactcacagggctccaagccgctcgctatatatagagagggagtgggagcccgatcacacggggggagacatttcaaacgcatcggagaggcaggatgcggccacgtggcataggtgggacccaccgccgggtcgcctcccgggctggctagccggccggtcagcgacggctttcccggcggcccacgggccggaggctggccgtgccgcaagtctgcgactgttgcataagcagcacaagactttcaaatcccactttaattttttttgcttatccaaattaaaacctttttttaaagctttttgagctccttttggaaaagagggagagagcaagtaggagcagcagtttggaaatttggatatatagttggatatattgaagtttgaacgccggcctttttgacgctggatgtacggtactacagtattgattcctggcgttaggcgggcccgcatgtcagtgccttgacgctggttgctgtcttggtactgtacggtgatgctcacttgaatctttggcgagctgatcatgtgaatggaggaccttgacttgaatatttgctaaggaaaattaagcaacatgtgcgatggacatggtggagtagtagtgtagtactattacttgggaaattgtggttctgtggaaaatgcgagctaaagaaaatgacttctagttcggctagtcggcttacctagcttgtaatattttccttctagtaaacgtggtatcatagggcacaccccaaaattttacaccatatcacatgaaacgtttaaacacttgcataaagtactaaatatagaaaaaaaataactaattgcatagatttcgactactttgcgagacagatcttttaaacctaattgtttcatggtttgacaatatggtgctacagtaaacatgtgctaatgactgatcaattagtcttagtaaattcgtctcgcagtttactaacggatactgtaattagtttttttattagtgatcgaacaccccatataacaccctatataatacccgatacgacacgctaaaactttacacttctgcatctaaacattcccatagtactatattagtagtagctagtgtagatgacggcgtttaatcagaacacaagcagtggtgattagccgccgctattcttgcccaagagctgctagtttagtcatctttgtattgttattggatttgatctactcgtgattctcattaagatatgattgtataagatatacgtacgtagtaccggacacagttgctagtaataattaataggtatccgttaatcagccatgtgtagttcatgagaaagaacaaaaaaaaaaaaccgtgaacacgaattaacaaacgtgtggtctaacggccagtcactctccaaataacctccgtacctatgtctacacaaatttaattttgcttcgttcttctctgcatatcaacgaattgaacatcgaaaaatattcgcacgctctcactcttgttgagttcatacaaccgtatcatagtcaagtggtcatgtcagatcgatcaactaatatttggcaccgttttgcaacttacaatctgcacgtacgtactctccgtgcctatgggaattttcacgtaagccgatcgaactgggtgaactccttgtcgtcggaatcgtgctgtgatacgatgtttgacgcttaccggatggaactactccacttgatcgaccatgaactgattgtgtacacaccgacaaatgtactcaagcctcacgaattaacatggtgaaaatttccatggaatttctttcgctgacgcttgacgcgtgcacgattgatcacagctcgatccttgggcgctgcatacacgagttgccaccgtaaggtacgtgacgatttcgcgagaaatccttcgcgtggagcagtactattccccggacttggaacactcgaataccagccactcgaataccagccgtatgcagtccaagtccgcgcgcgcacgtaatcggtgtcggtttcatgcacgtagatcacggtgacaccgccgttttttatcccgtggtaaattttcccaacgatctctgcatttgagattgttcgtgtgttacaatttctaaaataaacacccgtcgcgatcggggcttgagcggcagatggcagggaggcaggcgcgatacgtgcacgtgtccaggttgggcatgactccgatcccccgtgcgtggcaagtggtgacgtacacgcgctttgccccttgacacgtccgttaatttcatcctgcttagttgacttctaatactgctttggacttttggtaatttcggagttgtaactactagtaccatccaccgcacagctgtacgcgcaggaactggccgactggtttttgtgtgtgtgtatgtgtgtttggatttcaccgtacttgcagtcaactgttgctggcatgcaatatatttttttaagttgttgttttgttgctacagtgccattgcaagtttgcattctgcttataagaatgacgtgaaggagccataggacgtgtcgagtagtgtccgtctcattgtttcacttatacttatgttatttatgttcgtacggtttactaataaaagattatggataaaaattttcacatatgtgcccttattgatttgattgaaaagcaaatgcaataaaataaattacaaatggaaacactatcaaatcaaatatctctattattataaaaattgaagatgttttttgccggtactttggtacgtcatccgtgtatgggtcgatttttaaattttttcgcttttagaaatacagatcacatttgaatcgtgttttaaaattgtttgatattagaaatatataaggagtcgcataaaaatctcttttaaaaaactcgcttttctagaaaaatatatatatctaagtgaattcccacaatgaattttatcttaactaaaccgtataacaataataagattaaaaataaccttcacccgtttacaacgcacaaattttttttagtaaaattaaaaattaaaaattaaaactttgattataagtataagtgaaaatgacgaggctgtgtattagggttgcatgcactggagcaacacgaaaccgggggagttgaccccggagacgaggcaggcgtaagcaatggaactctctgattgtttggctgctacggcgtctagtaatgcctattggtcaaaaatatatgcggccaacctgaagcagataattgttgattcacacggcaacatgttggtgcagagggcaagcaggaaaaggggtcattagattctcgaaattagttgtggtgatcgatgcttgcacccagcatacatcgatgcattagcccatgatctatacgtgcacgttttagcccgttctgtgatgccaattcgccctccggatgtcgcagccgttacatatcaccaacccaccagagcttccttctcgcatgaccggtagaaagacctggacgaatttgtgcaggtgcatgacacatcacaccgcctgtcgtcctaaggacgatgtgagttgtgacagagagagacagtacgccggcccgccactggccattactgagagcatgcttagggagcttttaactactactttctctcagaatcagaaactcatttaaacagttcagcttttgattcagattctgaggagttatagttgtaaaatttagaaaataaactagaagctggacaatcgagtttttctatattgtcaaaaactgactatcaatcagttgtttctcagttttttaagcttctcaaaacaagcaatgaggctaaacaagcatgttgattggtgaaccgagaacgatgggccgtgtatacaggaccacgatttgcactgggttagtcaggtagaaagactctcctgggtctggtggttagcagtacaggtggtggacctatcaaggaatttctggttagatttgcatgaatatcctttatatttggaacaaaggtagtaataaaggggtgttaaattacatgtcacatcaggtattatatacggtgtcgtatgtggtgttcgagtactaataaaaaaactaattacagaatctgtcagtaaatcgcgagatgaatttattaagactaattaatctgtcattaataaatgtttactgtagcaacatattgtcaaattatgtggcaattaggcttaaaaaatttgtctcgcaaattagttgcaatctgtgcaattagttatttttagcatatatttaatacttcatgtagatgttcaaacgttcgatgtaacatgatgaaaaattttggagtgggatctaaataaaccctaacgctgagttcttatctctatttatccaactcacctccctcgtttttcgcgtgcacacttttcaaatggctaaacagtgtgttttttgcaaaaactttatatacgaaagttattttttaaaaaatcatattaatccattttttaaatttattttagctaatacttaattaatcatgcgctacacgttgctctgttttacgtgttagggagggagggtttgttttttgcaaaaactttatatatgaaagttactttaaaaatcatattaatccatttttaaaatttattttagctaatactcccccatctacttttgatagtcatattttatcttggcataagtaattttacttatcatctatttaaacatgctattagtcattccttgtaaataagcgattcattaatatgtaaatttctcgatacccatgtagtcaatcttgtgaagaagaatggagagtcacacattaaatccgagaaagctattaagatgatatgttgttggattgaaatatacctatcaaaaataatttttttagatttgaaaatattcctatcaaaagtagatggagggagtacttaattaatcatgcgctacatgttgctccgttttgcatgctagggaagtgagggttcccaaacacacccttaaagtatctttagagttctttttcctttctactctttgcattttctctcctagagtctcttacgagggataacttatcctctctctcctaattacttcttttctccatctcatcatctaagtttatatactactcccttcgtcccataatataagggattttaaatttttgcttgcactgtttgaccactcgtcttattcaaaaaaaatttggaatttttttgacttactttattatccaaagtactttaagcacaatttttcattttttatatttgcacaaattttttttaataagacgagtgattaaacagtgcaagcaaaagctaaaaatcccttatattatgggacggagggagtaccattttaggatttgtgcttagaagcttatgttatattagtacttttgtaacaaatatgatgaacacttacgtttgtcactcgccgttgctactacatctgaatgtaacaaatatgatgaacagagaactcagggaaggatataaaggaaagcgatcaacactgggtttaagccaggtagaaccttttggagctagggccggttcaatttaatgccattttcaaccttaccaagttttgataaagttgctaaaaaaatagctatatttagtttgctgccaaaatttgataactatataagaaatcttgccaaaattttgacaagttaccaaaattttagcaactatgccaaaattttggcaatgctaaaatttgataaaattttttttagcattaaagtaaacaggcccttatatttcacaagcaacggattagacacctttagttttctactctagtgttatacaaagtggaatactcgagttccgaacagccggtaacattgatttattctatacacgcgacacacattttttgtacagagatgacattggcactctttatgtttacatgtaaaaagtccggcaaacaagctactgaaccaagtaaccatcatgacacggtcgaaccacatatgcacgaactacggcaccggatgatacgagtcatacaactacattttttttagataatggagtcatacaactacatgcgacgatatgcaatttctcaaggatgcagcttcttcgggatagtagccaggtcaagcgtactgccatacatcttggcgagagcctgtccgcaccagccatggccatcgtctagcgttggcatcctcacctcaatgaacggtggaacagcctggccctgaggcttgacgacgccggcgaataccctgaggacattgccagcgtcgatgtccatgcagacattgatttcgacggtgccctttgctgctgctggaataccggtgatcttgaagtatcccaatagatggttgtcttcagcctgattcccttcgccttcatagacggcaatgagagcttcggtctgattgtcgtgggttgtggtaaagagcatgtcccttctcgcaggaacagcagtgttccttggaatgattgcggcgaagttaccgccgtcagcacgaattccaaggttcattggagttgcctgaattgtcaacagatccaggctccctgaagggtcagatactcctgaggcaatggctccttccaaagcagcccctgaaactgcagcttcaagtgggtctataccactgtaagagtcgtccttcttgcataagccaaggacaacgcttctgattttaggaattctggaacatcctccaaccaatatcacatcattgatgtcctctggtgttaactttgcatcagccaggcattgcttgatgatcccttcacatttctcaaaaatagactgattcaccttttcaaattctccacggtccaagatctttgacactttgtggccagcccccaaatctacattgatctccacatgctcctgcgtagccagtttgtgaattgcatcctgagttgccatccggagtaagccaattgacttgattctgtccattgtttgaccagcatatagactatcaaaatcaggcatgagatggcgcatgacattctgaaggatatcctctccaccaacagtgcttcctgaaagtgctcttatctgagaaacacctccagcagtggcagccacagcagcatcacagtagccagcacccatgttaaatatcagagcaattttctcaatgccacttcccatattgtcatgtagcaattgctgctgctgttgggcatacaaaagtgcgatagcggtcggctctggcatgagccgtaacacatgcagcccagccatcgcacatgctctctcaatcctggtctgttgaaaccgactgaatgcaactggaatggtaagaacagcattcctcaccggatgtttgagatgcatctctaccaaggccttcaattcaaggagaaagatggcaagaacttcttcaggagtggtagaccgccacatattgttcaccagtgctgcaatgaatggtctcaccccaatacccaatgtctgcacaagaaaaggaaggctcttgctagcttgaaccacttcatctgtgtccattctcccaatcaaacgtttcatgttaaatatggcacttcctgacaaaatatctctttcctcatgtccatgttcccgggttgctcctcctgtaactcctgctgaaaggctgtcatctttgaacatcacatatgacctcatccctttctggttgcgagtgtttttgaggagttcaacctgatggccagtccaaacggcaacactacaatttgaggtcccaatgtcgattccaatagcaacatcaggaaacgacatctgcgacttatcttccccagtggtttcactgtcagatgccacagtgtataattgttcagtcatcctgcaaacaatgcagcgtcagtattgtgtacctaacattcttcttgttctaaaaagggaaaaagatctggttaatccaaactatgcccgccatttgaattagtagttttaaggccaagggtttatgatagtactattttattgcatttgcaaaatgtaacataaaagtgtaagccaatacataaggcaaaaaaacaagcaagaaaacagaattccaatgacactcgatgaaacggtgtgaaatcctagcaaaccaaacatgtccatgactcagaaatgacctattcgagccatttaaaggagctacccatgaaactatttcaaaataagcaatccattcaagtgatattttctgaatcctaacagtatttccttttcttttttcaggagtcctgacagtacttgtacatttcacatacagataaaaagaaattccttttttttttctggctctgtcctcatccatgcatatcggactcacttgatgcacccgcgaaggcagcttgaattatagataaccaattcgcgtatttgaaacaagtaacttgtcttgcagtacagttgtatatagtggtctcaactcatgtaactagatgacactatcctggatcgaccaaggaataagattgctaaaaaccaatgaaccaagtaatgagttgagttctctgcgacaagacaaacttaggacttagtaggtcacgtacttcgattccactgattatgccaatttcatgccttgccggggttcaggaatttctccaacctctagcactgacaacaacacatccaacatcaacgggataggattaaatgtcgggattttccagtagtaacacctagctactagctagcagacaatcgcatcgcatcgcattaggcttccatcaagagaaagtattcagcgaccacaacaggttcacagatccgggcttacagttacagcactacgacggggaacaaaccgaagcaggtaaagaaaacaaggcaagcgcagggtgtgcggagatacctcgccactcgatcgtgcgacggagatggccacgaaatccgggactctccggggcggcggttgctgggagggagtgcgggcgaagacgaagcttggggaggcgaagggtggtgggagcgagcagctggactggagccttgaagaaggcggaggaagaaagaaagccgcgccggagttttccggagaggacgggaggcggcacgcggcgcgcacgccgacagtgcggagccgggctcccgaagcgtcgggaagcggcgagacgccgctggagaagaagcgtggcttccgtgggcctggaaatgcagcggagatctaggcccagtgcacacggcccggatactagaccaaatttcgtatagaaataggcccatatgttttgggaggtacttggggttgggccgaacccacgaacgctccgggctgtaaaagtccgactagttcagatagcgtgctgggctgtaaaagtactccatctgtcatcgtgctgtgcagatgcacgttcgaaagtgatgctcctgagctattcgatggcagggaaactaatctcgagcgattaacgcaatgatgattaattaaatattagtacatataatatgtaatatgctcggactttggcacatctgaaagcaaagaatggcttaatatttcagaacgttcaaccttcctttcaagcatggagatttttttttgtcaacgaagttcttctgtatatgtgtagaatgaaagatcctttaaagcaaactgtttttaattggttacaaaccttataatcttcctatgtgaccctcgtgtaactctgtaatcttgtaaatattttctttctttataaaattatactgctggacaaaaccctggcagtatttccggtcaaaaaaaaatatgctcggacttggatttaacgtcgttttctgtaatatggcatgttctgtagtttgtgttactccctttgtcctctaatataagggattttgacaatttttctcgcgctgttttatcattcgtcttatttaaaaaaattaaaattattatttattttttttacttactttattatccaaagtattttaagcacaactttttgttttttatatttgcataaattttttgaataggacgagtggtcaaacaatgcaatcaaaatatcaaaatcccttatattatgggacagagacagtagatactattatgtaatagtttagaaatttgttacgtatttgactaggtcttcctttgtaactaaccctacctcccaacctatataaggatataatcataactcgattgtatacatacctagcggattcaatcaccgaaacaggactagagtattacttattatcaagaatggttgaatctgtttagaccttgtcccttttactcatactccttagatctcgtactatacgcttttttttttatcgttgatctagaaaatcgacaacgggtttatttgagtctttttaataaaatcctaccgtcctacatagaactttacttcaaacacacaccttttataagtttaaaaaagtgtgctgatgataatcaagggattagctcatcctaacagaaaaaaaataacggggcctaacctaacgcttacactaacagcatctgggacacattaagctcgtgagaattcttaaggatgttttagtttagtgttgttttggtttgatgtcaaattttgctccactaaactattggtattttaaatagtgatttagaaaggtttggactgctgccaaaagttaccaatacatatataaattgtaaaaaacttatccgagttttagcactataatatattaagtactttgaatagtaatacggtaatatttggttagctgtcaaaatatgccaatcagccatataatatgctaaaatattggttttggtattgttaatattttgatacgatagtaaaccaaaacaatcctacatcatatagtacaacggacaccttgtcaaaataatctagcctaagttgttagcccacaaaatgatgaccacatcttaggcaaaattttactggcaaattttagtaaaattgtgagcaaatatatcgctagtgggtctaagagtgaaaaatccgtggcacattacaattgtgggaacaaacaagcgtttcataaaatgtgacaaagtttcataaactgtcataggctatcaaacaacccagttggacataattaggagggagatggagatgtgccccataataacattttttttgaacgactcgcacgagacggtgcgaagttctattgataaagcaggaaaaaattacaagattaaaaccctgtagggtcgtaatcaggaaaaagaaaaaatataccaccacccacacaccgacatcgccaacacacaagccaaggagaaggctagcaccggaccggccgccgctaagcgtgaccgaccgctactagaccaacaaagggtcccagacaagatcgcctcctaggggatgccaaaacgacgtcttcaagaagagaagcgagggaaaagccgccgccgtccgtccgtcgggactcaaaggagccaagactgggttttcgcccgacaaacacccttgaggggtgagacagcacgacaacgcccttaggagggggaatgaaccatcgttgtcggtccggccaaggccggactgagttttcacccgccgttcaccacctgcaaatccacgactgacgcaccgatgccctaccaccacagaagctctgctgacctgtgggacccctgcaccggcgtcccctgccggccagccttcgagcgccgaagatcgcgccacacccaccggcaactcctcctcacacctaggtcgcctcctccatcgccggccgcgcctctcgtgccaagccggccttctccaccggacgtgcctctcgcgccaatccagcctccctccatctgtcgcgcctcttggccaagccggcctccatctccgccgtccgcgcctctcgcgccgagctgacctccgctgccatcggctgcgcctctctgcgccaagccggtctccgaccctccaccaaacgatgccgcggcggccaaatgtagccgtctcccactccctcggctagccatctgaggccatcatgcctccggtgaccgcaattacggccaccaccaccacagccgctgctgttgaacgcctagccacctcgccgtcgccatcctcaccgcgcacctccacttgctgccaccagcgacccgcatctgccgacatcgccagcgcctccacagtcacagccgccgcaaatcggccgctgtcaccgctgccactgacgccagccactgccagcggccgcttcgctgtcgtcgtccgccacgtcgccgccaagtcctccataggcgtcgtcagccgacgccgtcgccgccaactgccgcgaccaccactgtcgctgccgtcaccagccgtcgcaagtcagccgccgtcgccgacgaccaccgccggccaccctccagatccagccaagaggcgcagatctgagggagaccgccgccgagcaccgcgccgccgctgcgtagggaccaccgcagccgccttcgcgcccgccgcaatcgccatccccgccgcctgcaagcaccaacgaccggcgtctgcgagcaccatcggccggcaccgcacgtgcctgccccataataacattagttatttatcttttcttgactcattaaccgtttgattgttggcagagaccgaaactttaaaccatttctatgaccccaagagggatgttggtaaccaaacaacctctaaacattttgccgatgtttgatgggcagcaatgtttttttccttcctttttttttcggtgatcgatagtagtagtagtacgtagttacctttcaccggcagagaatccccaatacgaacgacgatgactcgaacaagatctaatgataagctcccttagctcgcgactggtgctctgaacaatcatcattcgcagctcaagcttttccacaccaagaaaattcaaacacgcctgctcacagctcatacagaagacgacccggaccgaaaatcgtatcagctaatcaatcatactacccggatacccaaatgacaccacccactgcacccctcctttccctttcaacgccaagctgcgccaacaataattaccacgccgcgaaaaaaaaaatcaccggacgaccgaccgggataccagacaccgcacatacgcgcgcggtacgatctccactcagtacaacacatccagcaggaagtactccctccgtcatataagagattttaattttttgcttgtaacgtttgatcactcgttctattcaaaattttttaaattattatttattttatttgtgacttactttattatctatgttactttaaacacaacttttcgttttttatatttacaaaaataatttgaataaaatgagtggtcaaacgttacaatcaaaaagtcaaaattcaaattccttatactgtgggatggagggagtagcagtggtactgtaccactggtagcatcacccagaaaacacaaaagctagctagcatcattgtaccggctcgagcacggacacggccccatcttttccgcgcttatgccgcgctgtgccgacggccgcggctccctgcgacgcgccgtggcatccgtcgtcgtctatcggcctcgccatgcacgcgcgcgcgcggagcgccgggccagtatcagcgagagggaagaaacgccccctggccacgcgcgtgaaactcgcagagacgatgggtaaaaggaaaacgctgtatcagcgcgcagcaggagccaagttgccaatgccgtcgtctgcatggtagccgcagccgcggcagcgacgcgagacgtggaggatgccagcgagcgtccgcgcttgcgttcgttgcagcttgttcggaaccccctcttcctcgttttccacgcgtacgttttttaaattattaaacggtatattttttaaaaaaatatatatatacgaaagttatttaaaataatcatattgatcttttttttaaaaaaatagcaaacacttaattaatcacgtgctaatgaaatattccgttttctgtgccagagggtagcgttcccaacctcccacgcaaaaacttttcaccctgtcacatcgaatgtttggacaaatacatagagtattaaatattaaaaaaaactaattacacagattacgtgtaaattgcgagacgaatcttttaaacctaattggttcacgatttgacaatatagtgctacagtaaatatttgctaatgacggattaattagacttaataaattcgtctcgtggtttacagacgaaatttgtaatttgttttattattagtctacgtttaatactttaaatgtgtgtccgtatatctgatgtgatacgccaaaatttttcagcctagatgcataagattggtggcatgatgtctcgttcgttggacacacgcagcagcagccatcatgctgttgggtgcagcaagaatgcacaaatttgcacgagaaacagtgaacggataaagattttattgaatgcttacttcgaattcgaaagatatatatatacagaggaagaaattccacgcaaaaggttggaaaaaggggggggcgacaagattctcgcttgctgccgtggactttttacgggccatgcatggaggacgtaaggtggcaagtacgttttttataagaatcaaatttagaacagttatacgtttcaaaaatttgaaaccgagcccccaggatttatcgtggggggccggaatcgcgagtcacgactgctgcctagcttacgatcgaccaatggatggcccaggagtaaaaagggtgagagccgaggctgccccacgcacacatgtattccgttacttgcgttgtccctgccgggctgcaggaat

SEQ ID NO: 56150 - DNA, 5580 bp, Oryza sativa
cgctgccgcggccggggtgtgtgtaagccaagcctgccttgctcgctcagacacgcaccgtacgtggccgaccggccgtgggcaggggtcgcatgcatggcatggaggtcgtgcgcactcatctcgtgctacgtacggtgctacccatgttgcggggctctggcacggcgagtgtggtttgtgggtggtaggaagaaggggacgagagttgccgattttgtttcttcctcaagttttcgatgttttcctggggatggctcatggccgggcttcgcgtcgattgcgcggccggcgagcttgttggctttccgtgcggccgcttttacgtacgtacgtggtcgtcagcgaggtggtagcatagtagtacgtagtagtaggtaaaattgcagccttgcagggggctcatagccggatcgatacggtcgttttgttgcatgggccggaccgccggagtagtagtttagcacgctagatgtatggcaattctccggttactttgcactaaactaatgacggacggagtctggattaacggctaggagtacttttttcaccgaaaaagaactgctacttttgttttgttggaggcagccagcataccgaagtgcttagatgattgctattccacctgcgtttcatacggtaagtcatttgtttttttagtaaaatctaattaagatcgaccaaatttatagtaaaatttagtaacatctaaaataccaaactagtttaattaaattaaagtttaatatattttgataatatttttattttgtattgaaaatactaatatatttttttaataaacacatttaaacttgaacaagttcgactagaaaaaaatcaaacaatttataatacaaacggatagggtacttaattgtaaagtgtgtttagggggaggaagggattttaaatgtgaagcgttaagatccacacgacaaacaaaatgctggggtggccatcaccacgtacgccggggcccctgtaagccatgcaaaggagactcacaaggccgtggactcttgctaatgacatcgatggaactgacattttatatcagtatattaccaactaactccctccgtcaaaaaaaaaaagagaaaccccgatttacgcataaagtattaatcatgttttatcatctaataacaaatgaaaatactaattataaaaaaaattcatataagacggacagtcaaacgttggcacgaaaatccagggtttgcttttttttttggaacggagggagtagctagcgccaccatctgaaaaacagtcacttcgtttttattttccaaaataaaatactaggagaaagacgttctactagtactagcgtacaaaacaccgcaaagtatatcttggagctttccattgccaaatacaaacagcaatcatatactaggagtacaacgagacaatataagttcgatcacaaattcacagtcatgaattaatcgtagtactcgctccgtccaaaaaaaaaaaacttaacttataaagtttaaattttatctaaaaaaaccaacttctaccatcctacctaatccctgcacataaaacgagaagttttatttcttaaatactttttacctacctatcaacatttctacgttttccaatacggaaatgctaaataccgggataccgttgctagccttcaatacgagatccttatcctctcctagcctcacgtggctacggataagaatggcgcggagacaaccaagtttcacgacggcgttgcagctgagataacctatttcgtgcgaggttgcgccgtggcatccgtcaccgtcgcgctacgcagctactcgcaccagctgatgacagcggcggcgcgcggggcttggccgtcattgctgaatcgaagagaggtgccacgttgaggagcagtgcgagcttggagtcggagctgatggacgtgggttgtcgcgatggccggggatggagctatcgtcggagttgatagacgcagagaaaggaggacacggccaccggcgacgagctccgatgtggtgtggacaatggaggatgcggccgtcgctgatgagctccggcgtggggcgtagatgacggaggacgcggccgccggcgacgagttctgacgtggcatgtacggcggaggatgcggccatcggcaactagctccaacgtgagacgtggacgacggaggacgcaaccgccggtgacgagctccgacgtgacgtggactatggaggatgcaacagtcgtcgccgccgagctccgacgtggcgtggacggtggaggatgcagccgccgccgacaagctccagcgtgagacgtggacgatgggaccaccagcgacaatgctttggtgcccgactcctgatacctcggaagtatcacctaatacgtggtaggaatcatctgatacctaataagtatcacatgatactttgcaagtatcacctgatacgtggtaggaatcgcctgataccttataggtatcactagatacctcataagtatggcctgataccggttaggtatcaggatcccgtcccaacaggatttcgttgtatagcagctctcttttcaataatgagaggcattttggtcatttttactcttcactaatctctccttagatgctaggaatggactttttgtgggatggagggagtacatgtgatcattgccgtgttcaagattctattggcatgctaaggccttgtttagttgggaaaagttttttggtttggttgtcacatcaaatatatagacacatatttgaagtattaaatgtagtctaataacaaaacaaattacatattccgctaggaaactgcgagacaaatttattaagcctaattaatttgtcattagcaaatgtttactgtagcaccacattgtcaaaccatggcgcaattaggtttaaaagatttatctcacaatttacacgcaatctgtgtaatttgtttttttcttatatttaatacttcatgtatgtgcataaacatttgacgtaacagcgtgaaattttttttgtttaagtaactaaccatgacctaagtttcgaccaaagcaacaatcagcaacaatgattgggcaacattaattaattagttttaggttcgaacatacctatctgtaggtagtaatttatttacaaatactccgatagggaactccatcaaactgacgggatcaagtcttgtccaaattgcccggcctgttttcaaaaaacaaacaaacaaacaaaccttgtccaaacttccgataagatatttttctgtatgcaatctgaaacgtagaagcgattccattcacgtaggcaccaaaacagaaaaactgtgggacacattgtcacgtcaatttcatggccagaacgcgcacacgggcacccactagttacagactaaactcagacgatcgagctgaaggtgaactctgataaattaagacagtgtgatcaatcattgcaaattcagagtaggtgtgaaaaccataatggtcactgtttctgttttttacggactgcattggtatcataattcttcagcggaaatgctaaagggcgatcgctcgtctggagatgggggtagcgatcaattcgccccaccctgcctccccattcctctctctccacctggtttcctattttgacaccgcattactttcttattttagtaaatttatgcacctaaagtttatatatctcaagtttacacatctaaagtttagagaccaaaagtttataagtcaaaagtttatatatccgattcaaatttgaatttgaattcaaatattttttttatatatagtatttctatacatctaaagtttatacacctaaagtttatagacctaaagtttatatatccgattcaaatttgaatttgaattcaaatatttttcatatatagtatttctatacatctaaagtttatacacctaaattttatagacctaaagtttatatacctgattcaaatttgaatttaaattatattcgattcaaatttgaatttgaattcaaatattttctatatatagtatttctatacatttgtgcaaatatgaaaatatttatgtcatgcttaaagaacatttgatgatgaatcaaatcataataaaataaatgttaattacataaattttttgaataaaacgaatggttaaacattaaaaaaaaagtcaacggtgtcatacattaaaaaaatatggagggagtaagacctacccgttttctctaggtaaaaaacactaggaatctaccgagagaccaagtaggttatattcctagttggctagtactcctagttcggttccactcaaccgggagcatgcaggttgagcttattagctggtggaaggtggtgacctacaagctacagctcgactctacgacgtccggatgagaccaacacgaagagaaaaaggcatattaggtggctatacatgtcgctgtgtgtggcgctgctggcgcagcctgcaggccaagctgccaaaaccgcaggacacgatgtgtgggatcgtaatgggaaaggcagcgcatcactctgataatgaccgagatcacaggaatgattgccatccccaacagagcgtctcccgtctttgtcaatgctctcgatgtcatgcatatgccccccccccccccccctctcgagcgatcacaattcacaagctgtgaactgaagccagctgatcgatcgcgagacgacggccgaccggccgtgttgttggcaatggcatgcatgagcgcgaaggcatgcatatacgatcgcatgcatgcgctgcctcacgtacgtctaagcgctagctagcttcatatgcgcaagctctgcagcgagagctactaatccggcacgacaaagcgctaatggacacaccctgatcacaggttacctgttccatggcgtggtggttagcgcactagctaggcgagagtgcggtgacgcatcctgcatccccctctcccacacgtgcgaacagaagccgcatgcatcgtcgtctctcccctgctgccgccgctgccccgtgatgagctcaagttaagcgacgaatgcgacagccgaaccgcagaattactagctaggctgctgctgccacatatatgcgctcatggcgcagtgctgatatatagatagatgcaggcgatattgctgaatgcaccccggtaacagcactggagtatcagagaacatgcatctggttgtgagatggttaagaaaaagataactgtagtaagtgctcctggctgtagctactcatcagacagcctctgaagccgcctgaacctgcgtgccattagacgactgttctctttcagaaaatttgtgcatagataggatgtgcatgcttgggtcagagcccggaggtgtcaaaacggtactatctctgttcatgtcgtggatattagagcaaatttaatagtatagtcaactattagttttaaatcatgtaaattagtttaatagttaattcataacctataaacatattctacactattaatatctggttccacccgtcatacgcatattgtatcttagagtccgtgctgcagcgctagctatagagatatgtggtccgctgctcctctctctt

SEQ ID NO: 56151 - DNA, 8395 bp, Oryza sativa
  unsure (1)..(8395): unsure at all n locations
acttcctttacgagtacggagggagtatataaatgtgggcaatgctaaaatgtcttataatatgaagtgaagagagtactacaaaggcgattagcacacgtacacggtgacacgctaactatacacatgttgtcaacttgtcatttcactcatagccttcatttagaccaggtagaagcagggattctttgcattgtatttttttttcaaaactgatatcttcacgcaaattcgcgtaaaaacagtatactttcgatttttttggggatccatgaaaatgtagttcgaagatgcagcatgtgacactcttaattgcagtgcgacatgccaaccaaacctccggatctttggcactttgtacccataaattgtactccatccctggacatgatttcgccatcaaagaacaacaaatatataaatggttcagacttcagacggctgtttggtgattcagaagacagagcactgatgtctgatggtctcttgatatagttaccagatgtctgatggtcatgataaggtgcaatgggccattgaaaaatcttatctgtattcgctattcagtgaggtcactccaccatttgatatagcatatagagggttggtgaatctcagaatatggaaattgtgtgggggttcagagtccccgtggaaattaagttttcctttggcaaatgtaccatgaaaagatttaccttcgtaggaaatagactacctctagtgttaacaaaaccaattggttttaacgaaaaccgttggattaacgtaaggagttagatcaaatgtcattgtttttaccggctttcgcttggtttccagcaagccaatggagggtggtttttacttctaaaacagaaagaaagttggactgaagagatatggattatacttttcttctcctgtcacttgacggtttatatatattggtatgatttcttccctattttgtttccctgtcttgttcagttagatagatttgtaataagatagcaataattgagatgattctaaatcttttaaaatttctacttttcagaatatatcctggagcactctactttgaccagaggataaaactaaggttgatcgtttggcatgtaaaccatccattgaccctcatatgctaatataagtgggatacccctacttcaaataaaagagagagagagagagagaaataaaagaaaccattgttctttgactgcaaatttctttaacaagccatatgaacgtgcaatatatcgacatatagaataataatatttccacaaccattcatatataatctaaaagtatttctaatagaggcatcgatccatacaaggaaataaggaagccactctagcattgcaggaaacaacttacatatatgcgcgatcaactctaagagaaagccatgcaaaaagattgatatagaccactatttttgctattcatgatttaagcaattcaattatattggtcacaaccaatttgaacggctaaataagtcaacacttacacaatgcattatgtggaccccacttaactaagacgtcagatatgccataaataataaatatacaatagctaacggctataaaattttcaattgtaaaggcgcgtcaatcatatttggcacacttaactttttaaaagctagcgttacaagttaggttttaaccatgccgtcgtatagtagtatttatacgctttgttcaaaacacaacggtaatatgtattattagctactaccttacaaacataaatatagtctcaactatccttatatgacataaataccaacgtttttttttcataaatttttcaacgacttacaatactggaagtgttatactccactattcaatggacaccataggccgccgcagcaacccaggtcattttctagctccctgggactgtatacatgtatgtaggacccatgaattggtgaaaataaggatacgaatcatatgagagccctgaaaacatgaacccaaacaagggaataactatatatgatgatgatgatgatgatcaaataaaagcacaaaagggttgtggttctttaaataaaaccgaacgcaccaacacgggccgttattcgctagggaacgaatcgctagtcgccgaggcgaggcggaagaatacgagcaaaagtcgacgaccaaaccatgggggccagcgcgcgcccaaacgtccgtttcccgtttcgccgtcagcgcgactcggcgagcgagagagcgagcgagcgcctgtgcgcctgtgtggcttgaacggcacacccccgcccgcccacgcttataatactgtcgcttacgcctttattttttcttctctccttcatctgttcgtcctctcctctctcctctctctcgccctctccacactggcacactctctgtgaatctctccttctgttcctggttaattcgctcttcttcctctcgtatctccgccgcgatcgatggccatggagaaggtggacgccaaggagagggagaagatcgaggccgtccgcaagaccctccgcaagcaggctccgctcaccgccaagcaggttcgccctccatggctcgttttcatgcatggcgctcgctcgctcgcggtgctgcgttttcaatcggttttggttaaccttggtggtgcgtgcgtgcgtggatggcgtgggcgagcaggcgatgtactgcaacgacgcgtgcgtggagcggttcctccgggcgagaggggagagcgtgaagaaggcggcgaaacacctgagaaccgtcctgtcctggagggacaccatcggagccggtacgttcaacaatcccagcttccatttttctccattatttccatccatccccacatcgctcctcatttactccactcccctcttttccatgtttctgccaacaaatctgagtttcatcaagcgtgtgtgtctgcatccctgcgattttccggcagcagccgggggccctgattttttttgaaatccgtggggggtttgccacattaatggtggtgcatgcccctgctctgtttcgcttctgttctcttcgcgatacctacggcacagtgtattttagtcaagctactgtgcgcctgaatttattgtgccgtgtgatttgtttccttgcaatattatgcaagcaaagtacagtctgcaacagtgtacactcttgttggtattctgttcttcgtcgggttgggggctaaattggttgattttgtgccctttgttttgtgttgagcagatcacatcatcgccgacgagttctccgccgagctggctgacggcgtcgcctacgtcgccggccacgacgacgaggcccgacctgtcgtggtacgtttccatggcctccgtgccgggtgcaaattgacactcacacgctagatggagaatatgttctgatttgacagggaggtctttttttacaggtctttcgaatcaagcaggactacccaaagttccactcccagaaatcgtaagaacgaacagatgaacacttgcctaatttaatcattaacccggtcttaacaattgattgactcttgcttcttgctggatttaattaggttcgtgcggttactggtgttcacgctggaggtggccgtgtcatgcatgtcccgcttcgtcgaccagttcgtcctcctcttcgatgcaagtaagcagccatttcttcaccatttccaactattcccgtagctgtagtagtggtactagttacatctgtgcgtgtcctttctttctccaaagaagaaagacagcgacagtgagaaaatagcggtcgcgtttctcattgcctcgcacgggcaaggcagaatgggcagtagtggcatgtgtaggtcagagctgtgcgcactgcacattcgtggggatggctcggcgagaccttcgtcgcgcgcggcgcggcgcgcccacctcgctcgcacggacgaacggggccgcatggccgtgtcgtgtcgtgtcgtcgtgtgcggttgccggcgacggcttcgcggcggtcccgcggcatcgcgcacagttaccgctacagtggcaggcacggctgccgcttttgggggcggagaccccggcttcccgccggtgcggtttgaatcgtggcgagaatgattggatcggtgatgatgcgtggaaagcgagagccgtagaatctgcaggaaagtgagaggggttgacgagacgaatcgaatcttttttttaatttttttttcatgtgcaggctttttccggtcggcgtcggctttcctcaacctgctcatgggcacgctcaagatcgtcgccgactactaccccggccgcctccaccgcgccttcgtcatcgacccgccgtccctcttctccgtcctctggaaggtatacgtcacgtttgatttcgtgttcatcgcgatggcgatggcgagtgggagatgaactgaaaaaacgggtgcggtgttgtccagggagtgaggccgttcgtggagctggcgccggcgacggcggtggtgtgctcgctggacttcgaggactcgctggaggacgcgtcgttcacggcgtacccgcggacggcgtcgctgcggttcgagccggcggcggccctgctggcgaccgggacgaagggcatcggcgtcggctccgcctcgtcgcggttctccgtcaccgtgtcgcacgacaacaccctcaagccgtggtacctgtccaccaccacgccgtcgtcggtggggcctcgctccgtggtgccgacctccagcccgtccctcatcggcgcgtcgccgctctcggcgcgctccttttccttcgcctcccccgccgcgcgttccaccangacgccgcccgtccaccgcggcgcaccgctgacgccgttctcgaccaagggcgggcagaaggcgccggcgccagcgcagcagttcccgcggacgccgcggccgtcgttcctgcagtcgccgtcgatgctgttcgcgttcaagaaggacggccaggccagccgcggcgagcgggagcgcgagtccttcctgccgttcctccgcttctaccgccgcccctacgacgagatatcgtatcgcgccaagatgcggccgccgctgggcgggctcatcgccatcgtcgacgagaagtcgaagcagcacaagacggtgcagccgccgctgcgacggcacgccgggctccaccaccagcagctgttccagctccaccaccaccagaggatctgatctgaactccagatgatctcccgttgctgaagcatgaatccaaccgatgaagctagcgttcttctccatacattttacagcataatccaatgctataattatgctaagttgatcttttgtcgacattttccccccagtatttacctcctaggatattcttcaacccgtgtaaaataacagccctaaaatgtgagtaaaatcgaccccttttgcagcctctcgccgtgactgactgcatgcatgttcatctctgattgttcatggctttaaaaaatgccctgcaaaatgccatgattttcaaaatattttcatattgtacgcctacagtggacacatgctatttcttcatttcaaacataaaaataatagagtaaattgcgttggcggtacaagaacttggcaggtgtgtgcgattagatgtaaaaatttgaaaatcaagcatagcggtacaataacttggctaggtgagtgcgctcatggtgcaaaagtagccatgtaaaaaaaattgccacgttgctattccaccttagcaaaattgccacatcagctttatatgaaagacctatctcattttataaaaaaccccaaatagctttttttttccaatcacatttcctttttaactcgacaaacagaacaaacgtatgcatatctccttccatctttcttgacgtgttcctaattgagaggcggctgcggttgtggcgatggcggcgtagcgacggtggcggcggcagtgacgacggcaacgagggaaaccgttacatcgccgcggcggcgagggcttcgtgtgccacattagttcaagccctaaaccagtaaccaaaccaattcaagccgacaatttgctaccgtcgacatgatcaccgtaagctttgggatggctctgaatcgacgagtttttggagcatctgctcctagcttattatggtaaatcacttgctgatggttgtagatttctatttttcgttcatttgatggatgatttcgaagttaaggtttcattgatctgtacaatggctacatttttttgggttttcacttgaatatcatgttatttgttattacaattcaatgaagtgatctaatggtactagccactagattggttttactgaaattattggtgtttcctgtaattgtatatgatataagagaaacattggcaatgagaaattcttgctagatgtgttgtacccttgtcagcagatataattagttgaataatttgcaaataatcttagtgtattattttccttatgcggtataacacatcaaccaattattttgtattgcaggtcatgaggaagaagaattcacaattgcactgtatcgtggtggattttttttttttttggagttggcagtagcagaatttatttggatgagaagatggactggtttgatcattgtgatacaggaggaaaacagatatatctgaagaagtaattggaatataaaagttattagggacttttctgtaaaatgagatggtcaatgcatgctcatgtggcactttcgctgaggtggaacaatagcgtggcaacttttgcaccatgagcgcacccacctagccaagttattgtaccgctatactcggtttttaagtttttgcacctaatcgcatctacctgtcaagttcttgtaccgctatgcacggttttttcaattttttgcacctaatcgcacctaacttttaagttcttgtactgccaatgcaatttacttaaaataatattaaaaaatcttgcacgcgacagtgtcacgttggtcatgcgacatatcgagccaacacagttggagggagaacacaacaggccagacacggcccgttgaaaattttgaaacgttgagacgaaaaagagagatgacatggagagtcccgacggttttttccttttcgatcttttacagtaaccctgtcggccacttcgtaaaacacacaaaagctagcgtcaccgattaagcagagtccagtatactagtactagtataaacagaagtctacatgtacgcatgtacaccttctgattttctgctaattttttgtcgctctccctctctctctcttctgtgtaagttggttttactttgagatgatgatcaggtttgacgcttttaagctttgtcacaagtgcttacaaaaagcaaagctgatgactgaattgaacatcaatttcttgtggaccaaatcgaagtttaaagtctatactactatgagaccactagtgtgaacagcctcttttttttctcgagttctgggtaaagccaagctagcacagtggacatgcaaatctttcctggcgagctactgctaaaacaaattgaaatgatctcctgcaacaacaatgatccagttcgctttcattgatccagatgcagcgtgatctgcttcgtgtggacctagatcgctttggttttgtcccagaagggaccaaagctggagctccattttgcttaggcgttaattaactcgatgtgcttagcgcagcgactaatcccatctttccacattaatcacttccccttttgagcccagcctgctgggatgttgttgtgtatcgagaggtttgtagtgtagctgagagtgtgacgtgcaatatccacatggaccagtgtgtagaacccatctttccatacagggagctcttacgtgcattccgtctgtttgaataggctctgtgatctgtgaacgtgttcatgattactcatcgatacgtttacttgattgcctactaaggctatcaaaagaagaaaaagataactgaactaaattatgattggattcatcttgaatccaaactcggtaactacagaaatactcttaaagaaggggatggattcaaactgagccacattttcagcctatgcgttcatttgcagtttgtgttttctgtctcgtttgaggttattaactgcacatgtacttctgtagttttgtcacactcagttggaccgaccaagtggttattgtcacaaaccacggatctaatcacagacgacgctacttcactattacgaccgatcgtacagaaaaacaacggacttaatggcagcagcaggaacggtcgctcggtggtgcatcggaggaatcacgctgtgtcaaggcgaaacgacggtgtcgccacggcacacgcgcacgcacacgcaggcgaggcgagcggagccgaggcgcagggacgagacgacacggcccgcacgcgccacgatggatcatctacccccccccccc

SEQ ID NO: 56152 - DNA, 6139 bp, Oryza sativa
actacgtgcgtgctcgtttattttactcgccccaaaccgacccagggtacgtacgcgctacgtgcgtgcgtgacgccgttatgtctaggccgccgagaccggacgcctccggaaagtccacgaaccgcttctccgtggcggcatcgcgcggggaggcgcgcgcgcgcgcggggtgtggtggacggtggtgtccgtagcagccgtcgcggctcgcggccgccggtatccgctctgctccgcccgcccggctaggctaccgcccggagccaagggggaagctccagggtcgcgcgcgccgcgagaccgaatcgggcgcgcacggctcgctcgcccttttggcgcgttccggtgtgtccggttcccgtcgaggcattcttacccccccagggcccagggctgaccttggtatcagcatcaaccggaggctaagcgtgatttacttaacctgcaaactgcaagtcctattaatgtagcatgaactcttgctcttgtttgcatcttggagacggaagattgtagtgtttggacggagtgtcttgggactgtcacagcctttgatggtcactcacggatcatggccggctggtgctcacgacgtcatacgctgtcaggatactttgatccttgagcatttccagttttttcaatacggtagggagtagaatctgacacaagtttgaagttgacaaattggaatggttggttaaacagagggtaggcgagcacttccagttcttcgatccaatagggagtagaatctgacacaggtttgaagttgacaaattgtgtttcagtatgtttgaagcaaagataaaacacacaccatgacaaacccgtttccagatttgtcagcgtttgcttggttgccaggcaacaggagtgccttaaggtcgtagtataacagtattacgagcatatatattcacaaaaagctgctatgtattcatttaatagtaccataaaggacattggcttatggccaaattcaaagcagcatcgcttgtaagctgaagattgagaaatagtaacacattattgtgagtttgcacagcttcagtccaaggtacagtataagtatgaggaaacttttcctttatttatagaatatactccgtatgttcgttcaaaaaaagaatatactccgtaacaaagtacgtatagataactgaaggcagtgataacacgtcaaaagccattcttgaaacagtctggaatgaggagcgccaatgatttccatatctctgaacagcataccaccaccacctcaagcttcatgactatagattgttaaactgcagatcgaagtccaatgatacctacaagttattagcagacatattagcttgtcattccactggaaggatcggtcttgcagagaaaaaaaaagtttctttttattttgtacaatatttgtcctatgtgttcctgagtactagtatgtccgaatggttctttcctcctctcagtttcagaaactacaaaaagattctcacttaccgcatccaattcttgctcctgcatttcctgttgttttactgagttcatgaccaccttcaaaatatcaaagtagtacaatgagcagcagcataaaaagtgaatgcttcaccatgtgatactaaatggcaaaacataattgtgcatgaaacctattctaacattaggctcgcaatccgtaatttgactcaactgatggatacttgagcatgtattttggaacctaccactagtcaaagttagccaattgttaacaaatggaacatagagtttgaacaggagagaaaaatattataccaaaatatttcatacttaaataattggacacaaacagatgttgttcagaattgagtatgacgcagttattgatggtaatggcaagagctttatcatcccaactcctaggacatgtcttgcacaaataatgtataaaaaggcctctggaggcactgaaaataattggcaaaacaatgcagcatagatagtgccagaatcctagatctagattgctagaaatgtatttcttaaggcaccacagtaacatttgtctgctaccacaaacctagcataaatgcagcagaggaacagagactggcaattagatttttgacctgtagcattgtacagcccatgggcagttagattttgaactgcagcatggtacagcccatgcaaatcctgttatctggacctgttttgggcccttgcctactggattatgatttataccctactgtatgttaacatagtaccacagtccacaataatttcatgacagctatcagcaattcagcatatcccaggttagttgggcttgggagggattacctgtcttatgaatatgatttttactagtagttacactcaaggttgaagagccaaatctcaggcagctttggaacaccgaataatcccatatcaaccatagctaacaagggaacttctacgttaaatagttatatgaatattcaaatgcatgatagcacgccattcggcaggtaataagctctaaattaccctctaaatagtgaattcaatattttctaaaataagaggacatatataatgtaggaagggagacttctcttcaattctgaatgaccaataacaatcttgcaagagtaatgacataatgcttaccccttcctaggtcatcagaatcagcatgaacaacaactgcccttcccaatatggaatgaggcccgcttagtgaaatcttcacaaagcaatgaatatgaattaccaatgcattagcataaacaataagatgaacaaactgatattttacatatttcaagacaatggaacctgtaggtcctttatgaagatatctgcaacacctggaacaaaaaggtgatgtattattggtagacacacatgaattaatttacaaagtttctttgcgttagttgcctcaaaggtcttaatgtagacggcctgacagagtgctaaccatctttgttggctactatgtttcccaggtcgcccacatgtctttcatcatcagatggtgccccatgggacttattgtgaggattaaaatggggccctgggacaagtaatttaatcagaacaaatgaaaaataacaattgcaagatggcatgagagaacacttcagctgctccatggagcacccccaacttgggttatgaaaattctcaaataaatctagtaacatagagtttgatgttatccatctctccataacatttcaaatatagaccccgtacacgtgaagaagaaaaaagtcaaattttcatgaaaaacaaaccctaaataaaagaaatgaaaaccattcacttaaaaatgcagtagcaagatttgaacaggacaattagaatggaagggtgagcagatgattctgtattggaaacattttttgcagcatacattgagcttatgcagttccccaaaactttcacctgagtacactcactacccattccatgatccatcattcattgggcaaaggctaatagtagtgtttccataggcttgccgaaggcattgtaactcataaaaactctgcgggaggcgtgacaatctctttttgtagtgcacacataaatacaaccaacagttttgtccagtgcttgagtttgcttgagaccggcgcgacatccttcatgtcgttgtaattaaaactttatttcccccaatcttaatgaaattggccggcctatctttggccgtcccgacaaaaaaaaaagttttgtccagtgcactttttaacaaataaatcggtcatttgataattcttcacagcacaactcaattggtaaacgaagttcctacctcagtgacgttttcgtcctatccatgttttgatcagcagtcaactcaaattagatgcctatcttctcttatggtagttagcgttgtaagttctacttatacataatataggagtatgcgagttcacaattgcaatacacgatcttatcgagcagtgctccaaatggccaaatcccccatcaatttcacaacctaagtcacaaaaccaagcaagggaaacggaaggcaacgaaccggtagagttgcagccgttggtggtgtcgccaaaggagtggatgtggaagccatggaggcccggagcgaggccggtgaccctccccctcacctcggtataccctaaaaaaccacgcagagatcgagtagtccaccaaaatcacatcagcgagaagaggtcaattcacttacgagacgagctgctgtgcgcgcaggcgaacagcacggagctacagggaggagacgcgtaccggtggaggggtcctggaagaagtggagggcgccggcgaccgcgctgttgccgccggcgccgccgatgagggcgacgcccttgaggccgccggctttccctgccattctctgccgcttcgctcccaggcctttcacttttttcggctcttttttttatttatttttttcggttcgcccaaaaccactggttcgtcgtctgcccgtccggcgcccacgggaaacagcagcccgcttttgggccagggacggaatttgtcttgtgggcctagaattgaattgcttcatgtggatttctatgtttcaaatggggcttaaataattgggccgcgaataaattatcgatatatgattttttttttttgaaacgatcgatatgacaatttttgttgggagaaagttatcgatatgcggtttttcatttgctttcacattttggtttctgtgaaaccgtttttgtgtcttctatgacatttgtcttttctttttggattatttcatgtggatttctatgttccaaatggggcacaaataattgtgccgcgaataatttatcgacatacatactcactgtgatttgcttttgattcacattttgatttctgacgaattcttttattttttgtgatgcaagtacaacaaaacccactctcacaccacaaagtcacaagagtccatgtaaaccgagagacccccttccaccgaccttacaaacttgcggtttatctaccgtgctagattcacctagcaggctagcccgatcagtactcgccctgttcctcgtcgtcgtcctcgacttcggcgccgacctcctcgtagtccttctccagcgcggcgaggtcctccctggcctcggagaactccccttcctccatcccttcgcccacgtaccagtgcacgaacgcgcgcttggcgtacatgaggtcgaacttgcggtcgatccgcgagaacacctccgccaccgccgtgttgttgctgatcatgcacaccgccctcctcaccttcgccaggtcccctcccggcaccgccgtcggcggctggtagtttatcccgcacttgaaccctgtcggacacctgaaacacaagatcaccgtcttcgtcatcatcatcgtcatcatctccggctaaaatctctggaattcagcgagatgatggagttaacgtaccagtcgacgaactgcacagtcctcctggtcttgatggagtggacggcggcgttgacgtccttggggacgacgtcgccgcggtacatcaggcagcaggccatgtacttgccgtgcctggggtcgcacttggccatgacgctggcgggctcgaagacggagttggtgatctccgggacggagtgctgctcgtggaacgccttctcgacggagatgatgggggcgtaggaggacagcatgaagtggatcctcgggtacggcaccaggttggtctggaactcggtgatgtcgacgttgatggcgccgtcgaaccgcagcgacgtggtcagcgacgagatcacctgggagatgagcctgttcaggttggtgtacgtcggccgctcgatgtccagcgacctcttgcagatgtcgtagatggcctcgttgtccaggaggacgacgacgtcggtgtgctcgatcagggagtgggtcgagagcacgctgttgtaaggctccaccacggccgttgagatctgcaacacacagggagtggttttcagtacagagcttgtatgttaacatcgacaaatttagcttctctagtccattcggagggtacatgtttaccttgcattgagatatctgagtatctgacatgatgtgcatgcatgatgatgacataaaaaaatactagtacgattattaatagtcttacatagtaaattaaagtatggttcacagcctt

SEQ ID NO: 56153 - DNA, 13367 bp, Oryza sativa
tagaatgacttacattgtaaaacggaggaagtagtataaaaagaaaaacagttgtttccatcaataacaggttgatgttgctcccacaaaaagtgtgaaggtacacctgcctacattctacgcctttggataaggacatatgaacagttggtgattacgtaattttgcacagctcttccataaagatttttttagattaagtcttccataaagattagattgtttggaagggtctttctattcaaaatagggtccggcagacatatgtagattttttttaatcataagaatcagatgtttacagtagttactgtggtcattttcagatacttatggaatggcctttcgaaaaaaaagagataatgatggaatgaaaaatatgctgaaaattggacatgtgtttaggatcatgggagaatcagttttataagaaattgcatttgctgatgaacataatttacttcggttttccctgagaattttatccatgcacttgtcaaataaatgattcaacatcacagaagacattcttttgctggagtattctatttttttccatggcactacaatacgctgtaatgaacacaaacatggtaacaaatcatgaatacttttcttgattacctgtggtgaaggatatattgtgaacccgagcttcgacttcctaccgtaatctactgataggcgctccaaaagtaatgaaccaagtccagagccggttcctccaccaacagcattgaaaaccagaaaaccttggagaccagtgcagttatctgccagttttcttagtcgatcaaggcaaagatctaccacctctcttccaactgcagcagaaaaaaaaaaggatttgaatcattactaaaaaaatattttcattataaaggaatatgacagtttctctagtatgacaatttatttatggaggaagctaaatttatggcgtcatatttttcactaaaaaatagtcggcatgtcgtaagttcctaaattattattacaagtcaccccaaggatataagttataaacaattaatgttattccttatgtgagcaataatccttatggatcccaaggatatgtaagcaatatcatggattcagactcctctaaatccacccaaaccatatctttgtggatcaatcatacctgtagaatgtttcttgtgaatactattctagttggagtatatcaatatgttggtttagacattttcatagacacattttatttctgcaaaatggctcagtttcagggtaagcatcacacctgtgtagtgcccacgagcaaagttgttagcagcgtcttccttgtaggagatgagctgctctgggtggaagagctggcggtatggcccggtcttcacctcatcaatcaccgtgggctccaggtcgacgaacaacgcccttgggacgtgcttgcctgaactcgtctcgctgaagaacgtgttgaatgcatcccttgcaattccaggagttgtgtcgctgcaagcaagcgtcagatatgaccaaggattaggatatcgtaaactaggagccactaggcaccgcagcaagtcacagactagtattcttcttgaaatgaaattcgcttcacaaaaaaggcacaggctttctactctcaaagcaaccggcttggggatcacagattcacagatagcatctctacaagaacagtgctagcatgcatggtgcaaatcaaacatcgaataaaaatcgctaatttcacttctgattgtcatacatgactggagctggagactctgccccaaaattctcctcaagatcaattcttttttaggctacagcaagaaccaaccaaacaggacaaaaccatcatccgaatatcagaatttcacaaaattaagtaggaaaagacagcaagagatgcagacgagcaagaattgggatcgagaagaacctgggcatgaggccgtccggctggatgccatgctcgaggcagtatagttcccagcaagaattccccacctggatgcccgcctgccctatgtggatgcttattatctccctcatatctctctgcctgtctctgcagccttcagagttcagagttcgggattggttcagggttcagaggaagacagaagggacctgagcagtgcagcacatagaaaaagctagggataaaaggagggcaggcacaatggcgtgaaccggaacacttcagccccgggaacacgttgcagggaaagtgactccactatttggtggaccaaataacgagcagctactacaagaaaggtgactaggcgactggagatgatggtggtcttctccattctgcctgcctctgactgtgagtatgcctggtgtaaaattatatcgcaattacatgaaatttttgtctatatatgatttttagggcatgcttattaaaaaaatcgaactggtaaacttgttttctgacatcaagtcggccattcagacagctacagatgtacaggtacagattgtttgcaagatgtctgacaaaaatgtcaatgtacctacggtagttttcaagcaggaccaagtttatcatctgctgataaaagaggaccaagtttgtcatcgattccaaatcgaatgccgccgtgacttgacaaggacacgtccatcataacatatgctgtgatcaaggacgccatccatgaccacaacgctaaaatgagcacatctacggcgcatgccgacgagttcaatggggagtcggcccggaagttgattgtcttgatgctgatgatgaactgaacagagcaccatacactgattgattatttttttctggactgaacagagcaccataaattgctgacaccacaaaatagttgcatagactctgcacctgtaatctgaatgatctcacatcgaagaccctcaaaacgaaaatcacatatctatcagtgattttttcccaacttttttctattaagatacccttcgtacaaaactacaaccagatggttctgcacttctactacaaccttgttcatctattgcactagccaaatactactactactctatctacccgtgttattgtgaaaatgaaggaataaacagtgcaaaaatctgttcagcatcaagtgcagaaactactcacaaagaaaactttcttttctgcacggcataagtccgcgactttcttgaacaattcgcaatcggcgggttccctccggaagagggcatcagaacagaacatttgtttagtaggcattcgtttattctgttcttggtttcttcagcaatcagtgtacgacgtcacgcccccaagatcgatgcggattcttcttctgtcacttggatttctgaacattccttcgcactgtgcaggcgacagcgaggcgaagcgatggagcaaactgacactgctactgcgacaggttgcacatgccggggtggagcgagcaccagagcggctggatgggctcggcgcggatgccgcgctcgaccatccggtgcctccagtcgttgaggcggtcggtggcgttcgcgtagcgcttcttcccgttggagcccttgttgccggaccagagcgtctccgcggcggcggcggccctcggccacagcctggcgtccagcaccgtctcgtccgactgctccgaccacagcgccacctccccgcccagcaccagctgcgcctcgtcgtcggtcagcccgtgcaggatgtcgtagtcgtagacgcgctgccacgtcttgaacggcgcgcaccatgacccgcccgtgccgccggggtcgttgaacagcggcgtgccctcgcgctccttctcctgcttgtcgtaccggctgtcgttgcccacccacccgccgtggccgcagtccaggtagtagtacgacgccgacgacacgatggcgcggtagcccgcggcgacgacgcgcttcgtgttctccggcccgtcgttccacgtctgcagtatggtggtctccctgggcagaatcgtggggccgacggtgaccttgggcccgaggaggacgtcctcccagtagaccaccgtgcggttcagctcctgcgccacgaacgggcgcgtcgcgttgatgaacagctccaggaggtggtcgtgcgtgccgccctcggcgaggaaccggcgcaccaccgggtcgtcctcccagcacgccgtgttcacctcgtcggcgccgccgtggaggtacgggtccgggaacagggccaccatgtcgcgcagcacgtcctgcgccacgcggtacgtcttggggttgagcgggttcagctgccccgtgccgggctccgccgccagcgccggctccgcgtgcggcgcccagaacctgttcgcgcaggtgacgatctccgggtacgctcccgcccacgaacccgtgtgccctgatccgaagcgcgcgacacttagccttgagtatactgtttattcggagagcaatggaattgaaatgcaggagcagcagagggagtctgggatttctcactcaccgggcatgtcgatctcggggatgacgcggatgccgaaggaggcggcgaagctgacgatgtgccggacgtcgttctcggtgtagcgcatggtgggggagtaggagccggagttggcgaggttggggacggtagggaggacgatggggaaggactgggcgtcggtgatgtgccagtggaagacattgagcttgttgaaggccatggcgcggagggtgtggaggatgtcgcggaccgggtagaaattcctggcggtgtcgaggaggatgccgcggtgggtgaagtgtgggcggtcggagatctcgatgccgctggggacgatcggctggccaccggaggcggcgccgccgccggcccaggcgagctgggagaaggtctcgagcccgcggatggcgccccatggcgtggcggcggagatatcggccgatccggagtccgggagcacggagagcgtgtaggactcgtcgacggcggggccgagcgggacgtcggggtcggagacggagagcgtgagggtgcggacggggacgcgggagagggtgtagttggcggggggaaccagcggcgcgtggcgctcggcgcggatgaggcgggtgtagaaggctaccgcctggcggagcgacgggtgggacagcaccgcgcggacgctgaacgacggcgagagcggcgcgtacaccgcggacggccacgagatggacgtcggcttgggccacacctgcaccttctgagcaagcagcggcggcgggaggtgaggctccgaggtaggcggctgcgaagcggcgccgggcgcagccgctggtcggaggatcaccaggatgaggaggaggaggaggagataggccggcaatgccgccatctccgtggaggacgacgagcaatcctggtcgcctccgcgagtgcagcagtgaggcactgagggattcagttgctttgacttttctcccctcatatcgttcgtgatcgagcgaggttggtggcgactcggcgttatccgcaacacgtggagcaagacggcccatgtactactcaaggcccgtaaaggcggcccatgttccatgatttcttccactgtcaggtatctcctccaccctagccgccgtcgctccgcctgctgctaccccgatccgggcgagagtacgccggcgccggaaaacgtaagctacatgctttccctgtttattatcgtattcgtttcgttgcgcgtgagcggagctagttcatggcagccgctgaacttcccccttcctttacccctagctcatggtcagatcctcttggttaagatgtttgaatcgagccgttttccagctttacttgcgccttctgtcacctgtaaaactatctaatttcaccatcttttatcatcaaaatcgattttgtgactgacgcttggagttcagtatggtctttacaaggtagagtaggtaggagcattttagaggaacagtgtaaccctgaaatcgtgtatgatcacaaataaaaacatattgaatgtttacaacaaaagcagattgatggtttgcacccaccggagggatatgcttagccgaaatcggatttgttacgtctgaactctgttgtgcctgcatatgaaggggtaggaaagatgacgcctgattgaattgcaccgcattttcaacatatcttgaattcatattagttcagaaatcagtacttgcactgtcacatcatgttttatggaccacaacggttttagatatagtttaggctaagtcattgttttcatttatgcaatcatgctcaggacccagctttctgagatgacctgagcttctcagatcaatcttttgcagcatgcaaattctgtaaaggtccatgcactattgatcttgaatatgtgtgcattcccactgatctagtttcattttgtgatagtgattatcttcataaccagtaaactttgttggcaggtatagctgctgtgagacgaactgtatcaatgatgagctcacgaggcactagtgctatgctttcaagagctgctcggatgaggcaaaagctacagtctgctttggaggccagtgcgctagatattgaagatgtttcttaccaacatgctgggcatgcagctgtcaaggacaatgcaaatgagacacattttaacatcagggtaatttcgcctaagtttgagggccagagccttgtgaagcgtcacaggatggtgtatgacctcttgactgatgagttgaactcaggacttcatgctatctcaattgttgcaaaaactcccaaggagtcaggatcctaaatgtcaaaaatgtaaggacttatatgcttgattacttgtcttgaaataagttgattgcagcaatattgtgtaaccataagtcaattttttcaaaacaatgttatggacgcttatgttttcactaaaatgcagtgcacaacttctgttgtcagtgaacatctgtgctcatgaaaatttgtggaaaacatagtgagtatcgaattgatatatctgtttactattcgatcagatgagatttttctatctggtatattttgtaagcatatatgaaccttttgtcttggtgctagtctgttacatatatttcttatttacgccaattggtatattatccatcatgacatcgctgataaacaataacattcctagttctggcagttgtttttgctctgatcttctgtgatgaaaactagcatggctgaataatatttatcagtctgtgtttgttgctaagattattaagtaaatgatttgtctgtgaataaaaagcatgcccagcccagttcattatctttgtgacattttgtgcggatacatgtttctgcttcatataatctccttttggttcaaagtagcgatctatttatcatcaatattatcattctgttcaattccaagaaccatgtggatatggaggaattcaaaatatcaggcctcacttggaacatacaccctccatcccaaaaagagtttatttgggctattcagctagacaaaaatctaaagagtttatattagcgaggctcctgcgaaagctgagactattgcaaacaatgtgtcggttactgtttgctggagaatccatgagcaggagtagagatgcagctttctggccaatctgatgtgtagaagcgtgtcatgtaaaacagcaatttacctggttggacaagaattcttaaagttgtatgggtcgtcttcttctctttgtgtgtgtgtgtgtgtgtgtgtggttcaaaattatactgagcaacattttttgtttatctatgtttggtgaaactcagttacataattcaccctttgaatattctgtcgatgtccaggtttggaggtgtagagggtatgatggtgactaagccacagtattgtaacaactcctttgagagataaaaggatgtctcacaatatgtattttgtgacgtaaagttcaaagttatgagtaccttggagacttggtggagatgagttgaccttatagttagaacaggattccagtgtattcataacatcctctttgttcgagtaaaaagattttggtgaagatgagttgccctaacaattggaacaggactccagaacatcctttttattggagtaaaagaaattggattccggtgcattcaaacatcctctatgttggagtaaaaaaatgagtagaaaaaacgaacatcatctttattggagtaaaaaataattaaaaaaacgagttggaaaaaggtaaaaatgcccccatgcaggatcgaactacagaccttcagtttacaagactgacgctctaccactgagctataggggccactgctacaagtaaaaagcttcagtttactgtcataagtttaactgaaatatatacactaaagatccagtaacccagaacactggctatacccaaaccttcagttgcaaacttgcaatggaacacttgaatgacagaatgtagaatccagaaagtccaccgtccatgattccaactatggttaagggaacctgttcagtgttccattgactttttcaggtgcatctagctaaactttacaaatatgcattcacctttggtttttcaattccaaaaagtatcatgaagaacaagaaagaggtcggttctgtgaaatgctgacacagaatttcttggagtcatctcacgcattacagtgcatatccataagagggtgacaatagaaaaaaaaatggagcggagcaccaactccccgttgaagaacaagttcccaggaaagacaactattcccatttatctgaatatttgtatcgagcaaaaaaacatcggttgataacattttaagataatacaatctatgagaaatgcccatacacaaataacacttcaagacattaaatgtcatttcgacaatgcagagcttattctacatcttcctcattatgaacaagcaacttgccttccgtgaattcgcatggcttgatgggtacagctaattgcttgcgcatttttcttacaacaaatgtttcagtttcttcgcatattgtgaccacagttcctttccgccctagacggcccgttcggccagctctgtgggcatagtgtgtagagtctgttggaagatccagattaatcacaagatcacattctggcacgtccagtcctctggcagacaactcatttgtaactagaactctgaattcaccatccttgaactttttcagcacagttgatcttgcaagctttccaagatctccatgtagctcagtagctttcatcccacgggcctccaacttaaatacaacatctttcaatggcttggtgttgttcataaatgcaataactgtctgagcttccagagcatggatacatctcctcaaagtgtcaactttgtgttgagccttggatatacaatagtaatgttccaaagatggtggtaagctgttaactgcagcttgattcactgaatttgatggagagttggggttggcatctgtctgggacagcacaggtcttggaacagtaattgaatcaagtggaacaacactcatagctctaacaaggactggatcgtgaccccaactcctggctgctcgtataactgaaaacggtattgttgcagaaaccaagatagtctggcgctcagaccgccttgcaagagggccaagaatatctctagatgaagtaccagatttccttcctacatgttcaagtattctatgcatatcttcacgataattgaaagacaaaagctggtcaacctcatccagtacaagaaagcggcaaccatgggtgtgtagcttgccccctgctgaaatttcagaaatacgaccaggtgttcccacaacaataagtggcttgttctttttcaatgcttcttcctgcctcgaacgattagccccaccaacaagttgttggacaagcctcttatcattagggcccaaaatcttctccacttctcgcactatctgcattcctaattctctggaaggagcaacaataactgcctctacacctgatctcttatcagaaccatcttgttctgtaggcctctttagggggcctatttcagaaagaatagggagaaggtaagcgagtgtcttccctgagcccgtatatgactggataactgcatcatgcttttgtgaaatgataggaatagcagcagactggacctcagttggagtacttagaccttccttgttcaaccgatctataagcaaaggcggcaaaccaagctcttcaaatgattttgcagagaaaagagattcatctatcttcagagtcttcttcactactgctgatttcggtaaggtgctctttgctggtttggaattaaatgaagaaacttttggtttcaccttaagagcagaagcccttgaagacggctttggacctccaatgcgtgttgctttttctttcttaccatattcaactttgttttgcccttcaagactagctagagttagtgaagcactcttatcttgtactgtttcagtaccaagccaagcggtctggtgaaatctaaccgctcgtggtaatgaaagcattctcaatgggaggttgtcaccgaggacgaagcatgatcgcgaagatgccaatgcaagcacatgtcgatgcacttggccaacagttagcctcatctgctgctctgcttatgaaaaccaattttacagcagccgaaatgtccttactcccaactgatctcgcaaattcaccgggggtgctcttggctgtgcaaagaaccaaacaattgaatcatgtaaactgcagcattcacaacttgcaatagtaaaacaaagttagacgcaagaagtctgtggagtatcggtggcatcaatcgtgttaaactcggttgaacccccaaattttcttgggaacaaactaaattgttattcgtgctaaggttaaggcaaaaaggtaaagagaaaggcaacctacagatctagaagagaagctagggccaacgcaaatcggaggggaaaaaaagtgtgggttagtgagagatgagaaagaggatgcgcgtaacgggtggggtgctcaccagcgggcgaggatgcggcggaagcagcagacgccggcgccgctgcccactggagatcgacgcaggcgaggcggccggcgaactcgcgaggagggaggagacacgcgggtttagggcttagttagcctgaagccggcgactggctggcgttcgtctatccggttgagtggggagggggctcgtgtggtcagggtgtcagagacacgaggtaggagtgatgggccggcccatcaactgtggcgccggccgcaggttgtggaagcgggccacacgggccacggcgccgccggacatgggggagaagactgtttaaatgaagacaaaccaaggataaagttgattatcaaatataattaagactaaattacaactgcgcattttcttacatccatggcatcatccattttctacctcaaatccgaaaatgtaacatgcccacaaccaaccacaatatcaacatgttttgtacatgaaaagtgacaaaatatagaaaatacttttgagatgttattgatattaaaacaaaagaatactccctctgtactcgtaaaggaagtcgttttgaacaatgatacggtcttcaaaacacaactttgacttgttatttctataaaaatatttattgaaaagtgatatatgtacacttttatgaaagtatttttcaagacaaatctattcatataatttttacattttcaaactcaataacttgagagttattcatgatttatattcctaaagtttgacttaaacattgtcctaaacaacttattttacgagtacggagggagtataccaatagatggatcagtcttggatgagctgcctccaaattttaccttacagttactaggaaactgcaacccaacttgctcacactctgccttatagcatagataatagtgagctataaattaattataaacttacgtggatgagagaggtagcaagaaaaaaaatgaagggtgttactcttgtgcaagaactagctcaatacgtgctccaagacaaatacaataaatgcataagtgagataaaagagagaggacaacaaaaattgaaggaaccttatagctaatctattatatatgttgtctttaaagtatgataatagctgatagtgagctctaatattaaatttgctcttaagacgtgaggatatgaatggaatccaggtgcttaatagccttacaatatccagtcacatattggactcctgcaaccatgagcctaatataactagtgatctttagaaatatcttagctcggattgaaatccatttacatccatgccctgatatgttacacctataatttggtcatagtacgccacaccaatttgcagttagacaacaaacttctcagtgaggcatcggttatcttcaagcaccaatccattcttaggctatttaggctactacaacagcaagagccaatgtttctatggactctagtcactctacactaacatcaacatttgccaatgacgagagtctctaggttatgggaaaagttagccagtggatagacttatcaccttactctgttataatccagcggttttaatgaaaccaataacgctgaaaagatctcaacgtattttacctggtcgtcatcgctaatccacatttttttatccatattaacatcgagccattgcaatcttcatgcctccaaaccacgacactattcactatcatcgagtcgctgcatttgagactagtctttgtcctttatcatgtcaaacttgatcatggcctcctaaccttctattttctttgccatcacaccaaagtcattatagttagcttactagatccatgtgtcatgtggtgccatgcagaccaccacacacctacactaacatcgctaagttattactataatagtcttcttcatcactttgatcgatcgtaaggacgattcctaaactgccagtgctatatactattcatagtgtttatatcctctacatcacctatgatttatattagacataactctctcaatacacatcaataatttaatgggctaatttaatgtaatttatttctcacaaggtttagatgtaatccatatatttttcatctttccttgttaactcatatgacaaaaaaatccccacattctatatgaaaatactcattccatttcaatttacttgccgttcttgtatttatctatttttccataataatcatctttttacaatttatagagatgtgttttcttccctactatttttaaatatagttatattaatgctattatctgttacaattaattgtactacttattttgaaaaaacaagatataattaataatggtaataaaattatagttcattaatattttttcgtatacaatgtaataaaacaacgacgacgacaagtaattcgaaacggagagagtacataggtgcagccagcaagggcttaatgag

SEQ ID NO: 56154 - DNA, 2079 bp, Oryza sativa
tattttgatctaaacgttcagccagaacataggtgatccatattattctacacgattatgccttgtcattatctgcagttctatctgttaacctctaaatctttgcgtcgttctcttgttcattgaccgtaaaaactacactctttgagagtatggatcaatgcctaggtctaaaccatgaaaaagtggaaagatttaatgtatgcttttggcatgctttctagaaagaaatgggaaaatagtgtaaaaacatttacttttgggaaggagtgaacaaatttatctagacagtagaatgaaaaagtcgcttgaactcttagactgattacatagacatctctgctccagttgttttgaacttcgaagacactggtatcatatctatgggcctattcattctgttcattttgttgccacgttctaccattgctattctaccaaaattggtagttctgaaagtttcccattcccactcataatgacacaaccaaaatttggaaagaaatctaacaaaacacatccaagtatccaacgctaccaaaacttgccacttcctaccctgccaaattttggtaaggttgtttttggcaccaaagtgaacaagccctatatacttcccaaatatgtttgatttgcaaatctattggtgaatgtgcatagcattttgaatggaacacagtgactgatgtattgctatgcacaattatgaagtatgtcagccacatttatggcactgtcatgtgcatatttttctagcaagcatgttcaacaagattcgtgagttgtctgtcatagtgtcatttagctcataatcgtcaactataattgactggaaatgatgctgaccatccgacccttccatattttcatcttaacactatctttttcacataaactctgtactattggataactttgtgagttattgcctataattgttttcttctatagttattctctgaaataagaaactttcatcaaagaccatagtacctgctattaccagtatgattgttttgaaactttccatttttaatcattttgatgcagtgaagtaggtggctgtgaatattatcctggtggtggtggctgtattatacttctttccagatccttgtatgaacaccacacagatttggatttaaagaatgcgctgcttcatgaaatgattcatgcttatatgtgcatcaaagatagtaatgataaccataggtactttttagtaccatgactggcctcttcttgtattacacctgaatttctgtctacttttttttttctcgttttgactaatttaaaaactgtgatcaagcagtgaccatgggccaaaattccagaaactgatgaatacaatcaatttaaactctgtagccgatcctcatgtaagttgaattcaggtgtcaattttcaatcagcatgtgcttaaatatttcttattatcgtaacgatatttttaattatatccagcgtcctcttggtggctacagcataactgtgttccatgagatcagaaagaaattttatatacacaaagtaagaacctgatctttaaaagtaaatcttattttctaatttcagattggcagctaacaatctctgtagtgtgaaagctgtggagatttgatcaagtcaaccaaaatcaaaggaccatcacaggatgactgcattgaggcaatgggtgctaatgacttgtgtgacagtttaatttgtcactggcattggtattagctatatatttctttgcattttttttgttccatgcatgccttattggtatatctctaaaggtgtgttcggaatccccagttcccaactcatccatctcgttttccgtgcgcacgcttttcaaactgtaaacagtgcgttttttacaaaaagtttctatacgaaagttgctttaaaaaatcatattgatccattttttaaaaaaagattagctaatacttaattaatcatgcgctaatgaaccgctccgttttccgtgcggaggggataggttcccatcctccattactgaacacagcctaagagtgcacataaatattcatagaaatatagctagatgtacattttaaagct

SEQ ID NO: 56155 - DNA, 1059 bp, Oryza sativa
agtgtttctattggctactcaaggatctagaacgtatgagttatgatgaacccacacatggtgtaggcctgcatatgagcatatctgtcaggcataaacatgaagtggtatcaagatcccaacaaaaccatgtgctcttacatgtaccactgcatgtctgcatcactcccaacatacccaaaatatttactgtttgtctccactcttagttggcggattgctggagtagatgcattagtgtgctactgggttgccccttatagtgggtagtggtgtggcgcttgatcactgatgtgacaaagacttctccaagggtggaacttaatgcaccttgaatagcataattgttcaacttttattgttctttctggtcctatttcatttgattgattttttctatactctaggctcctagctatgtggtacatataaggtaaaacccacagggctaaaacaggtatcaagacctaagtcataatgtggggagctatcaactttatccttatgataggctttttccttcttgacatctgattctgatgttcagcagatggcgttcctttcatctttgtttgagtacaatgatactgcaatgttgctgttgttattgtatcttttatcatgcgggtagtattagtatgctaacttttgaaaacctatctgtagattttaggagatggtgatgtatcagtcaagttgaatatcaaggctggggcattctctgcttcagccaaggagaagctcgaggcagctggttgtactttaagtctggtaccaaagcggaagaaatggctaccacaatcttatctgaagaaccaagctcgtgcagaagaatactttagcaagaaaaatggtggtgctggtgaatctgatgaagcatctgcatagaattcatatacactgtacttctcctttacccttttctttaacatatacttatttctcttaccttgttccaaaagttccacgttcaacgaattttgaatccgtgcgatatgcaagcatttttttttgtgtgtttcctgtttaaatggagaaaattccttctatacccctgaa

SEQ ID NO: 56156 - DNA, 17005 bp, Oryza sativa
  unsure (1)..(17005): unsure at all n locations
ttttgttaaatttatttataaacttaataaaacataagtaagggtggttagaaagaaaaatcaaaacaacttataatataaaaatataaaacgaagggagtattaacctattatatgtgcaagttggatcgcagttgggcgttggtaaggttggttgtttcctgccgtcgttgcaaggacggtaaggtggtctgaactctgaacttcgacatcacccagaatcttcagtttcgcggtgcatatcacaatcgtacatgacatcgagagatacacggattcacgaaaggccaaatcttacatctagttttggtggacatcaggagtgcatgatttattaacttttttcagacagtcgatcccaactcccaaccgaccgccgtgagcccgtgagaaatgaacatttggagttgccatcctccattgtgtgcaagaaaaaacgatcgattccaaccatgatagccactgacgctgatgtgaacgacacagcctttgggactagaatcttgacgtatagacgactaaagaacgtactccatgttagtttattataagcttaatcttttcgatcggaaagaataagcaaccagtctatgaataatgatatcaattcaagctcatcatctcgttgcagatttccggagttagagccagccgctcacccaaccgtttccctaatccgtcattaagatttcaataatcacgtgttggtgagccgaaccagattagctcccgtacgccatcaggaaaatcaatctaccgccgtgtacagcgccagtaatgtgtcacgccgtacgtacaacgagattataagaatgtaacgcatcgtgagcgtgaaaacgatcagctcgcttacgcttcgcctgcatttcctgcagtttcggtaacatgcgtatatggaggcccatttagggtctctgtttcttctcaagttaataaaaaaaaacagcccacaggctacagaattggtgtatagtagataaaaagacacaaaaatgaatgacaggataactactatactcagggtgtgtttgaggagattgggaagatacgcaaaacgaggtgattaattgagtattaactattttaaatttcaaaaatggattaatatgattttttaaagcaactttcatatagaaaatttttgcaaaaaacatcccatttagtagtttggaaagcgtacgcgcggaaaacgatgtgcattcttactccctatcacccaaacaaacacagccttagaacacatataccaatatatggattaggattactggtgatttgggaacaaccaactagcagtcatcttaaaaaaaaaaagagaagtcagaagatagctacagtgaattcattagtgtccagagagtgcttgtttgacaagcaagtcaaaagtgtcaaacattgataacatcaggacggttggcatgcgatcgtgcaggtttaaatgcagtcaacaaagaagtcagaaacgactcattgtacgtgtacgagtacggtcgctgttttgcttccgtgatgcgggtggacgttaaggtctcatcactagcgcgatgtcccacagcgatccagccagcttcatatggttgcatatacagaaatactactactttgcattatcaactatgctccattcagcttcgtgttcagatactctctcgatacttgcgtgaagagagatcagatatggacaacgaagacgtgcaacgtgtgctttcaaaaaaaaaaaaaaaagacgtgcaacgtgttacatgaacagtacggcaaatgcgatcgaggatgttactcgagttattacggcatggccaatcaaagttgacagttaaagtccaccctcagcgaacaggtgattgatcgattagtactcctaacgctgctgtacttctcgaataaacattgggttattcaaaattgttggagtagttataactggaggagtcatacaattattataggactgtgacctcgatcaggatggtttctaactctgttcctatcaggtagccttcaactccaacacaatctacactctgattgtatttacaccctgtatatgtactacttcctccgtactcgtcgttttggtcgggactcgggagtaaaatggagtttaaccgttattattttctactaagcaacttcaaagtgaataggtttaagtgtatgtaagatattggtaaaatattttgtcgacgtttgatgtcgcgattccggtatttgaatagtatggggattgtcggagaatgaactcctccaccagggaaccgtgaggcccccctttgtgagttcggccgggggcagcgggtgagattcgaggatttggtgagcgaaactgtgtggtcttgagggggttaggcccctccaagacgatcagaccaaagaggtttatacaggttcgggccgctatgaagcgtaatatcctactcctgtgcatgattgattgaatgtagaacaccagtgcttggggttgcgagacccaagcgccagttcgctccgaagtccctcccctccaccactaggcctagacctccttttatacctcaaggggttaccacatgggcccaacaacctaacctaactccggtggagaagtattataatctttgcattaaatgcatgtcttgtttcttgacttgggaagccaagcacacgtcgtcttgatgatggggcctgtcaaatcttgccgcctgacacggggggtgcccctgtcaatcaccatttaatgggtgaaaacttctgggctccttttacaccgggaaacgggagccttgctttgaccagagcgggaggaccgactccggctgggataagaggatgagaacctctcaccatcactatttgatgggacatgtcaggctgcacaccgcctgacacacgagcagcgcacaggcgcactagccagtctcatcggtcattcgaccggtcacagaccggttgagtgcactgcacgccacattaaatgcggcgtagcgcgaccgcttgggacgccataaatacgggtaggcggacacctaacccaccgtacgtggtgacctagagatggggtcgggggagcccgacccctagtcacgggagggggcggccgccgcccgacctcgggcctgatcccccctcggggggggggggagccacgtggcgcctggggcggccttctccctctagtctcggccagggagtggccgccgccctacctcgggcctgacccccctctggggagggccacatagcattggagggcagcgtcctccatccaatttctgggaaggagtggccgccgtcctacttcgggcctgactcccctcgggggagggccacgtggcatcagggggcagcctcctccgactagtctttggggaaggagtggccgccaccctacctcgggcctgactcccctcgggggagggccacgtggcatcggggggcagcctcctccctctaaacctgatacccccaggcctatatcaccgacaaggatcgttggtactaggatatatgcgagattgaggtaaaagagacggagacgatgatttttatacaggttcgggcccctgaattatcaggtaataaccctacatcctattggccggagccggtgttgctctttattcactataatcacaccagtacaatatttagggtagcctatctaactattgtagacttggcggtctgaaattctaactcgtatcgacaacagggtagtcttcctcctcgaatccgtgcccggcgagatcagagatagcgctttcgtctctcctgacagtatccggagacaccgtaggggactagccgtgcttatccctgaagccgctttcgtctctcctgacagtatccggagacaccgtaggggactagccgtgcttatccctgaagccgctttcgtctctcctgacagtatccggagacaccgtaggggactagccgtgcttatccctgaagtcgatatccggcgtcttgtcttggcttatgttggcttgtatgttgtggcttctgttgttccgtctccactctcctcttaggaggtcttatatttatacccataggtgtccccttgtccaagtagaactagggaaaccaatatggatacaatccgagtagtccttgtcgttttcatgtggaactctattcatccttccttatgcggaactcctcttatatctgaaggttgtttccgtataagagtatgtggtgggtcctgtcgagatttagtcaactactattaggtatgtggtatctataacactgacatattttccatcgcaaaactaataataagtagtacaacattgatgctaaataattagattatttaagtatcaaagctaagcaactcaaagtcaaaaccgatgattaacagatgaagtattaaatatatttttttgcgggaatgaagtattaaattttgacttaggtattattatatatgttaagtttcaagttatcatgcatgtaacatcatgtacgttttcacgaaaatgctcacacccgcacgaccggcggggtggagaaaaatcggacgttgtctaccactacagtatgcaaagaatcttttcttttcttatttattcaaaagatttttttatcgtaaactatttatctaatctacgatctgattgcaccactaaattcgttacaattaaatctttacaataagaccacacatgattatatttcgacaaaatttttattgatttttttaatgttgcatgtggtcacttatgtttcaactagtagttttacaatgtttcagctagtgtactcatgatgtttcactgtgtacggatcaaatgttgcagtggaacgtgccgttgcaataaatcacccacatattttggaaaccctctattaagggaattttgtttattttttgttccacaaaaaatgtttcacctaatgcactcacaatgttctactatgtatagatctaatgttgcagtgaactgaaatatatcattgcaacaaaaaacccacatattttggaaaccttctattaaggaaattcgtttcattttttgtttcaccgaaaaatgttacatctagtgtacttataatgtttcactatgtatagatgtaatattgaagtgaactgaacattcttccgctatttgctgaaacattgtttttatataaggtgaaacaacaccagatttaaacgagtgaaacattttcgagaaacaattccgatatatctggtggaacatcgtgcaacatttaaaaatatttcaataataagctaattttttttcatcggaatatatccatgtgtggtcttgttttgaagatttaattgcaacgaatttaatggtgtaatcgaatcataatttggataagtaatttaaaaaaattagtttaaaagtagttttgtatgtaaatcgaacgctgacgtcagtgtccgattttttcctaaagcatcgaacgtccgacgcgtaccctctccatgttttcatctgcaaaaagtgtacaaatgagtattaattggcacgtgtctgagtctcagtgcccatgcatgttccgcttgttttaattcagttattttcgataggcaacaaacaaatgcaacttttatatgcacaagaaaaggatacagctgccgaacgcacaccaacaccaacagctcacacggttgggacgtgttgtcacgttgaggcgccgttgggcacgggtggcatcactccacccgtgggtgggcaggtttcacccggatcgagccgtacgcggacacgcatggcgtcgacctcaccactgcaaatgcgtgcggttagtccaccggtggcggcctcacatcacatggctcgctctcggtctcagccaataagccaaacgacaacgaggcaggcggcggctggaaaagcaaagcgcctccctggccgcgccgtacatgattcgagcgcgtgcgcggcgtcgcgaactggctggccggacgtgcccggatgagatagcgcacgcgccaacgtgcatatgcctacacgccgcgcgtgcggtctgggacgagtttcggtgcgtgagatgacggacgatgttcggttgcggactggcggcgatggatgacgccacgcgacgcaccgcgcagcggctggccgtttttcggttaatctatagtagctgagctgggtggtagtacaaaattatatattttttaatataattttacttaaaattaaaatttattaaatagttaccttgttgtcttaagattttgaaagaccaaacatatatattaaccatttcattattaatcttacaattattattctgttttataatccgatcacactattgtattcgttataattaaatcttttcgacaagatgtcatatgactatattctacttaaagaaaaatatatctttcaacagttaaaatttaatgttgcatgcgtgataatgtggctactccctctctctcatattacatgcatgtagtaatttttaaaataaattttcttctaaactatttatccaatctacggtatgatcgcaccattatgtttgttgtaattaaatctttacaacaatatataacatgattatattttgatgaaagtaatacatatgttttaacatatgttttcatttcataaactttttaaataattcatttgctatttttttcagcatgtataacttaatgtttcacccatgatccattaaaaatttaatcaaccatttatttcaaggacaactgtgttattgcccctattttatgttgcaattatgattttacccttcttttttagattggtgtttttacctttactttttgctaagaaagcttcagtttgccccaattctaaatggttgttaggtggcccagatttgtgagataaaataaaagagaaaaatattaacgaagtgcaaaaggactattgtacccccaacacagtattcgttcagccgttcccattcaaatattcctatccaagtcctgtgtagaactcgagcagttagcggctgaggctgggggtaggcgggtagctggcggcggctctggcacagcgccacgggaagacaacagcgggctacggcgagccagcaacagctacggcgcaacacacgggaaggcggcagatcttgcgcatcaccacgggaaggctgcggcgagcggccggcggcagcgctccggcgcagcattacaggcagttgagcagtgagcagcatggcgtggcacgacggcaacaacgacacatatacggcgggcagttcgtccacaaagacgaacgatgccgttgctgcttgattttccttttgttttttcccatctcatagtatttgtgacttgcgaggaatttatgtaaatattagtgctgaagtttcgcaaccattcgaattatgtgaaaatgctatcaaaattctatgaaattttgggatacaaattctaaaatacatgtctttttacagttgaattcacacaccgggcaaattgaattttcgtttgaaaaaagtagggatgaaaacacaaatcctaaaaaaaaaggtaaaatcataattgaaatacagaataaaggtaagaacccgtttgtttcagaattcatgcaacctgctgtaaacttgtgtgtcgggggccttgcaggcttgcagctacggtagatggaatgatgagttcggtcaatatttttttctttcacaaagctaacatgtcagggtaatcagatgttaccgtgtaacacgtctaattaataatctaaaaaagaatatagataatacacctgatcgtgagtgatgttcacccttgcggccttacctagttaccttcattaatgcctaaaatgattccgaaacaagttattctccatgccatccgtaggctacaggttccctttatagtcgactagattcattgcagaacgaacatataaattccttccattgtatatatgttgtacatctaaaataaactcacggcttttatgtacatatttgagggcacaatttcatgtgctggtagcctggtaacgtggtagcatagtacgtaccatgtgaaattgagtacgaggacgtgaaattgagcaagttcactttaggtacctcaatttatctctcagtctgaaattcatccctaaactaaaatgacaggtatagcaggtctttcaatttacaaaaccggatcaaccgagatcctaggtagtattatcaccaattttaactgattgacaagctgggctcacatgtcagtggataacatttcccggcgccatcctccgtgttcatcgtcgcgtcgatctcgtcggccagatgacgacgcacgcagcagctgtggctctgtggtcggtcaccgttagggaaggaggaggtggtggtcacggcagcggccatgccggagccggccacggccacggcggcggacatggagcagccacggcaggccggacccatcagagcaccacccgggcaagcgcagcgcggcgcccggtgtcgggcagcctcctgcgccgctgtcgctctgcttcccctctgaatgaatcctgacccgaaccgcaccgcacccaatttcaaatcttgaatttaaatcgattgatcttgttgtgtacatagaatgaaatgaatccaaaggaattttttgcgaacgcagaatccaaaggaatcatagagaatccgcccgattcgggatttccggtgagattttcccgcatcttcaatctgcaatctatgtgttctttccaagaaatcaaggttttttcttggatacgttcatagaatcgaataatgcattgctaaacctaaaagggttcaaaaaaaacgtagtcagctttcaagtcgcatttaaatacgtagctacggccaacctgcgaaaccgagacaaattcaagagaaaattcctgtgtacccttaaaaattcacctaatcccttatacgtccttgaattttacttattttcttatatacccatgaattttagtttggatctcttccatgcctttttccgctagttgactattagttaaccgttaaatttttaatgaaaaaaacccattttaccctctgctatgaaaaaacatataaaataatagagtagaaatttgttagatgggactattatatttatgagttagttatgcaccatattatttgcgataaatatacttttagatataacataaaaaatagtacttacttattagttattaaaagttttctatgtagcacattagtatatttttcttatacgacaaatttgttgtattactgtcaaaacacatatgctacataaaaaaaagttttaataactaataaataagtactactccgtttcacaatgtaagtcataaaacttacattgtgaaacggagggagtattaattttttatatgatatctaaaagtaaatttgtcataaataatattgtgcataacaaactcataaatataatagtttcatcaaataaatttctacactccaacaatctactccattagtttattatgtttcttaatagtaaaggataaaatagatattttcataagaatttaatgatcaactaggaaaaatggcataaaaaggatccatgtaagtaaatgagcaaagaatggattaggtgaacttttatggatacatagggagttttctccaaattcaatgatcacgaaaccatggctcctgctcctcatcttcttcctcctagccgtgttcttgcaacgggtgattcttctattaacgggcaagcgattcatttcatcctctccgttgactctctctgctcgtgattagattgatctgatcttagtggtgttcttatcctctcttcctacaaagttataatccattaattactaaagcttaacatgtaaagatgacacatcatcgttcactaacaatcattaaatttaaacatcatgcaaacatgctatattaactataattttataatttattaaattttagatcttttaaaatgcaagcatgttaaattattatcccacataattcacataatatttttatatatatcttgattgtttttttatattatactatgtacatatatagttcatcatcacttagttctctcttctctcattaagtcatatcacatcaattgtttttagtgcttaaataaaatctatggtccaaattagattcgtctcatgaattagtccaagattatgtatgggttttattaatagtctacgtttaatatttataattagaacatccgatgtgatagagacttaaaagtaagtttcagtcccatctaaacagggtcaaccagcccggcaccacccttcttgtgacccctctgtcacgaatctccaagcagtcagacggtaaggatggtgggtacttatgtacccgagctcaaatctatgttatatatatatatatatatatatatatagattaatcatctaaaggctaaaaattatcgagatgatatggattaataagagaagaaaaagagagataatttggaccatagattttatttaagcactaaaaacaattgatgtgatatgacttaatgagagaagagagaactaagtgatgatgaactatatatgtacatagtataatataaaaaaacaatcaagatatatataaaaatattatgtgaattatgtgggataataatttaacatgcttgcattttaaaagatctaaaatttaataaattataaaattatagttaatatagcatgtttgcatgatgtttaaatttaatgattgttagtgaacgactattgagcctaattaatccatgattagcctatgtgatgctacagtaaacattatctaattatggattaattaggcttaaaaatatgtctcgcaaattagtttttatttatgtaattagttttataagtatagtattctggcagggagggttaaatgtagagcatggagtaacccgtactattgctacacagggaccgagagcaagaatcccggatttggccttttgctgtgtgaggaagcgtcttacttattaaaaccactcttggcgcaggctcttctcattcaccaaattaaaatgacatttacaaaataaaatatcgatctattatatatacacacgctgaattttttttttgttgaaatgatatatctctattcaccaaaaatgatatttacaaaatgaagtatcaatctattatatattttgactttgtttttacaggcatgatgagaacagatgggtggatggcaacccaaatttaaagggcaaaactagataataaggatttcagtaaaagtactaattgatccatggcaaaagattacaagaactcgtgtgaaatcaaaataaccggaagatatattatagaacggaacataaggaaggcaataaccttctcgagaaacatgagaagaaggtagcagtagcacccagcaacaggccaacagctagccttcgagaactggaactggaaagaaaaaaaacagtaaattgcatcttgggctattttttcttacctgtactgtaacttagaccagtgaaaaagtaaacttttcactttgaaccgggtatgtttacacaatgtttcaatttagactctcttcttcttcctccaactccctttcttcctctcttttctccgtacagctcaaggtctctttctcgatcaggtgcagtgcatgaaaaggcaagaagcaaaacctttcacagggtagccacccgccgaagttgatttcgagctcaaatgcaggcggcactacgaaggcggagcttgagcgctgcaaaacttgttgaagctcgagcgacacatgtggaaatttagcgcaggcgtgcagcataacatgtagcactagctgaggtcgagcatgagcttgagagcgtggctatctgctacttgacttagttcttatcgtcagttcagaaagtagcagcaactgtctgccattgccggccagcttcttcgtatgctagttgctaccagtaggaatacttgttgtgcaccttccgctgtccttgaaattaagccacaagcactaggtagtcgagattgaaaatgcaaactaccctttgaattctttggaagattttacagattgaaggggagattgggggaagagagttggaggaagaagaagggagtccaaattgaaacatcatgtaaagatactttgcccaaattgaaaaatttagctttagcctagtccaaattgtaacaatggtaatcaaaggtggctcaaagttcaattcactaaaaaaaatgcagcaagcgaaatacaaagagcatgcacatgaactgggatttttttttctcaagatcaaccaaataatttttcacatcaaggcaggaccttccatgactgtttcctcgccagagagaggggagagagagatcgggaggaacatgcagtggcgaaggatgaggtagctgcagaaatcctccatgtcggcctactctcatgggggatgcgattccgaaattatgtgcgcaccgctggttccgcaacagctttatctgccggatgcccagatcatcagcttcagcgctcttcgcacacatcataaaaaaacaaatcaaataatggaaataaaattaaggaaaaaaccaaatcgaccaagaacacccgattcccaaaaatccaaagaaaactcactacttgggggcagcggaagcagccaccgccgggctgcgctgtcctcggtcctcgtcaacccagtgcctcctccctacctcgctgagacatggatcgagactagcagctacgctgcgctggcgacatcacatcgccatggacatccacacgaattatccagcgctaggaggaacagggccgtccgatctatcgcctaggaggcggagggctgccggatttggtggccgtggacccttcccgcgctgacccacgcaccatgtcgctgctcaccttcctactcccactcctctcactccttctcgacgccgacgcgcgccatagcttcaagatccggcgcggggtggaccaaggagtctcgagccagtccttgtggtggagtcaagctcgagtggtcaggcggaagcttgccgcccctcaccggacaagctcgccgccggtccatcgtccacgagcgagggcacagcccgagtagtactagaagggcatttcgggtaaaactacagtaccattgtgtacccaccgtccaatcccaccagctcctattaggtgaaagagctacttttgatagagcagatacacttcactaggggtaaatgtaccatgctttaagattcgtgtgcacacgtgtagggtgcagatcgtgggtgcatatgaacccaggtgcagattatccaactcctataaataattactgcctcatgttataagttaaattttaactgcatgctatgtacctggtggggagcaaggtgagtgggttagaggctgtatcaggtgttatttaatacgtagcaccttataacttataagatgaggcagtaattattttactcagccttcactaggagtggtgtacaggcaaattagaggagagatgatccagtgatttttttacttgccgtacaatttttttactcattaagcgttcacatcaccagacgagtaactttttaactcgggacaaatgggatgggaaaagcctttgcaggcggtggtagtagtaaaagcggtccatgaggatgcggcacatgagaaaggcgagaaatccgaagttggacccagaaaaaactaaaagccaggaaggcgagcgctgagaggcgcgctacttccttcgtagcgccaccatgtgcgcgcgcatatatatatatatatatatatatatatatatataaaatatttacaaatagggagagaaatagaatttacaaagttattacatcaccgtgtatatccatgatttccaaataagtctttctactttcaaataggcccaaactatctcaatatttttcttctttcataaaatcatatcaccttacttttacatttaatcatcattctatatactattaaaattaaattatcataaaccacgttaacttacgtaatcttatgttatgtacctatgttacacattgtttttacttattgttatcatactaagctcccgcaacaatgcgcggagtttcatctagttgtcttgatgcgtatgtaccagcaggagctaaggagacgacgacgaaaacgttggttggcgggcagccgacgtccagaacgattgggaagagggagaaggggagagagagaggagaatgaaagtgctacccactgacatgtggggcccacgtgggtcccatgctaagtcagcttgtcacgtcagttaaaaccttacacaatactacctagatctcaggtgatccagttttataaattgagagatcggttatatctgataatttggtttagcaatgaatttctgactcggtgacaaattaagggatctaatgtgaaccgactccattttaaatcgagtgaccaatcgtagagtccctccgttccgttgtttcgtgaggcgtgcactcgtactcggtgccgaaagcgtccgctcggccacatttaacccaccacagcaccacggcctaaagaaactattttgacttccgtcggcccagcactcaagttaattaacgatttaccgctcgctgcgcggaaaggaataaagtccatcagaggtccctcaacttgtcaatgaatctgattttcatccctcaaacggaaaaccagacacaacgagtccctcaactatcaaaaccggcgcagattaggtcccttagcggttttaagggtggttttggcagacgtggcgtctacgtggccaattggactcggtcttcgtctgacgtggcattgacgtggcgcttacgtgacaattcgatcggaaaaaataataaaacccgtgggacccacatgtcagtttcacattaaaaaaaggtgggacccatgtggggcccacatgtcatactcacagccttcctcttcttcctcctctctccatctctctcccctctcctccctcctctcgcagtctcgccagccggcggagataacgacggcctggagaggcgtgacctcctccgcttccgccccctcgagcctatcgccggcggccgctgggaaataagcagcacacgagcgtcagccggagggaggagaggagcggtgcgcaggcgcgggcgtgggcaccggccggaggaaggagaggagcggcgcgtgtgctcggccggcggaagtataggagccacgggcggaggccaaggggagcgggagaaatccgcgacgcgctccgcgtccacatgctctgtcacggcgccccgcgcccccaccgattcaccacctacctcgtcacgcgcgtcaaccactgcctcccccactcgccaccaacgcctcctcatcctcgagggcgatggcgggctcgagaggctcctcgacctcctcgacgcggctgacgccggcgtcgatgcgcgggcggcgcttgagcgcgacgacggcccggtcttcgaggccgtagagacggacgcggagcacggcggtggcggcgcagagggggggcgcggcggtggtgcggcggaggcggggcgcgaggaaggaggagaggcggcggtgcgcggtggaggcggggcacgaggaatgaggagaggcgacggtgcgcagcggcgtcggggagacggagcttgatctcgacctccatcacgggaggcatggaggagagggaaggctagggtttggggttgcgattgggattggtagggaggctgatgcggttggacttggagggcgcggcgccgggcagcgggtggagaaggaggttggagttggaggacggcggggtcgtggtcggagtggatgaggcagtgggtgtgctggctgccgcggcggcggcggcaacgtagaggtggtcttcgagctcgtcgcagttggaggtggtcttcgcgcgccgccgctccggccgccgtcgccccacttcgcccgctgccctagtgcacatcgtcaagaagagagagaggataacgggaagaagatgaggggtaggaggatgacatgtggggcccacgtgggtcccaccatttttattattttgtatgtgaaacagacatgtgggtcccacatggtttattattttttcggatcaaattgccacgtaagcgccacgtcagatgaagaccaagtcgaatttgcgacgtaggcgccacgtcagccaaaaccaccatctaaaccgtcgagagatcttatctacatcagttttaatagttgagggacctgttgcatctggtttttttggttgaaggaccgcgcggaaacgtcgccggtagaggcgtagagccggtagatttgtgacgacgtcttccgcgccgccagatcggcccacttctcatcttctttattgtgaggccggctccatatatatcatatttatggccggctattacatcttcgattcctcctccccaaacgcaaggcactttccttctcctctctctctctcgacgcatcctccaacttgtgcacgtcttcctcctcgatctccatggccgagttccttcgccggccggagttttgtctgcccatgcacatatacacatcacgcggatcgaagatgggatgaacgtacgtggagcggtggaggtgcaaccggcaggcacggtggcatctcgatcgatctatcgatcgatgaggaggccacggtggcgtctcgatcgattcgcgacatgttcgccgagatctatcgatgaagaggccggatcccgaccgtgatgcgcgtgcgggcgtgcggcgtcctcggcggcgccgatatgctttgtggtcgggtatggatgttccgtctcaacgtcaacatatcgagctaattagtatttctttggacaataatggcgatggagatctgtgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56157 - DNA, 1620 bp, Oryza sativa
cagatatacattttaaactcttagtatgcctactcatacaaattgatgatactgctaattttgttggtagctttatctgtagaagcacctgattgcaaagttgaagaatcagcccctggaagttggcacaatgcgcatgcatcaattaagggtggaaaaggcaataagcatgaactggaagaaacctctgctgggtttcctcctgatgactctattggtatttctggaatggagtcctcttcaagagacacagctaataagaaaatcaaattgtcaaaggatattggtttggaccgtctaaccgccacaactgttcaggaagcaccgaagcgtccaagaacaacctcactaaagaagaatcaagagtgcagcagacagaagaaaagaaaaataagcaagtgggatggttcctactctgtaatcattgaatggttgaattactattctgtggatgagtcagatgaagatgaggtgcctttgataaataaaagaaccgaaagaagaaagcggcagaagttactgaaacttgttcttgctagggaatccaatagtggcagtgaaggtgctagttctacatcttttgtagaaaatggcagaaattctagcagtgctggctcttaccccctaagccagggggacaatgacaaatctgaaaatgtgcaagctaatcgagttgatgtaagttcattgccagatcatcctgtaagtagtcatgtagcagcagaggatcaagctggccaagctgcatcgtcaccattgaactcaccaactagaggtatcgttgttgacatttcagatggttgatggccagagttccattagtttctttcagctgaggcctggacgtacaattatccagactacagttgtaacacttacttttaattccttgcacctgtctactgctagacatgcaacgggacgatcctgtgaagcatgtgtcttgtacatgtcttcgtttcttcctttctcatttcacctttcttttcttagcatagatcagttcagtatacttaactctgtcaggttgtgtgacccatcagtttctctccgtactagtctcttgaagaacagcaaagatcaggttttctctttggttgattgtgtgtggaagatcaatccaaatatgttcatttcttaagaagataaattcagttctattctattcataaacttttgtaaaccttctaaaatcctttaataaacaagaagcaaagtgagtaatacgaaaccattcacaaaatagagggaaaagaggcccaaattcccaagggttaattggattcatggcccatttatccaaccgtcttatctccctcgtgtccttccccaattatccccttctatccacccacaccagcaagccgctcaggcgcgctctccgctccaccgccatggcgtccatcaccctcctctccctcgctcccgcggccacattgctccacctcccggcctccacttcgctctccacctccttcgtcgccgctccaggccccatctccggccgccggtccgtcgtcctccgcgcccgcccgcgccgctgcgtcacggtcgtgtgcagcgccgcggcggccgaggccgcggaggcggagcccgcggagaagttccggctcgacaacc

SEQ ID NO: 56158 - DNA, 8378 bp, Oryza sativa
ccccccccccccccccccacacacacacacacacaccctcatttcctcggcccaaccaacacccacccccggtccgtcgccagccaaacgcatttaacgcctcccaaccgcgccacgcgcgcctgcgggtgcccgaccacccaatccccgctgcttctccccgcgtccaacgccacgcgacgcgcgacgccaagttgccacgacccagcgaggtgaggagtgcgcgggggagcaaaacccagcgcagccgcgctgcggccaccggcaacgccgcgccgcgaccacgcaaccggggaaaaaagcccatcttgtcaccttcctcggccattaactgcgatccctccagctagccaccacagcttagctcgcgccagcctcgcgtccacacgcccacccacccacccacccggcgctgagctgcgcctcgtccgcatttactagcatccgatcggtctgatgcccgtgtgaggtcgtgaccgtgatgacccagccacgcaacgcacgcagccgtcgagtacctggatcgaacggccggctttcatcctcaccggggagtcgaccgtcgccataaatgtaaaagcgattaacgtcctccacaccggagcatgattgatgttttgaggcggaacggaaactgaggaagaaagccgtcttctctattcaaggaagagcctgtcccggaaaacatgtcggcacggcgactgcatttatttacgtgttacagccgtataaacagagggatattggaaattcgacaaagggtaagaaagggataatcagacaattttggattattgtacatctaggggcaagggcatgtttggctttcagctcctccgaagtgaagcgggctagaccgcttaagcgctcccaccgagactgtattgggtttagtattgggtttaggctactccacaattttatttcaaacctaactattagagttaaatttaaaagttggagttattctcagctagtcctctaattgtcaaccatagcagatcgggcatgtaagtaaacccacgtcgttgtcagaatttataacagaaatggaattctagcttaagagaggaataaaacgtgagctaatgagcacaactcacttcaaccagtaattagatggatcatgtctgaccggttgcatgaagtgcgagtcgattttaatctagtaagatgaactcaacttcagttagtaattagatggatcatgagttcggttcgagctaaaactcccaacgacggatcatgagtagctcgtgccctctccttcagatttttttgtacaatctcctaacatattccatttcttatcaccaaaagttttaagaccggaaccactgatttttcaggaacaaagaaggactgaaatatctcagtataatactacctctgtcctaaaataagtgtagccatggatatccgtacccaatatttgaccgtccgttttatttgaaaaatttatgaaaaaattgaaaatatttagtcacacgtaaagtactattcatgttttatcatctaatagcaataaaattactaatcataaaaattttcaaataagacgaacggtcaaacgttgaacgtgaataatgcaaaactgcatttattttgagacggagggagtacgcagttgtaatcaggtagtcatctcagtaataaattacgcatgtctgtatttggaagagtaatgtagtaatactgtactagggttttcgcaaatcaaaagagattaattggtgtgcagtgtaggcctaccagtctaccagagactatgcgtgtatccctttcgccagtaacgatacggattgcaactggagcctatgagattcgatcacgcccctcaattccccaatccctctccctcttcatggatcctgacacgaacaatcgaacaaccacggccacgctaaattggaaaattaaaaaaatatataataattaatctcctgtgaatgatcattccttatgtgacacatcagacaaagtatatcgatttaatccgtgtttatagcgaaaaaaataaaaataaaaggaagacaagaaaaaaaattaagaagcgagggaggggaaaggaggaaagaagaaaacaccacaaattaagaagctccaaagtttgaggacgcacgcttcgcgggtgacgtacaggtgtaggggaggtaatgcggcggcggcgcgacggccgccggcgagggcgaggctgaggctaccatggattcgatcacagcttgacgacctccgggatgtcgacggggtagcggtggatgcagtcgtcccacggcccgtcggcgggcgtcttgactgtgcggaggcacttccagacggcgctgttgcacttgaatccgctgccgaagccgatctgccagacgcggtcgccgcggcgcatgcgccccttggcctcgatgtaggcgagctcgtaccagagcgagctgctcgacgtgttgccgaaccggtgcagcgtcatgcgggacgcctccacgtgctgcgcggacaggtccaggttcttctgcagctcgtcgatcacggcgcgtcccccggcgtggatgcagaagtgctcgaacgccagcttgaagtccgggatgtacggcttccacttcttgttgatgagcttgcggccgacgaggcggaagaagaagagcagctgctccgacatgggcagcaccagcgggccgatggtggtgatgttcgacttgagcgcgtcgccggcgatggccatcagctccttggacagcgagatccccgagtgcccctgctcgtcctcctcctcgtacacgcaccggtacgcgcggtcgtcggcgcccttgtgcgtgcggaccacgtgcatcagcctgtacttggccctcctcgcctccctcctcctgttcgacagcaggatcgccgccgcgcccatccggaacaggcagttgggcagcatcatgtcccgccgggttccccagtagaagtttggtgtgatgatctccgtcgacaccaccagcgcgttcgagttgggatgcacctgcgcgtgtccgtccatgtcgctcgttaatggctcacctgattagttagttagctaaacagtagtaacatcaaagagctggctagtacttacctggagcatgtcgcgggcgaggtcgagggagatgaggccggcgctgcagcccatgccggacaggttgaagctgcggatgttgctgcggagcttgtacttgttgatgatcatggcggagagcgacggtgtcggggagaagagactgcagttgacgacgaggatgtcgatgtccttgggcttgagtccggtgcggcggacgaggtcgtcgatggcggagaagattacgagctgggcctcggcgcgcgacgcctccatggacgggttaggcgggatgtagtggttggccggcgggaggcaggtctcctccccgagccccgaccgctcgaggatcctggtctggaaccgcacgctcttctcgtcgtcggtgatgaggcgcgtgtgctccatgaacgtggcgaacggcacccggcagctgggcggcggcttgtagcaggagtagtcgacgaggtacaccggccttggccgcgacatgaagtacaccgtgccgacgaacacgacgaggaacaccgagcagaggatgtggacgaggtcgagctgcagcgaccgccacagcgacagcagctcaccgggccccatccgcgccagctccagcgccgtcgccgccatcaccggcaccagcagcagcgtcaggaagtggttcaccagatactggtaccccagcttcacgtacttcagcttcaccgacccggagtaccccgccgcccccggcatgatcgatgctctcactacttccccgcgcgccgccgcgcaccgcaccaacgctcgcacgccgcgtcctacgtacgactttagtttcttcttttttttgagcggtgcagcgtgcacaatttgtaggtgcgatgcggtgcggaggcggatgggtttgcagtggtgtgttggtgatggtgtgtccggtgcccggttggggggtctaatataggggacgcgcgcacggtggcggagacgagacgagatgacgaggagtaattgataaatctggggcggatggggtagtttaaagaggccggtctaccgccaccaaccggaagcgttgggctgctcttattagatttctgcatcatgggggggacacaaggttttctcccttgttttttgtttatacaagtgcaactcgtagtgacggttaacggcttaaccccggtgtcaatttggatatgtcatatgagtatatgattgctaaggagtatcatactcctcctatagctcctggactctggagaggaccatttttcagtgacaaccttgttctgcgggcattatcggaggaaaataatagagttcgtaattaagtggagtaatacacaagcaatgtgcacaggtactgtactgctcgcatctggatccaggtgagtacgttcagagtttagtcatgcatgatacactgaacataattctcttatgttgctagtagctgctgtctgtcccatctaaatttgcatctgatttttgagcaccgaatgatgtaacaagccaataacaataagtagtactattatcagtagttaatcaccaagtgtccaaatcataaccgagttagttcaactgttaagacccttgaggtcttgacccgtcgaaaaaactcttgctactctattcgtcaacacctgatttgagtccaaatcaggtcctctcctatcgccgagtgaacttatctctgaagataggtttcaaaaacttatctctgaagattggtcctgttttcttttttactcacttccttttgagatgtatgcaatggtagatcagatgagagggtaactttccctgcggaagtacggcaatacagataatggctgggactgaattgggctcccttgcatctgcaccgtatagggttgtgtgtttcgcaatggcatcaggttcaggactgcatgtgcaaattactctgttggtaccctctgcttgtacaatttaaagcactgttgttgcaggttgggtacccatcattaaactacgagatgaacactcatgtccaagtcttgcaaattcacatgtaatcttgtaagaactgaacagttttacttcgaaatagtactctttaaatgttgactctgattcgatcggatcgacttcgtcagtgtgcattacaagctctgtttggacaaattctgaccctgttaagcagctctagctggatactacttctatactagtacttttttttttgaaagatcaatagtagatggtactcctattaggctattaccattactctttggatggccacatctaagtgcctgatctggtaatgctatactcctagtatccttgaatcctgataagggtagtacagtacggagtatactcgtatttttgttacgagactccacttcataaattcatatactacagtagtaatagctcagacaagttcaggcagagcagtgatagctgatgacagaatactccctccgttccataaaaacgaatctagaaccggatataacatattttagtatgatgtatatccagattcatagtattaggatgtgtcacatccgatagtaggttggttttttatagaacggaggagggagtagctatataggtgcagacagcttctgagcttgtaagaaagagttaattgcgtatgcagtgatctgcgtagcaatagtgcaactgtacaattggtgaaaatctccctaaaaaatggctaaatatatggcctcctattgtcccggagccaatgacagtgtggtcctttggctgcagccctggcagcagcattaacgtagtagtgagtgtccagtgcgcagtgatccaatcaaaattcgagacaggatcctccgggaagcatcaagcatcttcgcgtacgagtcgtgagacgatctgtccatgcctctgaagaaacggaaaaccacggattgttcttcttcccctcgcgctgatacgagtgaaagtgcagccgaagcagctgtcgtagtggccgcgtgaaatgctgaagttgacgggtctgaatatgtgatcggtctggaggacgaatggacgatgggccgacatgggatggagttgggggttgggagaaagcgtggcgaaacgcgctgtgtttgctcgtcatcgatcgaccagaggaagggcagagactcacattaataaagcttagctgcaaccatacatccgccgcaggtgtgcaagggcaatcctgttcggttcacgtctctcttgcccttgtttcgcacgagcgaattccgtctcttcgttttggacctgtccctcatgtactacgacgaacggcacttaggggatcgacatcttcgtgggacaggattgtaaacttacaagtattattctacctgttcccttcatactacacattaaatgtgatcatctgcttatttaaaattgatcatgacctgtccatcgcgccaaactgccaatctgtattaggtttgacagaggccattacctgcaaagaaaaacgcttgcctaagttaatgctctaactgtacgtgagtacatcctgcctagcgagtggttctgattgctgggtcctttactcctgaaaagtcagtttaactataatcagttgcagagataatcttttttattttcataaacaagtattttctctgtttatgtttttatcaataaaatcgaacctctcagactcaattctttgaagctcggaggaaactacggatcggacgtccgattcctctaaaaaatcggagggtcaaatattgtagttgaccaacaagtgaaacattaagttatgtatggtgaaataaaaaaaatcagcaactgaaatatttaaaaattttatgaaacatggtgatgatacttgttgaaacatgttactattatgtattaaacaacgagtgttaacggattgaaacatatgtttttctttcgtcaaaatatagtcatgcgatatcttgttataaagatttaattacaacgaatacaactgtgtgatcggatcgtagattggataagtagtttaagaaaaaatttattttgaagattattaaaatgcatatatgcatggatagaagggagagagagaggagagagagagagtagtggcaggtggtttcgtgaattttatgaaacacattgaatatatacattgaaacatatcaatatcacgtatgaaacattcagctttaacggtttgaaacacatgattttattttattagaatataattatatgatatcttcatgtaaagatttaattacaactaataaaatagtatgatcggatcgtagattggataagtagtttaggagaaaaacaatatttaaaaagagaaaaaaaagaaaaagaaactagcttgtagcgagaatgctcgccccgggtgaccggcggggggtggagcagatcgggcgctccccattttcgatgtacttagtgaaacaattccgatatacttggtggaacatcgtgcaatatttaaaaataattcaataataagctaaaaaaattttgtccgaatatatccatgtgtggccttgttttgaagatttaattgcaacgaatttaatggtacaatcagataatgatttggataaataatttaagagaaaaattagtttaaagcgggtttgcacgcatgcgtggcactgacgtcgtgctgacatcagcgcctgatttttgcacgcattgatcgggatcgacgcccgatcggtagttccctccagtttacagtatacttgcatgcatgaatcgggcaccctattgtgagcattctcctcgaaggttacgtctcaaacatttctatttcactacatgatatttttatgttaggatgtatgtcgcatatcgaattttgagcagtgtctttaattaatatgtaaacttattgagacggcagccgtgtcaagtacgatacatacccttctaataggtcctacaagagctcaaaaacattacaagcttttagtgtccatgtttgacttatgggtaaaatgcccatacttatttgaatatacaaatgttattgtatgttattaatttgatggattcaaacaaatatatattagacttagactattgcataatatcaatgactaatttgtaaatcttgtaaaagtattgatgatggactaacagcagaaccaccaccaccaccactatcgttttttttcagtagtatagattgatgctcaaagcatctatacacttcgagtgccatcacaaagcccatatttgtttgcacttttagcacattatacatacgtacagcgtttctctaaaaaaaattccacgttttgctatcgatggacgatctgttctccaaaatatcatcaacatgaatcctacaaaataccatgttacaagcatttttcatttt

SEQ ID NO: 56159 - DNA, 1519 bp, Oryza sativa
catatcataggagtttagcataatataaatgaaacatatgctaattaaagtaaaaacgatctataaatatagatgtaactagtttattattacagtacgattgtgattcataaatgtaaaaacaccgaatggctgcttatttgaccgatggctggcaaccatatcacaccatcagagagttgattttcggctggtacttgcatgttgcctcatgtttgctattcagacggtgggcgagtcacatttctcatcactaggatgagaatttatcatcactatgacgagaaatgatcaacttaggagcctccacctccctcttgacatctttacggtctgtatctatctcctacgaaaaaaaaacaagtggaaaatgttaagagcaggagtgacaaatccagaactggagctgaacgtgaaccaaaaatatattaaaataaattacctgtgaatcattgggcttcgtttcatcgtctattaacatctgcgccttttggagatatgcattctcctcttgaagaccatactcattgactagggccgtccaagtatcttcaaaatcacttgctgtgcgtgcatgatataagttgtgtagttctgacttcgtaccaaataatatgtgccaacggcagcgtgggtgatcatacttctgcagcgactgatcgatcttatcgctccgggcaccagtgttcatcttgtccatagctactggcaatataggtataaattccagaatactaagaagaggtcaacatatatgagaagtacatatacgtacagataagttggagccatacctggaacagaaatgtgttgttggtgagaaccagagagagcaccagaagtgagcagagtcgtattgttctgctctttatatgttgcaattgtgtctccgttggaaggaatgaaaaaattaatatcattaccaagtataaagatcttatttatggtaatatttatagctattacgaccgataggttacataatataatttgttaccgtcaacatggatcgatccagtcagaattgggtatcaattgattaatttagtaaccaactagtgatttcggtactaattggccatagtcaacgggatagagagagagtgaaaaaatgcacgtctgaataccacaagattaatgacataatctgtacttttataggtgtacatgtacacataggtttatgagtgacagagcgaacacgtatacatgtatatcccacaagatgaatgacataattatgaaatagaaaacatatccgaatttaattaaaaacttgtccaagtgcaacacgcaagatatgggaatatttttacaagattgtatttaaaaacaacgatagacttgcttctatacaccaacaccacacgttgatgcatagtgaccagctaacttgcatttcgtgcacaccttgatcaatttgttcttcgatgtgttctccggatttgtggggcatccagttctatagtgcccgttcagatgacagttcgaacaaatgcgcttttttcggactccacca

SEQ ID NO: 56160 - DNA, 2860 bp, Oryza sativa
tttgaattaatgattcctggggcaaagatcaattaaggaggtgggtaaactcttaagggagctaaccaactcaataatcgtacgtatttatatgcataataatcaatggcaggacccgtccgtcggtccgtgtttatgctaacagagactttacggattaatttttcatggtaattgaactaatcctatacaaaccttatataattcttagtatgttccaatgaagcccttgccggtttagctaggaacgacttaaaggtgcatattgttctgcacgctccaatttgtgatccatgagtcatactctcttctttcttattattggacacagctaactaatataaatttatctataaaaacattaaatcatgatgttttggtgagcacacatagaatagcatctaacgtactattgataatacgacatcttttcaaatatctatatcttttgaaaagacactatatatcaaagattttataaataaagtagtacctattggcaaataaaaagaaactgagggagagtaagtaaaaaatgtcgcagtacaattatgttgtacctaacaataaggctactgctacagtagcatggcactattccgtgcattagatgaatcacagcacgactacaggcacatataacttttcctctaaaaacatgagcgtttcagtgtagcacctgtggttttctgcgctggatgatcgccaaacctagtgatttcccctgaaggcctgaagctctaagacctcgttaatttaggaggtctaaaataggatgggattttagccatttcctcggctcatcccattgctcaaatttagctatcaatgttttgagaataatctacattgaataagctggattattataataagttgatacagaataagttgtgagttatttgtttctctggattattgaaggcatctaagggtagtgggtctttagccactcaataatctagaaaaagctccttcagatgagattattagattatactaatctggttcatagattataataatctattataataatctatcataataatctacttatttgttttagcttgctcattataatccaaattataataatcctaaactgaatgaaacagtacctaaccatccctacatgcttatgactggttggacggaaaatactcccagccctcaccaactgaccctgatccctgagggtgtgtttggataatgagaaatgaggggtgggattggtattgggaaataaataaagggttagtattaaatggatgagggagaatgaatggttaagatttaaagaggggtgggaaatcatttcccttagatatttgccaaacactgcttcatggcttaagccgaatggcattgatgagccaaaagggattgcaccttttaaatagtatgtgcactttcttaacttctatttttctcactttttgcacgcacgttattaagctattaaacaatgtgtgtttctaacatttttatagaaaagttgcttaaaaaaatatataatctattttttctaatgcttaattaatcatataatacatcactctgttttgcatgtcatgaaaatgtctcaactttctcaaacgaacacagcgctaggcgggaataagattagaagatcattcagatggaaacagatattccatccatgatctgcaaacagtaagggctgtgtttagatttaggggtgtaaagttttggcgtgtcacatggaatatacggataaacatttgaagtattaaatgtagtctaataacaatcggtcagtaaaccacaagatgaatttattaagccatattaatccgtcattagcaaatgttcactgtagcatcacattgtcaaatcatgacgtaattaggtttaaaagatttgtctcacaatttacacacaatctgtgtaattagttatttttttgtctaatttaatactctattcatgtgtccaaacattcggggcctgtttagttactaaaaagtttttccaaaaaatcacatcgaatctttggacacatgcatggagcattaaatatagatttttaaaaaaactaattgcacagttgggaggaaaatcgcgagacgaatcttttgagcctaattaggccatgattagccataagtgtgacagtgacacaaatgtgctaatgagggattaattaggctcaacagattcgtctcgcggttatgaaattagttttttttatccttgtccgaaaactccttccgacatccggcaaacgtccgatatgacacccaaaaaattttattttcgaactaaacaagcccaaaattttgctagggggtctaaagagggcctacataaaaacatagcaggccggccgtctactgtttcatgaaaaaaaaactgggaacagaacaatgataagttaacatatgaaccttgattttgattgatctctatttcatttgcatcaactaatctttggaacacaaaattacgccaaaacaattgcatcaaatatgaccgtcgtcgtggtgcgtacgaaaatcacacactgttttgatttgatgaaccatttcctcggaattgaatagcacatttccgtttgggacaatatttatccagctgctagatttcccaatttcctttcttttttttatctatgaacgagcgccacgtgtcagccgccggagcagcaggcggcgcaccggacgaggccgttctcgttgcacgccgtgcagacgcggaagccgccggtcttctcgctgtaccgccggtggctgccgtcgcacgtgccgcagggcacgaaccgcgtcccgccgcacgacgcgcacggggtggccgtcgcccgcgccgcgccggccaccacgcggtggagctccccgct

SEQ ID NO: 56161 - DNA, 9554 bp, Oryza sativa
taggcggcgtccatggacacgtccgctcgtcgacggcgacgcggagcccccgcaggatggcgcgcacgtcgcggcagtcctcgaacgtgcctcgcacggcgcggagggaggtgaagtagagcaccacgcgccgctcgcccgccaccgccgcggcggccgcctccgccgcgacggcgaacgacttgcacgcccggagcttggtcgacgacctcacgcggtgcaggacgttccgggagcccggcccggggggcgcgggcgccgcgtcgtcgtcgtcgaggacggagccgatgccctggtggtcggccttaccgccgccgccgccgccgccgccgccgctgctgggcggcgacgccacgcacgagggggagaaggacggggactgcgtgagccggccggtggcccggccgcggcggacccacggcgaccacatcgcgccggcggcgagcgatcgacggtgactcggtgagggaggagtggatcggaggaggggagaggagaggagtccgcggtgcgcgcgcgcgcgcgatggatttggcgcgaaattagttggtcgccctgccccctctggcttgctaattttaaccatgcgttttaactgtctccgctgcttatttgtggcgctggatttgcatcgggttagtttcctttgatctcttctcctggtgctgacttttttttggggccaactcatagagcgtgaggatgacaagtgggcccatggatgtgatcgacagaatttttatgtggacactttttttttcgcaagatactatcttgcaaccattaaggcaacaaggccttgttcggttacgcccggatttaatccggactgggaataacaagtataataagaaatttacatagatacaataagagaccgggatttatttcggaccgggaaccaatttactcatgatatagacaataagaaaccgggaatcaatccactagtcaagaggtgtggaactaacccagatgttttgttgtccctatgatgagtaaattagtttccggcccggaatcaatcccggtctctcattgcatctatcacaaatttgttactatacttctcattcctggccgggattgaatccagatgtaaccgaagaaggcctaagggtgtttagatccaggggtgtaaagttttggcgtgtcacatcaggtattatatagtgttgcactcgcatggggtgttcgggcactaataaaaagctaattacagaatcgtccgtaaaccgtgagacaaatttattaagtctaattaatccatcattagcaaatgtttactgtagcatcacattgccaaatcatggagcaattatgcttaaaaaatttgtctcgcaaattaatcgcaatatgtacaattagttatttttagcctatatttagtacttcatacagatgtttgaacgtttgatctgacagggcgaaaaattttagggtgggatttaaacaggcctaattctcgttcatgtatatgttcataacggataaaattagaatattatcaaagcattttgcagtgcaaatctatagaagtgtatttggcgtgaaaaactattttgcttactcttagaagcaaaatggctcttccatagtagataggagtgcctttttcaaaaaaatagtagagaggagtacacttctttaaattttggaacaaaaatatgtttctatatttttttaaaagaatatttttttaaaagaatatccataatggaactaagtcgtggagaaacttaaatcgtgaagaccagcaaaacgtgtaggcccagctaaaaattctcttctcttcggcccagtaggcgcaactaatgtactgagaagcttccgtagcttggaccaaaagcccataaaagtgttaggcctgaatcgttatcgcggcttaagccacagtgggccgccttgccgaattatagtgggaccggattaagccacacgatatcgtagcgcgcggccttcttcaaatcggagtcggactccgcatcgcctctgcccagcccagcccagctgacgataaatagccacgtcacccgcactccattccctccctttctctcccgcccaattcaatcaccaccatggctttttcctctactccccaccttcgtcactcttgcttctgcttccgccgctgtcatcttcgatgtttctctcaccgcagctccccgctgctccatgccgctctcccgtcctcaccatcgtcgttccagctggcctggctgatcgtgaggtgggctctgccgacgccggggtggtgcaagctgaacttcgacggctccgtgttccacgacgggtctcggcgagcgagcatcggtggcatcatccgtggcttcgactgcggcggtgcctcgccttcaccgagaccacggagcactggacggttggtgtggtggagggccgtgcgatgatccggggcctgagactcgcactggcgtgcttcgtcgagcggatcgtcgtcgagggcgatgacctggttctacgcagatgaggatccttttaatttccttcctcccttaaagctgaatctcaccatttgagaagctatggaatcgtcgacccccttaccaagtagactatgaagtcactttcattttttggttgtgtatgctatgtgtttgtgccccgtcatctaccaagtacttcctccgtattttaatgtataacgccgttgactttttgacaaacgtttgacctttcgttttattcaaaaaatttatgtaattataatttattttattgtgacttgatttatcatcaaatgttctttaagcatgacataagtatttttatatttgcatagaatttttgaataagacgagtggtcaaacgttggtttaaaaatcaacggcgtcatacattaaaatatggagggagtaaattcgacaacaaagctatccgatgtatatttgtggccgccatgcacgaggagatcctctccttcctccgccgtttcaccgcgttccaggtgagacacatgtggagattatggataccccatatctacacggcatgtatagtccgactgggtatggggtgccatgtatagatagaatatctttaagatgactcgggttaaattccaaacttgtatgtcaaggaaatacctgagatcctagtcggttatggttgtattttatctgtaattacatattccgttaggatatggactgcattttgtaatacggactccttcccctatataaggaggggtccgggtgcctctaggggcacgattttcacccagatcatacgatcaataatacactcggcggatcaatccccggacaggagtagggtattacttcttgattaagaaggcctgaacctgtataaaattccttgtctctaaacccatccacttttccatcttgatagccacccccttttagtattgccgaaatcttgtttcgaaaattggcacgccaggtaggggctgcgtcaagttcttcgccaaccagtgcgatgggtttcatttccggcatcgacgacttcgtcttccctcccgggcaggcgttctgattcggcagcctcgacttcatcaccaacgacttcggcaagatttctctcctcgactcggattcaaaccagtcgggaagagatcagatctccgccccgttcggtatcccgaactcggccgaggtctaccccaagatcatatccaccgagttggcttcaaacctctcggacaaggttcaatctacttcaacacgacccgatcaagatgatggggcctatccgccgatcttgatgaaactccccgacgatttggctgctgtcttcaccacaagggcgtcttctccccataggcctaggcgggatccggcttcagccccggcccggcctagctccatggaagtcggcgtcatactccagcctctcggcacggtttcgacggaacaactggacggctacctcagctcccccggcgtcgacttgcaaccaaccgagatcgtggagtacgatgacttcggctaccgctacgactaccgcaacctcgacgacttcaatgaaggctttgaagacaactacacgcctctctacttcggcattttcatggctgacaacgagacagaagaacagcgtaaagcccgagaagcagaagaactacgtgtacaacaggaagccgaacgacgccgactggaagagaaacgccaagcacaagagcgagaacggctgcagcgtgagcaacaggaacgtgaacgggctgcaaaggaggctcaggaccggcgacgacgggccttggatgccgggcgatgagcacaagaacttattgggaagcaagacgtcgagggaactgcggttttttgcgcctctcaacaggacgcggttgcagcgatcaccctcctcgacaccctcctcaaggaagacacgctcaatcaagccaatcacgtcgtcaacatcttgaaccagaccaagaccatgatcgccgcctcggtcccgattaactctgcaagcgtccgcacgccgactggcagccgagttcctcatcttcgatcccaagactaccaccaaccaagccttagcgtcgcaggtgcgggatctagtcgcaggagcaagggtcacgacgagcgatctgtccactcaccccccgagcgacacagggagcgtcgagttgaacgaccacgctccccaccttgcaggcgccccgtcgatcttcgcgatactatcaaccagcgccacgcgacaagaggctacgctccccaccattcaccagatcgctacgatgacgacgtggatggagtcgctgccttcacaagcgacctgcgtcgagtggattggccagccggcttcaagccgactggaatcgagaagtatgaaggcaccactaacccggagtcttggctcaccgcctacggtcttgcaatccgcgcagcgggaggagacagcaaagccatggcgaattatttgcctgtggccctagcggattctgcccagtcctggcttcacgggttaccccgtggcacaatcggatcatgggcggaacttcgtgaccacttcatcgccaacttccagggtacctttgaacgccctggtacacagtttgatctctacaacatcattcagaagtctggagaatcccttcgagattacatccgacgcttttccgagcaacgcaacaagatctctgacatcactgacaatgtcatcatcgccgccttcaccaagggcattcgccacgaagacctagtcggcaagttcgggcgcaagcctcccaagacagttaagcagatgttcgaaaaagccaacgagtatgccaaagccgaagatgccattaccacatccaagcagtcaggcaccacttggaagccgaagaaagatacgccgactataggggggagtggaagtaccaatcacaaggatcgcaagcgtaagcccaaggaacttgtggcaaatactacaccatcctcccgacaacgttcgcgcatcaacacttttgacaagatcatgaactcccaatgtccgcatcatcccaattccaatcacgcggccaaagattgctttgtctacaaacagtttgtagaacaatacgccaagaacgcacgcaaaacctctgacggagatcaaagcacgtcaaagaaaaaggatgatgaagatgataccccgactggttttcaagaccattgcaaggaactcaaccacatctttggcgaacccctggcttatgaatccaagagaaagcaaaagctaaccgaacgggagatcaacgctgttcagcccgacacgccccaataacttcggtggtcagagacaacaatttagtttgaccgctcggatcatctagaccgagtggtccacccggggcggtatcccttagtactcggcttcgaagatccctcattgatggtggcagtgcactcaacatccttttcgccaagactctggacgacatgcagatccctcgcacggaattaaagccgagtaattcaccctttcatggagtcatcccggggctatctgctacaccactcggccagatcactcttccggtcacttttggcactggggagaacttccgcacagaaaacgtttgcttcgaagttgctgatttcgagacagtgtatcatgccatactcggacgcccggcattggccaagttcatggccgttccgcactatacctacatgatgatgaagatgcctggccctcgaggagtcatatccctgtggagtgacatcaagcaagccgtcacatgcgacaaggaaagctgcgagatggcccagatccgcgagagcacgctcgcccgagaagaaatccgactggctgcgtccacggcaagcgaaggagaagtgcctgcaaccaagataccaaagagcggagaaagcgacgccaagaccaagaaaattcctctagatcccttgatcctactaagactgctgtaataggcgctgagttagattgtaaataggaaagcgcgctcatcacctttcttcaaaataataaagatatctttgcatggaaaccatctgatatgcctggtattcctagagaggtgattgagcactctttacatgttaaggaagacgctaaaccaatcaagcaacgactccgccgtttcgcataggataggaaggatgcgatcaaggaggaattgaccaagctgttagcagcaggcttcatcaaggaagtccttcatcccgactgactggccaacccagtcctggttcggaagaagatggggcagtggcgcatgtgtgttgattacactgacctcaacaagtcttgccccaaagatccctttgggttaccttgcattgaccaggtagttgattcaacggccggctgcgagctactcagttttttggattgctactcaagatatcatcagacccgactaaaggaatccgactgcttaaagacttcattcatcacgcccttcggggcctactactacatcaccatgccttttggattaaagaacgcaggagaaacttatcaacgcatgattcagagatgtttttcaactcagattggccgtaacgtcgaagcttatgtggatgatgtggtcgtcaagaccaagcagaaggatgatttgattacggatctagaagagacctttgcgagcatccgtgctttcaagatgaaactaaaccctgaaaaatgcatcttcggagtaccgtcagggaagctgcttggatttatggtgtcccatagaggcatacaagccaacccggagaaaattagtgccatcctcaacatgaaaccgccgagctcccagaaagatgttcaaaagttaaccggctgcatggcggcgctcagtcggttcgtttcacgactcggcgagcgggggatgccttttttcaagttgttgatgaaaactgacaatttccagtggggacccgaagcacaaaaagcctttgaagacttcaaaaaacttctcactactccactactcttagcttcaccacatccgcaagagccactgctgttatacgtgtcggcagcttcccatgttgtaagcacagtcctggctgtttagcgagaagaagaaggctatgttcaaaaagtccaatgaccaatttatttcgttagcgaggttttggctgactccaagacaagatacccttaggttcaaaagctattatatggtgttttaattaccgtcaggaaactatctcactacttccaaggtcactcgatcacggtggtcacatcgtttccactcggggatatacttcataatcgcgaagcgaacgggcggatcgcaaagtgggccttagagttgatatctttggatatatccttcaagccgcgaacttcgatcaagtcccaagctttagccgacttcgtcaccgagtggatcgagtgctaagaagacacgcctgcagagaagatggagtattggactatgcattttgacgggtcaaaaaggctttcaggcactggagcaggagttgttctaatctccccgactggagagaggctgagctacgtattgtggatacacttttctgtttcccacaacgtggcagaatacgaggcgcttcttcacggactaaggattgcaatctctttggggattcagcatttaatagttcgtggagattctcagttggttgttaatcaagttatgaaagagtggtcttgccttgatgataacatgaccacttaccgacaggaggtatgcaagttggaagacaaattcgatggacttgagctcacccatgttcttcgacacaacaatgaggcagccgacaaattggctaattttggttcaaaatgagaagcagccccttttgatgtgtttgttgaacatctctacgacccaaccgtaccacggagggaaacaatcgaggccacgaacactcaagacgtaagcatgattgaagccgactggagagagcccctcataagatttttgacaaaacaagaacttcctcaagataaagatgaagccgagcggatttccaggcacagcagactttatgttattcatgagactgagctgtagaagagaaacccatcgggaatcctgcaacgctgtgtttctttggaggagggaagacaattgctaaaggatatacattcaggcatatgtggtaatcacgctgctacacgaaccatcgttagcaaggcttatcggcagggttttttctggcccacagctgtgtccgacgttgacaaaattgtgcgaatatgtgagggttgtcaattttttgcccgacagacttatctaccggctcaggagcagcaaaccatcccgttatttggccgttcgcggtttgggggctcgacatggttggcctgtttaaaaaggctatcggtggttatacacatctctttgtagctgttgacaaattttccaagtggattgaagccaaaccggtcatcacaatcacggcagacaaggctagagatttcttcatcaatattgtgcatcggtttggggtacccaggaggatcattactgataacggcactcaattcacctgcggagtatttaaagatttttgtgaggacttcggcatcaaaatttgctatgcctccgtagcgcaccccatgagcaattgacaagtcgaacgtgccaatggtatggtacttcaaggaataaaagcgcgagatttcgaccgactgcaaccctatgccggcaagtgggtagaacagctatcatctgtactttggtccctgcacaccactcccagtcgggctacgggccagtcgccgtttttcctggtctatggagcagaagcaatgctgccaagtgaggtggaatttgaatctttacgatttcataacttcagcgaggagcgctacggagaagaccgagtagatgaccttaaccgactagaagaagcccgtgaagcagccttaatacagtcggctcagtatttgcaagggatgtgccgttatcacaattgcaatgtttgatcacaagcttttttagtcggtgacctggttctgagaaaaatccagactacacgggatcggcacaagttatctcccttgtgggaaggaccgttcataatttccaaagtcactcggccaggttcttaccgactcaagcgagaagacggtactcatatcgacaactcttggaatattgaacatctttg

SEQ ID NO: 56162 - DNA, 8397 bp, Oryza sativa
aatgccaagctcgctcccatacttccagcttccttgatattcttaaaatatgtatccgcagcaattctcagcttgtcgaagatttcggaagcatcaaatgcactcggaccattgttattgaagaacatggcttggacaagtggtgtagtggcattggcgacttcatctctggctccttcaagcttcttgattttgttaactaagacgtcgaattgagcttgggatttgatcttgcagtctacacaaataaatctatatcaatgactaggcatgaagatgagagtggtgttttgaagtattagttaccagtaccttcgacgtctttcagagccgagtcactttgttttgccaattcgatcttgtctttctccagagcttggatccgtttttccagttccgatatcttggcggcttgcactgtatcgcttcttgttggttgatatcacaaggatagcagcataaataagtgagacagggatgagaattatcttttgactaaccactcagctcaaagttggaatcttgaagctcggtgattcggtctcttagatcatgttcagtcttcctggcgagctctttagtttcatgcagctggtttcgggtggcctcaagggttccaagatggggaactagtctctcaagagtcgtagtcttcgcctcgttcctgagatggattctctgcaaagcaaatttatccgtatttgagcaaagtggctgacaggatggttgaagctgtgtacaggaagacttacatttacaagacgagtggcttggccgagtgcctttttcagtaggcatacttcctcgtcttccttttgcttatttatcacaattccctgtggttgcatgtcatcatcccaccacttgactaaaatgggtgggcgagaatcttcagctgactgtatctggaggatctcttcttcgtcgccaatcatcgggccttaggcattcatgaataatggtgaaacaattgaagaaagtctgttggatcaaagcagatttgaagggtttgcttacctgttatgatttccggtcggggacgaggaggtctttgtaccctaacaggagaactaattccaggatcaacaccggtgtctgtcttgggagggctgttagcttgagcttctacttctgggatatctttatctggctctgtacccgactggtttccagtcgggggctcctgattagcgccagttctagcttcggccgactggttcccagtcgggggcttgttgctgggttctacattgtcggtggccggttgattatcactcgggtgatcttctgcagtcagcccggtttcttttgacgggcctgtctccatgtcagtcggctcggagtcttttccagaaggatatatgtcagatggcttcctacaaatttgagttatgctatcaatactatttcaatagtgggtaagcagcaatacaaggaagatggccaaatgatttgtacctggaagattttctgattttcgacatgggacgactggatgttttcttcttcagattagtttgccttggttgttttccggtcgcttctttgtcgccagttttttcagcatcatcgccctcatcatcactcaggaccaatttcctcttgcgagagtctggctggctagtttcctcgaggtgtttggttgagtatcagaccgaatttttggtcccccactcgcctgaccagtctgccggctgggtgatcggcgttgagcgatcggaagatccgacttcaacaaggcgaattcctgagcatgatatttcgaactttcaattagcttaacagaaggcaaaagcgtgtttttgagaaaggctgaaatgtttgaatacataccggtggaggaggattgaaggcgttgtatggcaccactagtagcaagtgcgaataactgactgcggtagcgtttgagaagattttgtacattctctccttcatgactttaaagtcaagagagtctggatcttcatggttcgggtcatgcttgccgttaaattcaaaggctgtacgggatctctctttaattggagctagccggctgttgataaaatgccgggtgatctgttctccctgcagaccttgctcctttagcttcagcatacggtccatcagggcaagtgcctgagcagcttcctctcccattggaagtgagttccaagtgtcctgataaaccggaggaagacacgagtactcggggagtgcaggctcggggttttgtacatagaaccaatttgcatgccagcctttgtttgaggttttgaagggcatggagaaatatttttggcttagtgttcctctcagttgaaatccagctcccccaactatgcatggcttgctcttgttcggttggggtttgaggaagaagatatggcggaatagggcgaaatgaggcctgatgcccaaaaatgcttcgcaggcatgtatgaagttggcaatatggactatggaattcgggtttaggtgatgcaagctaatcccatagaaatccaaaattccccggaagaatcttgaggttggaagagagaacctgccatagaagaaatgagaaaataccacgacctcgtgtgtgtcaggggttgggaatgcttcgccgcatgctggacgccacccaatgatctcctttaccagaagaacaccatgcaccaccatctccttcaggttctcctctgttacatcggagggcgcccactgactctcaaagctctctctctctctcttccgccatggatgcgatctggataatatgatttggttcggtgaatggctgggaatggatgggggattgatgcggtggatgcgcaaatgatttctatggagttttggaagatggatttgggagaattggagaaccctagttccgttggagtggtttcgtactgtagcggagaatggggaaaaatgacgaaagtctcggcggggaagacgaagcggcagttggttttctgctgttattagggtatcaggagtgctaatgggcctgggcctgtacagtacttcaggccaattttattatcagcgtggctagttgtgatccttagggacttgggcatttttgcttcggcaatttttgctcacaacagtatggcccaatgctgttaaaatcctttttgacgcagttagataattccttggaattactacgatgcaaataaaaaggtacccgacagaaaggtgttatactacttttgtaagcctttttaggttgcgaaggctgtttgggttttgttgagatgattggtttttgaacagtcattctctcggcatgatatatgcttattttgattatggcgtgagtcatagcctaggctatttagactcatcaattatcatgatatcatatttataccatatttgatagatcttttgagagtttttacttagattcttgccatatgtgttggtttatggacctttagagtattttttactcgggcctctttatatcttcatttttggtatattaaagctaaagcagtcggctggatgttttattaaacgtcgcatatgcttagctgtgtggtactttgggtaattcggttgtaaaaccactcggatggatattatttgcacttcgactatatgtttagcctttagctacttacatagtcgggggttacacctaattaggtgcatctattcgatgcacccgattatttatttttagcccttcacaatctttgattttggtactcgggagatcaatgcagaagaaattgaagcactcggattatcattttgtgctacgagaaaaggctattttgtcgactgtaaatgtctcgggtgctactgtggagattatggataacctatatctacacggcatgtatagtccgactgtttatggggtgccatgtatagatagaatatctttaagaggactcgggtaaattccaaacttgtatgtcaaggaaatacctaagatcctagtcggttacgattgtattttatctgtaattacatattccgttaggatatggactgtattttgtaatacggattccttccctatataaggaggggtccggttgcctctaggggcacgattttcacccagatcatacgatcaataatacactcggcggatcaatccccggacatgagtagggtattacttcttgattaagaaggcctgaacctgtataaaatttcttgtctctgaacccatccacttttccagcttaatagccaccctttagtattgtcgaaatataccgagagggaaactgcgccggcatgtggtcggagagaggagggatgccggccgccgtctgggagaaggtggatgacgatcggcccggggtggtacacgagcgcccccgcaagaacaagtgaagcgcaccaagaaacaagaagcagccggcatgcgagccgagccgtagtctctgatcaaaagttcaagacttctcccaatttgtgattattgtagttgtacttgtacgattagtgtagctaaatactattcattgtagaaatagatcgatgattcataacactaatgatgtatttattcactgattttgaaataaaacaataaacttttatatatgcgtgctctgtttcttctcgtgtgttgtgatttgtgctgcgtgtgattgcggtcgtcttcgatgcggcggtgtggggattggcggcggaggtggattaatttgcggcgagcaaagattccacggcgatcgtcctctcctctgtttcttggaacgcttctctctgcccaaccggaaacccgagctcatgctctcgccgccggccaactctccatcaagaagaagcactctgctcctcactgcccaagcaccacgcatctagggaagcgctgatgccagggggatgcgttcctcatctccatcgagcgccgggcccccgcgtgcgacgccgccgagctctcttccttccctggtggtgggggcctcgagcttcatctccgcccttgcgtacccgtcgcccgctccctcatcgctcgagctccacctccgcccacatgccggatttctggagaaagaaatctgcttcagttttcgtgcacgggagatgtttgctgtattgcctaagtgagttcctgtggccttgtgtttttatatcctcctattaatgaagctcctgactgttccctcaaaaaaaataataataagtgagttcctgtggttgttcatccatttgggccctatgggttcaaattatgttactatgttgtgaaaccaagtgtgtttttggtttatttgtgatggaaaattggcaatgaaatgtgtaaccatgagttggttttgagcgagaaatttggtttggaatgctggcgattgtcaacgtgagtacatgcgactaatgcggtcaggttgcgatgtctatactcagaatcggatgtttggtttcatgtgtgtaggtaatcgaagtcaactttgatcaatggcgaggatcgggactatgctcaggaaggagcagaggtcttgcacggtccagaagctgtgacaaggtgggactgacgtcatgatttctgattgtcaacctgggtcgacggcagatcaggactaaactcagtgaggagttgagatccagaacgataaggaagtcgtgtgacaaggttgagatcaaggtgacacacggtggacaaacaccgtgtcgggaggttatcgcaacgggcttcgcaaaatcaactgcaagcgttgaaattcgcaaagaaattggaattaagacgtattttgtgtgcagcgtataatacatggcgtatggtcgatgtgtacgccatgtattcgcaaagaaaattggcaactaagcgtataatgtgctgcatgtatgtgtgtcaaggacaacgaacacatgcatggctcattggtgcagccaagactagggccggccacgaggcaatgcggacggtgtgatcgtaatgggtctctaaaaattagatgcctttaaaatatacatattatgatatcaggcctgagaggcttagaggaaagacagaagaccaatcggtgatcgagcatatcgtgactgcttgattgtattttaaacttattagtgtgaaattcattaatgataataagattttaaatattatcttgtatttttatggtgaatgggggcctttatttttttttgagcaatgctgcacgtactaaatttttcttactaaacttttactaacaatcatttcaaccgtttgatttaagtagatggaagttacaaaaaatctagatgcacttatagcatgacacattagtgttagtaagaatttaataagaaaaagttagtacatatagccttttcctttttttttcttttctataccgggccacagaaagtcaggccggccctgcccaagacatgtatgctctaagtacatgtgtgtacattagcttgagcagtgcatgcatgcacgaggagacatgcatgtgtgctgtgatcaaggttatcattatcccgattcgtatcctagtatcttacgatactacgatcctactaagccgaaacggtaccgatcccatctagtatcctaatttttatagtatatcgatcctactattcattactacacgatcctacgaaatcttaggtgatatcccgattctacgatccctatgatgctacaaaatattatttaaaataacatggtttgaaaataatgttactaaatatgctcaaatttatatgaaaatcagttaaatatataaaaaccaaagtggtttctcttgataaatatctctgtttgcatgacatatatcattactgtatttttttatatggaatggctatatataataaatataaatattaattaaacttaaaaaagaaaatcttgtagtatcccgatactctgatacgatcctacgatacgatattactttgagcaaaacgataccacctagtatcccgatccccgatcttgataaccttggctgtgattggttggcagaggccaagccaaccatccatctgtgatcatgggctaggccaggatgccacatggctgtaccggattggcccagtccaagatggagcaggccgtcatggtccaagtgacggcggcccggctccgtctccgcgtgcgtgggaaagcaacggagacacgtaggatccgtacggtgcgggacccacaggcgacgtggtgcgcatcgactgggagacagacgcgtggcgacgcggcttcgatacggaggagaggcgcgcgcgtggagcggcggcttcactcgctgtcaagcgggccggccggagcacgggcgcccctggcgacgtggcgacgccgggttcgcgccgtatgatgcgggacccacggcgcggagagtgtcaggcaagtgctacggtggacgtgactatcacttctaaatttatttatttggcaaaattttatacagaaaattcaaaaatatgcaattagctatgggacaccgtaaaaacgcgtatttgctgtaggacatcataaaaaactggttattagctcctggacatccgctgcattattttattatttttagaggaatatgagagagaaacggctgtgtaagtacggttctacccttcgaattaatttttctttattcttccttattcttctctctctcattctttctctctttctctctcagctatttcttcaagtgagcctgagggagagggagagcgctggtgatggcgtgggccggtgtagcgcctcggctggggcggcgctgcgcggtcatgcgggaggtggtgcctgagctagagggcaggttgtgccggcgcagttgggcggcatcggcgcgcaggcaagggcggccgggctcggcggcgcgaccacgccaggagcgcggctgctccaggccaacttcaggaggctggaccggatggcaccggcgccggcgcggcaaggctcaagccgtcgctgcgggcgctcttctcatgcgggatcttcagcacctgaacacacccagcactcagcccgacggcgacgcccaacaacaatgtcgtagcagggatgagtgggtctaagggcggatcgagcatgccattgggttggttgtggaggcggcggcaccggcggtggagacggcgtcgtcgctggttgtggaggcggcggcggaggtgacagcggatgcagcagcgggcggcggtggcggcttcgatgatggtcgacgagcccgacagctgcggtgacggaggcagcggcgagcagtgctgggaagcgggcggcggtgatagtttcgatgacgatcagcgagccggcggctgcggctttgacggtgacggttggcgagcggcgctgggaagcggctgccaacaatggggattagatagggctaagggcaattttgtctttttgaaatttctctctcctctttttgataagaaatgataaaatattacctcaggtgtcctatagcaaattacacaaattttatggtgtccatcagcagcgacgtgattttacag

SEQ ID NO: 56163 - DNA, 4468 bp, Oryza sativa
cccatataatgtatcacctttagtacacataccaatacctctaatactttcacacttttcttgaaatttgtatggaggttacctcttgatttaggggtggctcatcatctctctcctcatttctctcctccaccttatcactcaatccaatatggcactcttagaggcaacatatggggcattatagtacttgccctcagaagccgtttagcacagctctaactcccaactccaacttacctagagccggagttgtgccaaacagtatagatccttagattttcagagtggagttagtagagttactcctaaaaattgaagtgggtggagttgggttttactactccacaactctactccaccccaaaagatccactatcctttatttttaacatatttacaacaaaatgccagtgaactaccctacctaacccacctcacccctcaggccctcatcccatactctccctgtttgctagcgatgcgcagcgactagggttggcggcgcgcttcttgcctggcgacgcgcggccggcgacgcacggcggcgcgcggatgtgtcacgcccggaatttctatccaaaattccaaacgcttacatgtgtgtgaaccctcgtccaggaatcaactgaggcacacaataacaaaattgataatagagtacaattattactctaattattaaacgaataaaatatcattacagaggtagatagttcctctcaatcaataaagatctaagcagcgaaaaaataagatacacggcgcagacgactccactccacaggcagcttgaccagggctacacctaatcctccacaccatcagcacactgtagaactcctcctctgatgaatgattgcaaggtgagtatatgacatacttagcaagccacgcagcaaatatgcaagtgcataggataacaaaggatggcatagtagggtttcatttgcataaacaacatttaataaacatttcagaatttaataaaatagttaagtagtaattaaacaatattaatccaacgctatacaacataccctgttggataggcccaaccattctgaacaaccatcccggctgcacagttctatctccaaaccaggaatataccattccaaaccaggagctaatcaaattattaccagttatagcatcttttattatgatgagaaatgtgaaactaatcatgaaagatattgttagacccgcccataaccgcgggcatgactattcgaatagttttactctgtccagagatgtaccactgtacccacaagacacagccccacaacatgtcaccatgcgcctcaataccaccacagtacctcagaaaggagctgtgacagtacccctcgcacaacacaatccaccacagcacaccgttcctggatcataatcacccccttataaacaaggcatggactccccagcgacccccgtgggcttatctccgccacttctcagtctggtgccccgcaatgaaccatgctatacaaaaggtaaagccgttgcccacgctggcttgtggttggcacggttaatgtttcacaaccgaaactcgtgaaccagtccttaattgtcatgtgcacgaccatcaaaaccatgtgctcacaacccaccattatcaagttttagttggcaaattaattaattaaccaatcacgattgaccatcgtgagctatcattaagccatcattaaataatagtgagtcataagtatcccagttatatggactagtgtttctaagcatggctaagcaattatgtctaacatctagttgaaccaatatatataaagctcaactagtcaaattataatatcccaaggtatcaaggaatcaagtaatcaataacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaagtcttcaaattcttctcctgcaaaaacggactctccagaaacgtcggaatctaaacagaaaagagcaaaatcaccaaaacagcacacaaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagagaattactgcgtcagcgggctagggttcgcggtggacagggtgcacggcggcggctcacggaaacgaacggccgagatcgatccatccaaaacgaacgaccgagatccatcggtctacgaccggtctacaacggacggcaacgatgacgtcggcgatgacgtcatcatcggcggcggctcgggcgtgcatgctcgccggcgaacgacggcgcgacaacgcgaacggaggacaccaacacatagagggcgtcgtggcgaactcaccggtgaccaaaacagcggcagacggtgatcggacgacgtcggcgacgaggaagaagcggcggcgaccttcggcttgacgacgacggcgatgctccggcgatcgacagcgatagcagaggggcggacgaggttggcgacggcttggcgaacccgacggcggctttcccgagcgacgacgacgaccgaagcgacggcggcgcacggctggagcgacggcggcgacggcgacgctaggctgcacggggctagggctctacgggcgacgagaggcgaaggcgagggtggcggcgggtagtggcgggcttgggggtcaatttatagcggctaggaggcggcggcgaaggcccacggcgaccgcgatgcgaaggaaagtctagggttcggaggagagagatcgatccgaatcgaactcgaatccacggatttccaaacgaaattagccgacgattccataagagaaaagatagaggggatcccgaagatcatttcccctctactaatttcatcggaaacggaaaggggcggccggatttggaaggagatggcggtggcgcggtgctagggctcgggcggcgggcggccggaggtagacgacgacctgacaggcgggccccacctgtcagcgtccgagggcgcgcgcacgcggcggctccaggcggactgggccggcttgggctggggagagagagagaaggttttgggccgactttcggcccaaagccaaaagagaacttttaaaaccttttccaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaatttagacaacaatttatatattttggatttttagggtgtgacaggacggcggtggcgcctcggggacacgcaggcggcggcggaacggccgacgatggtagggcggcggctcaggacgcgcggcggcggcggtaggactcccggtcggtggcttgccctaaggtacaaatccggtacatctcctctattttcctctatttattttcgattttagttctagactaagaacaaaataggctgattttgcatgtatgttgagggtgattcttctttgtatatgataaggattaacatcgcaacataagccgattgtttcattcataaagggttcattcatctaggggttgatgatcctatttttggatatgaagaatggagatgattgttcattatatgaattgctgccattggtttatgcattcagaatggtatgaatgcttgcaagggaatgcaagcaatgatttgcatatatctgtccaatgcatgttacttctgttggaaaaaaagggaacactttgggtgattttgcatttatatttcatattgtgacaaagtgaatttttttatgcacatacatgagtactgctagcctttgttcagtaaatataaatatttttttatgttagtattgaaaaaagaaaggtgtgattgggtggatggcagggatggctcaaaatgagtcttcaaaaggtgttaagatggcaatggattgtgctgattagaatgaccacaacactagaattgtatgtgagctttttgttgatcaagtagtaagtggtaatcgaccaaattgccatttatcaaatcctaggtacgatgaagtcattgaacaatttgccgcaatagcaagtttgaggtacactaggcttcaaattaagaataaacgggataaacttaaggtcgaatacagctattggaagaaattgagaactcaaacaggactaggatgggacaacacaaggca

SEQ ID NO: 56164 - DNA, 1598 bp, Oryza sativa
gagatttttataaataaaaggatcaaagagtgatgtttgtcaattcattgcgcactcctgtaggacatttttcatggcttaagaagaagtacgaagtgaagtatggaaactagttgcatgtggtgttgccatggaatctatccctttgttttaattgtattttttttcatttcagaaaactatctatggtttgatttcagttatgaactattgttggtttgtatcaccttattgtatggggtgtttccaattgtgaacaattattttcagacctatttcatgtaattgtttgcgtatgttcagacttatgttatgcaattttagacctatgttatgcaatttcatacctttgttatgcaatttcagcaagttttcatgaatatcatgttgcataagttgtaatttatgttgcataactttatgtgtagatgtcaagtgatagtgaagatggttcatcggatgaggaatatgattatgatgagtttaccatgcatttgttcgaaactgtagcatccaatctttcttcgactagaaaagctgtagagagttataacacactctacttggaaaaggctccgccaaggacatcacgcctcagtgggatggaatgggtgcaagaaacgttagccacatgaggtgaatgctataagatgcttcgtatgaatgggaacaccttcattgtattacatggtcttttggttacaagcttgaatctactatacatatgcatacaatggaggcacttgcaatttttctatacatacttggtgatggctcatcaaaccaaagagcacaaagccatttcaagcattatggtgagacaatttctaggaagtttgaagaagtattgcttgctgtggtagaattggggcgtgatatcgtgcgcccaaaagatccaaacttccctactacccatgatagaattaggagggatcatcgcatgtggccacatttcaaagattgtattggagctgttgacggtactcatatccttgcagtagttctagatgaagataaggttaggtatattggtaggtctaaattgaccactcaaaatgttatggctaattgtgatcatgacatgagatttacctatgcatctattggacaacctggatcgatgcatgacaccactgtgttatttaatgcactggaaaccgatatagctatcttcccacatcctccccaaggtaattgccacatattatgtcttgtctatttttctatgaagagattctaaattggaatatttctaatgtttgtatatttctaatttttttaatcgtagggaaatattatcttgtcgatgttggatatcccaatcgtccagggtacttggcaccatacaagggacaaagatatcatgtccctgaattttggagaggttcaacaccaactggtgagaagaaaaattcaacttcttacactcgagtttgcgcactattattgagtgatgctttggtgtatggaagatgaagtggcgagttctcctaaatatgcctagctttccgctaccaaagcaaaagatggttgtggcggcaacaatggcattgcatcatttcatttgtgaccatgatgcaccagatatgcattttcat

SEQ ID NO: 56165 - DNA, 4287 bp, Oryza sativa
tattgaaaaacgagtaccatttgttttgacttttaatcacacggtttgcacatgtgtgtaccatagtgtgttttaccattttttagaattaacaatgtaacaattttaattgggaaaatatgttcagcgttctaattaattagcatgtgattgtcatggtttcagttagatattgcatcattcatttgtttggcttgtcctgcttcttcgtcttcgacggcttcctcaccgtgaagaagtaccatatattctctccgtaacccttgtatttctctacaagtaattattcatgcatgtgttgtgcatgcacttatatcaccatggttaattaattatcatatatgtattcaatggttgatcaattgttttacactgttaataaagtgaaataattaaaaaagattggttaccgatcaatttgactggatcgaaactaataatgtcaacctcgttgatgaagtccgtgggtgcctgggcggcctacgttgctcgatctcgccgcggaggtagaagtcaacgagctcctcatccaagaccacgaagtggtggcctggagacaactgcagcttcggcaccagcttgtgtctccgccggcctccattgctcgccggcgctgccaccaccgagcagtcgccgccattgctctccgttttcatctgacgacgacgtagtattttgtgtggtacgctaggaagaaagaaagaaaaaagaaaaaagaaaaaagaggaacgtaggtattgatagatatatcaagacatgatgtaatcatgctcttttctctactatgtttcttaatgcttattctctctataggtgttgcacggcactgtaacagagaaacgttatgttctagtaggaatgcaagtgtagcattagtctgtttaaaaaatcttcattatagatggaatattttcatatatttttagtttcatatatttttagtagctaatattgctagttcttttgttgttgaacatggtacaaatttgtatccttgttctaaaatctgagattgtattaacacttgttttgcaatttgaatcttttgctttaaaattgaaaatctgagagtgctttttttgaaatttgatattgtactagcacttgtttccttgttgattttactgttatcaagttgtcatcgttgattgccaatacagtgtccctgatgccagctgcctcagcaaagtcagagcagtagtcagattacttgtttacattggcttacaaagataggcatgctggttcagagtaaaagtccatgaatcataagatatttttctcccaaaaagagtttacaaggagtacatgaatgaacatccagatagatattttcccctaaaaaaagttgatagttttacatgaacatgaattaactatattttgtccaattgctacaacgcttaaagattttgtcctgaagttaagctaaaactataattcaaaatgagtactgctgggctcaagttctcaacttttcaagttatggatataacctttcccctaggtgattttacttaatttaaattggcaaatgaagtgaatttgtccggttctttttttccgataatggaagctttattaaaactcactcaaatacaccaagatgataccttctaactgagctcagtcacggcctctgtatgaaatgcacacagccacaaaacatgatctaactagaccctcaacacaaaacaaagaaattagtgactatcaagccgtagactagatcgccgcgacgccacccatgttccaaggcaaaaaaaaaaaactcccgtgccacctgttccaaacgacacaataccaccataatagtatcctgaagaccctattgtggaggataggccaggtgcgtagctaccaggtgactaaagcaataacctgcaaaggagaagacaccatcttgttgtcaaaaattacctcgtctctggttagccaaatggaccaacaaagagttgttgcacccatcaaaagtagatttctcatgtccttaggaacacatgtaagccaacgcccaaacatatgattaacattttgaggaggttttaagttataagccatatgaataacggaccaaaccaaacgagtaatatgacattggaagaacaaatgttgtatggtttcgtccttgtgacaaaagcaacatttcgtatgacctttccactttcgcttagctagattattcttggttagaattacgccctgacgtaagtaccaaaggaaaatctttactttgacggtactttaaccttccaaatacgtctatttatattcgtgatgcctgtatggacaagagctaagcaatgagaattgacttaaaagactccattgggggtgagatcccatcgaaattcatcttgatcctgtgtcaacaccaaatcagctatgcgaggccataaattgtgacaagtggctaattttctccgattaaatctcgtctccatgaaaagctcggaggattgttttgaaagatttgtgacatagtcgactgtttatgcttagctatgttatagagacaaggatattgatctctcaatgaggtattacccaaccctttatcatcccaaaaccttatttaagagccgtccctaatacgaaaggactcgaacctaagaaaatctagtttagctttcataaggttggcccaaaaatatgagtctcccgcattcaaaaagcctgagataaaggttgcgatcccaaatatttattacgtagcatctgttgccacattccatatgtggtgagtaatttgtatagccttttgctaagcaacgctacattctttacctctaggtcgcgtattccaagccccctttgatctttgggtggacagatgatgtcccatttagcaagctggtatttcttcttatgtccatcccctttccaatagaacatagatcgaaggtagtcaagtttcttacgtaccccgctaggtattgcaagaaaagacatcatatacattgggagactgctaagaactgagttaatcagcgcaagtcaccctcccaacgagacaagttttcctttccagctactcaatttgttttcaaatctttcaaccacttctttccattctgcatttcttaacttcctgtaatggatcgggatgccaagatattggaaagggaaattgccaacctagcaaccaaagagttgattatattgatatctgtaatcaagcgcttagccaaaacaatatagttcgcttttataaaagttgatcttcaaacctgataggtgttcaaaggtcagcaacaccgacttcatattttgagctttatgtaggtcatgattcataaaaagcattatgtcatcggcatattgtagtatggacagtcccccatcaatcaatgtggtatgagaccttctactgcccttgtgttttggccctatttttcaagggtggctaacatgtcagcaataaagttgaataagattggagagagagggtctccttgccgtaggccttttttagtctgaaaaaaggccccacgtcattattgactttgactgccacacttcccccggaaatgaaatattcgatccaagaaatccacttgggcaagaaacctttcatccgtagagtttgtaacaaaaagggccatttgaccttgtcgtaggccttttcaaagccaattttgaatatcaccccattcaacattttcttgtgtagctcatgaactgtttcatgtatgatgatgactccatctaggatatttcacccacgcatgaaggcaatttgagttggattcactacatggtcacccaccgaactaattcggtttatggcgaccttagtgaataatttataattggcattcaacaagcatattggtttatattgttagattcgatttgcttcttcaactttcagaattagagtaatcaccccaaaatttaaaccaaaacttggaagaccgccagaatagaattcattaaataaattaagcaaatcatgcttgatgacttcccaaaaatttttggtaaaattcaacagggaaaccatctgacccaggagctttgttatgctccattgcaaagatcgcttcctttaattcttcctctgagaaaagggcagtaaggaagttattttctacttgtgtaacctgagccatatcttcagttatggtctcatcaagcgaaaacggattttctttggtagtccaaagagtctcttgtagaaattcgtaatgtatgtttcaacgcatcagccccctatttttccttcatcctggtgtaaaaagaagatcctattcttcctatgtttgccattggcaatttgggtta

SEQ ID NO: 56166 - DNA, 984 bp, Oryza sativa
cgataccctacaccaactattgtcctcgttcaccaccaaccggtgatggcagcactgaagatttacaaattctgtatgtactctcgtagtctcgtccaacaaatagctccgacgaggatgaacaactcgaatcgagctccttttcagccaaaaatatacaaggaaccgtaaatatgtaccagctgcttcaccctcccagtcagagtcttctagcgtctccttcaccagagccctcaaaagcatttgaagctccagcttcacatgagcataagtaacttcagagccagataggctcacagcatgtgcatcatccatagtttgaacttgcgcacgtatagatatatgacgcacggtccaatcagatcagtttcggagagtcgcttgcagagtttcatgtaggactccaggctgccagattcctgtatgtttctccgcagggcggtcagcacagctgctctgtctaggtactctggatacaagcccatgtcaagcatcttcatgagtgtttccgaggcctccagataaaagccgcctttgacatagcctcgtagaagccatgacagagacttcttccttcttccagcactggttgactcgactccagcgagcaatcgacggacggcagcaacttctccctgagaagcgcagatggccaaaacaacatcatagagctgtgtgtcaggttccctaccaagaagcttcatttcccaaagttggtgctcagcttctaagccacaaccagcgcaagtgtacaatgaaaggagcctctcgtgcacaagtcctaggacatcactgctgccttcctcaattgcccattttgataaaagaacaccatcacttaataattcagattggtaattttcaatactatgcatagtctcagagtcaagtttggaaatcgagcccaccttcaccgatgaattcaatttccgcaatggctttgagaatttcctttgttctttaaccaagggcagtcaacccaat

SEQ ID NO: 56167 - DNA, 2121 bp, Oryza sativa
cagtcaagttcatccctcaaaaaagaaaaatccttcagcacacttaatactcttaggtttcttgctgtaaaggtacagaaaagatggatcccaataataagaatcgctatttcatagtgctgcaggtttactatttaatatcttgctgtgttgcagtagtattcattattcaacgataaaaaacaatttattcaaaatgatgcagcagaaagccctaaagcagtgatacactggtctctgcaggtactctcaatgtattctgaaaaagaaatttagagacacctcaagtagggtttgtttggcttgtagacccaacttatacctgcaaaatattgagccccagttcaagtctcctaaaggttggttttatcatttgcctgccccaaggaacatcgtaataccacaaaaaatttataattcaaaattggacattttccgctgcaaaattgtccccactctctttcttaaaaaataatccatgatgactaacaaatccttgtttgattcattatcaaaggcgagttcggttggtacaaccccaggaatgagcgtgggtaatccatgggcagccaatgaccatactgaaaatgctttttttttttcactagctttgaagaaaaaaggtgcattagttcagttagtggatcaatgggtacctataggtggactcactcccatcacaacacaacccagaactcaccagcaatgtggggctaagaaaaaagatcacttatgtctacttagcaaccagcttccaaattattgggcaaccaaaaatttgaaaccaatgtggtccctacttgtcatagagataggtggataggatttttccagcaataatatgcaaggtgctagccaaaaatctagcaagttttcttaaagcatggccaaatgcccaaattacatgggaccaaaatcgaattttggaagagaactaaacaacagctcaacaatgggaataaccaacaattggatcaggaaacctgacacacccaaacttttgtgatgaaaccaacatatatattaccaatgttaactcctttgttaaaactttttgaggatgatacgcatgctggctaacaaaataattatatgaaactcaataaactacagtacatctaaacaagtgatcaatgtggggatttagttgttatgattattttataggataacacgtgattaattgatacgttattctaacaacatataatacaaacagccatgagatatcagatataccagaagcgcatattataatgatcggtttaaagtactgtacacctaatgtgcacattgatttaaagacaagaaagctgatatcccaaccacctattaaatactacaaattatcttcacatatagtagtagtgatgtagagcaggtcaacaattcagaatcaaaacaaggatgcgacctaaccgatgcctagtacacagatacacatgatgtattatgtcaacctcgtgatttcgagaagtctaagttctcagcacagtagcagtagcacacagtttaaagaaccaagggatacagtaacccaggctagtacacatcaaccgcacaaacaattcaattgagatatacaagcacagaaatgggtaaaaaaaatcacttaaaaaaagagggtaaaattgaaagggggaagaaatccaattaccatcatcctccacgcgaggtatccgacgggccctccgcgctcgccgtcgctagcaccgccatactcccctccgtcgccgacgccgacgccgacgccccctctcctgaggacgtccctgacgaagtcgacggcgctgcccctgtcgccgcggtcccagtagagcgcgacggccttctcgacgaggctgaacccggggcggagcccgacgcagtccatctccccgagcagcgcggcgacgtcggcgacgtccccgccgccgcccacgaggcgctcgatccacccgcaggcgatggcggccatgagctccatggtctccccgtcgacgcggttggcgcggcggagccagtcgaacacctcgagcgcgcagtaggcgtcgcggccctcctgcgcgaagtagacgagcaccagctgcagctcccgcggggacagcgccgcgagctgcgccgacgccgccgccgcggcgt

SEQ ID NO: 56168 - DNA, 3995 bp, Oryza sativa
ataagctacgataaaaaaacaaattaaactattgctagtcaatataaattcagaagttaaatttaattttatatttttctgaagtgatttattagatattaatctatgctgttaatttttttctataaatatctttacctattataaaagtttaagatatttttgccagattatttggtccgtcaattagaatcccaatcgtttccgtcgtcgtttttttttcagcctaatcatatgtttcctttttttgttctcatgaccgtaacgcatcgtcgcctactattcgtttttttcgtgtctccttttttttcgactcgttttgtcgtgttttttttgctgtttttatccgggttctttttcttcgttgtttgttttttcccgattcggtttttttgctaggtttctttttcgcttttttcaaccggtttttttatctcatccgatctgttgcatgcttctgtcgccggaccaaacccttacgccgccgccacttcgatctgtctccccatgcgttttctccttgaactgattgcaaaaattgattctccactcctctctcatcatttttctcatgatttctcctttcgattcggttttaaatatctagatttatcagtcactaattatggtcggccgacctttttatcccaattttgtgaattcattttgattttgggaaaaccaaaagaggatattgagtgtataagttgagagataaaaaaaaagattcgaccgaatttaatagggattgctcgcaatcttcctccacgcccgctgattccacccctctctttaaaccaccaccgccgaattccctcacagccgtcatcatcgcgattgccaccgatcccccacctcgggttcatgtcgcggtgaccgagcccccgccgaccgtcgtgccgcgccaccctgccttgccctagcgccatcactgattcgtttcatcgagatctagccgccggcttcgtgccgcccgagagcaggaagaacacggggttggtgtgagggatcctcggctcgatcgaggtgcagcccatgctaattaacggcgccgccgcagccatcttcatcatcaccggcctctaccctcagatgggaaaggaaatcttcatgttcctgtgttccttttctcctgattacaggtcatgtcattgttttggcttatgtttgatcgtgcatcacggccttcataatttctgattgtatttgagctctatctccggacaccctcatgttgttcgatgaaatgcccgtacacatacacggcaagaaatcatgtagtacatggagcagatgttcatgggtaatatatgtgttcatggcttttagggtaactttttttttctaaaattaattgcactgttgtgctgcacatacagcaattactgaattgggattgaacatcttaaatttttatgtgttacatgtaaacatgccattacatgatctggtggccgccactgccctttagctacaacatatatttggatcattcatacatttatatatttctgaaagtggtccaggtcatcaaggttgtctaaagatatcgaaactaattcacggactaattcaaaaccaatattattttcttaagatcatagatttagactgtatatatgtgaattgacggcaactattgaataaatatggtcaaatatctcatgaacccgcccttttttttcagaatcctttttttgtgaaaaaataaaaccatctcattatggtagtactcgagttgtgaagttaccgatgaaaacattcaaactgaatttggttgctgcatttaggatgtcataggtattttcttttttaatctctctcgctgatttggtttcattcatttagatgagtattgaaaacctttctcttgtgataattttattcagttatgtatttcattcagctgatgaattatcctttgatcatagccattataaatgaaatataaactgaattgcactatctgcatgatataacttctacaattggattatgtttttctgattttggcatatattgtatatgaatttcgtatacttggataaccgtgtttctggtttgtttaggaccttagggggcatgtttctgaaatttaccgtctggaaaaaattctgacattgcttattatatactcagattttccagaaaaatgcttatgtattgccagccttctagcacatgagtttggatgcttgttattgactgacataatgataacttgcaatattaaatcggaatacaaacagtgagtataaaaacttttgtatgaatggaaccgtttgtgttattagagtgaggtttacatttggtcaatattatatttccgtttatgttcatgaaattcatcttgtttctgttcagtgcagtactcccttattgattccttcctcatttctgaacaaaaaggactcacgaatcttagatggcatcatctacactattgatgcatcatctgcactattgacctccttatgttcatgcgatggatattttttcagatcagtgcagtacaatcctacttttgattagtgatgataaatagaagtttgatcgttgaactgatcaatacaagatccttatttgtaagtagcatctattgcacctaattttgtatatgcagtacattagttaggatcatgtatattttggtattgctggcaaatataactctcaccttggatcaaaaatgatttcagctaaacaccacctatataagtttaacagatatttatctaaactcaaaactgaaaaaaaaatgtgtttaatgtctgaaacttgcaaggtgctactatgatctctgaacaaataaacggtctgagtttcctagcagcaaattgatttgttcagagatttaggtgggggcacgccataataaatcgttgagactaggtcttataacaaattaacatgattttttaaagcaaattttctttatatttttttacataaaatatacagatcggaaaagcgtgcgtataaaaataagtgagtataagttaggaagatggagtaaaaagcacacccttaacccactaacctatgttttgcctcattgtaccccttgaactactaaaattggtttgctcgagcatttatcttcttcgtctctttttatacgagtcatattctaaagctgatattttgcagggccagacataacaccattatcaaagctctaaaatatttttaaaaattttcatgactattgtttgaaatttgaaaccacgatgtttaaatcatgcttactgctttgaaatatatgtatacggtggtaaaaaaatatgaaaaatactgagaggtaggttataatatatctatatatcaatcctaccaaatttgcttacaaaatacgacgtatatggttgtatatctttatctacttaaaacattcatagtgtttttgccgtgcatcgtagaaaagtgtgtctcacacaatttttcatccgacatgtgaattgttggtccgtatccatgtcccctgcaagcgtcaaactcttccgcccacgtgaaacggaaacaatcacgtataaaaattcagtttccaatccgagcacgacaacatcacgcacccactgcctgtagcctcaagcagtgacatgtgcctcccctatcacaaaaacgagactcatgacggtcaattgtcttttgagctgatagagattttttgctggtgggtctcacgaatatgtcttcaagtgtatagaaatcttgtgaccgccaacagttcgtagaatatactttactcccttcgtttcatattatttatttcactgaaccagttttagctattaattatttggcaaaatttgctacaagaaacgcaaaaaacgtgtaattggctgagagacaccgtgaaaacgtgacacggctgatggacactacaaaaaatgtgtaattggccataggacaccggtcgcattattttattatttccgggtcaaaagaggtgatttcaaaatgacaagattgcccatggagccatattcccccgc

SEQ ID NO: 56169 - DNA, 4348 bp, Oryza sativa
catctccaatggcttgcttgtgccgtagaacgcgaagtagagcatggactagatccacatcatctcgatgcagtcgcttgccgtcacgccgagctccgggaaggtgtcggccatggcggcgacgaggccaaggcgtgtgccgactaccgaggtacagggactcgaactgcgcgttctggttctgcactatgacgtggagaagttcccgccgccgccacctcggatggcccagaagaggtcctccccaatggcggccctgtcgaggagcctccccctcggcgttcaccatggtggcatcgacgacgaggtcagaggcgaggccgtgcttccacagcatcaggccgaagccgccaccactgaggaacccgtcgacaccgaccgtcccactcgaggcgtcgcgctgcccgcgcgccattcctccgctccgccgcgtgtgtgagaaagaagaaggataggagagcaatgtgggcccccacttatgattagcaaatagtaatcaccctactaattaggtacaaattagtccatgacgcgtggggctaggtggttaaaaacctattaaaaattagattaaacatacactgtctatgacatgtgggacccactggtgtttaaagaaggaaagagaaggggcaatctgggcatttagaaaaatatctcacctcttttgaaccagaaataataaaataatgtgaccggtgtcctatagccatttacacgtttttttagtgtctatcagccgtgtcacgttttaacggtgtctctcaaccaattacatgttttttgcgtgtcctatggcaaattttgccttattatttttatttcacgaattcaccagttgcatatataatagttcattttcttaaaaaatagctaccatatgtgcccatgcgcgaaaaccctattttcgcatgtggtttgtgctgcccatatggaaagatactaaaaattattttttatagtgataatcgccgttatagtttagccaaaggcgaaaatcattttttatagtgataagtgccattgcagcaaaaaataaaatctttataccacactaataagtaatgacaccttcaactattgattatctctatgtgaaacccacatctctatcatatgttccatccacgacgtgcctgagacctacccaggttcatgaaaaaagacccccaaatatccatcatctaactctctgccaccatacacaaaaaaaataacatatgtaatttggatttcctatcgcaatgcacgagcatctttgctatttttttttttaaaaaaagagaaatgagagagatgaaaggaaaaggttcacttgaggtcccttatcttgtcgtagagtttcgaaattgtccctgaactaaaataccagatataacatatctataatcttgcaaaaccgggtcacattaggtcccaaggcagtattgctccccggttttggtgacttggtggctgagtcagcgtgggacccatgtgggtcctacatgccagccgataatcttctcccacctatctcccctttcttcccgtctcaacccaaaccttcagggcagctggcaacaggtggggagaagagtggcgactgacggctgcgtcatggacctacacggcgaagagcgcgaagaagcgaagtaggaagggctcccgacacgtcgtcccctcgggttacaccactacatcgttgcatggcagctcgccgcgcatctgcgccacgtccacatcatggtcgcatgtcagccacaccgtcgggattggcaagaggatctccaagagttgggagatggagtacgttgcgacgcctgagcatactcgcgagcaccactgactgcatgagtgcccgtgcatgcaagcgaagaggacgccagacgctgaatcgcgagagaggtgtgtggtggcctgtgaccagcagggagaagggtggtggttgttgggcggcggtggtaggtagaagcccgacgacggcacctggcaatgggtggggagaaggctagcagcgaacaagaagcttggcggtggcaagcgttagggaaaagggcgcatgcatcgaggatgatgcgaccacaacgtggagtagatggagttgacctcgaagacgatgcggcggagccgcgcgttcgcctctgcggaggagaggcgaagctcggggacacctaaacacatcggcttttgagccgctcgatgggggcgactatgagcttgggggataggagttggccatcgtgacgaggcggaagcccgggataggagcttggccagcgtgatgaggcggaagccccagccctcacgcgtgccggtgaagacgagattgcagttgtagttgggacccgcgccacaccccgcacgtgcgcaagtccatgacgtgagcgctcccggtcattgggagccacgtcagctggcggcctccgccgtcgagcttttcccctccgaccgacacccttctccccacccattggcgaatgccctggaggtttgggttgagatgggagtagaggggagtgaggtggaagaagattgctggttagcttgtggggtccacgtgggccctacactgactcagccaccacgtcaacaaaaccggaaaacaatactaccttgagattaaaagtgatccgtaatccgttttgcaagattaggggttcagggtcgtttaaaactcaacgacaagataagggaccttagatgaacttttttgggagatgaaaaaactccagcctcatgggcctgtgcatatgacccataggcaggcgacaccgcgtgcacgacctccgcctccccaatccgtcccgtctcctcgccctccgccctcgactcccgtctcctcgcctgccgctggcgccgatctccatcctgctagcagaggtggcgccggcgtccttctgctcccgccgcattcgctcaccggtgagcatcctaatccatcccatccggcctcggcctcgaatttcgtctcctcgcccgccgcttgcgccgatccccatcctgcgagcagaggtggcgcccggcgtcctcctccttccaccgcatcgtcgctcgccggtgagcatccctccctacccacacctcatcaggtattctgcattatccctcaaaaagtttgggggttcaacggaaacagggttagatctgcctctgcccagctccacctactttcaagttgttaattttgatttccgtttttagcatatgtaatttggttactgaatctcatccaaacacccttagaacgaaaaatgtaagctcacataatttgtactcatccaaactcacataaatttcttaagaagaatctagaccacaaactacccatagtcacacaaaatatctttttatcaaggtatattcttataagtaatttttattccacaaaattttctaaaggacatactttgacacttggcattaatctaatttaactttttttctttatcaggttataaattttctaagacatttgtgccacttggcatgaatctaatttaacattctttctttatcaggttataaattgaaaccattgaacgcactttgtcttcccgtccctaaaacattgtgatatatctataatattttaatatttttaattttaaaaataatttagactaataatatagatatttaaattaggtaattaataaattcaaatcaactatagtttagaataaaaaaacaaaatgatatatgccaagtacaatctaataacaatagaatgttagaaacaatatgaattcaatatttttataaattttaagtacgattcatacataaaattaaagaaaaatatagatttatatataagtgagaacataataaaatgcaaggtaaaattattaaaggaaaaatgttattaataaacaatgatgttgatgtatttctaaatattttcacgtttatttattaagtgtcaatgattgaaatagatgatttaccatgtgacagattaattattaaaattataaaattatattgttttcatccgttgcaatgcacgagtattttgctagtttagatgatatgcaaagaaatgatgtaaactcgagggtcgagagtttagaacagtagtttccccaaaccaacggctcagacccccctcccccgcgccgcactgccgccattgcttcgccgcgtgcgccaccaacccgtccttcccaccgacgagcccgtctggcgagccacagcgaggttgcagcctctcgtcttccaccaccatcccttccccgcgagtgctgctccctgtcccgccgccgccgccccggtgcccctcaacccggggaattcgcccccatcttccccctccccgcctcgtcccaactagtcgaggggtcgccgccgccgccgcttcccccgc

SEQ ID NO: 56170 - DNA, 2618 bp, Oryza sativa
aacatcttcaattttttaatagtagagattaggagtatgaattgactatgggtgggaccgtgggagtgagggctcaaatccgatgattttatctattattttatatgtcttttagtttatattttcacttttaattagggtctatttggtaagactttaacttttaaatttaattataagaattgggtctggagtgtagttgtggagctgtctaaatcagctccacctctctagtttgttttgtagaaaactttagccagctccactgcaattttttatttttaatgaagttgaaactatttggttggactctctgacttcaagagaggtggggatgaagctaaagttgtaccaaacagatcctaaatttgtagtttgtcttgctagttgtttattcatgatttttgtttttagttgttcacgtatacgctaccgtacacatatacgtgagccagaacgttagcttttcattaaagaaagttaagataaaaccaggagataagtgggcttgctgttgctgtgcgcggttatgttggggaggccgtttgggccaatggcccaagcggaagcgtacgtcggtacgtgcacggtgctggatagatggaggaaagggagcgctggggaggcggatgcgtacatgcgacgtttgttgtttctctctttttttttcttacacatgccacctaatcattctgctacttggtccaatcaaacggcgacattaccgccaacttgagatatgtagattcgaccaaacataatagtgaaacatttaaacctataaaaacttccttttagcggaatataacgtaatttgatcaaacataatggtgtttaagactaaaaaaactaaaaatttatgagacaaatataatttaatacacctttgaaggcttgaccaaatttatctagattccaaatactctgttgtagcaagaggcaaacaccatcctcatattcgatcgaaacactcttacccacttggaaaagaggtttttactcgtggcaaaacttttcgacctaatgtgacaagtaaatactaaaagactgacaaacatggtaagaacgctagtctggaaaggagtattctagcctaccacaagaggaaaataccattagaccatggcggatgaagcctgaaaattatatcattgagtgaggaatattactcaagaagatactgcagggaccattttaaccactcctataagctggcgccatactattagggtttctaactttacaggggtattgttgtaacttcctatgtatagttaggggtaggattgtaacctcacatgtacctccggaggctatataagccggtcatgatcttgtaatcagacacgaggtcagatatatcataataccatacaacagatgagactttacttttcgagtcatctcacttttgggaacatattactttcctacctatccctgatttgtccgtgacctaaggtcactacatactcttgcgcacaacttagaattttgttatatattttccagtcaatttactcatttgctaaaaatttcctctatttaccaaaattttttttgctacatttgtctaagattaaggctgtgttcttccccctattttcccaacccacctcactcgtttttcgcgcgcacgattttcaaactgctaaacggtgtgatttatgcaaaaaaattctatatgaaagttgttttaaaaaatcatattaatctatttttcaaaaaataataattaatacttaattaaccatgcaataacacagcctaagtgttcaaaattattgtcacatcttaggtcattagtaagcctaagatacatttctgattttgtgtcacatgatttatatagatagaccctttattaaaagcacgtttttgctagttaactatcgacagttttcagcgctgaaaactttcctttttttgtccgttcgatccagctccaagattcgtgctggcggtgctggaagatagaaaaaaatttgcaagcccaattcgtgtctgcaccaatttgtaagcctagttcgtgcctgacggtgcaggaagatggaaaaattttgcaagcgcgccatggggatcgaacccaaaacctacagcatacacacttgctccattacactttagtgggagttacacctgagttaaatactaaatatactgtagttccataacagttacatagtagttacaatgtaattacactatagttacataatagttacatttaaaagtttttcatctaaaaaactgtcgagtgttatatagctactccctatacaactacctaagctaatcaaacttgcctaatatttagacgtatgactagctataaaataaccccattaacctcaggagttaggagtacaaaatagtataccttttcttatcccttttgaatttcaaaaggaggcacctccaccactgaccgtccgatctccccagcaagggcgaccaccggataggatccccctcggccgtccgatcggtcgcggccgctgggatgaagccacgcgtccctcccgcgtctctccctcccaaaagcccacctccaaaaccccggagcccgcccgcgtcgtaaaccctagccgcctccgccgcctcctcccccctcaaat

SEQ ID NO: 56171 - DNA, 1101 bp, Oryza sativa
taatgtgttccgctgacttagtgtacttgtgcagctgcctgttgaatatctaattgcccacagcatagttagtctaattgagctttgcattgttaattgtacttagcttggttcccttgtttagatgaaactcatggccaaatgaggtgcttatccaactgtttaactgagtaacttgattttcttatgggaaacaatcaatttttaagtaagggtaaattaaatttgaataatctttagcagagcttaactgtgttgctaatgtggataacataaatgttgcatggtgatagttctacatcttgtaaccataatttgcaagtatctgtggatggaaaggaattctgaaggaccctaagctaggtcaaactggcccaacggcctttagttgctaggattgttaattgatgtgccttttcattaagtttgtgtaattgtttttcgcttaacatgattaacagctaaaatctgtttctttgatgtctgctaggacagttggtacagccatgaatatcactcaaatcctgctatcagctcaatctgcagatggtaaccttcgggtagtagcagaagggaacctcaagcagttccaggagcagaatcttcccaacttccttctctccttgtcagtggaactttcggataatgaaaaaccaccagagtctagacgacttgctggtattatccttaagaactccttggatgcaaaggattctgcaaaaaaggaactactgattcagcaatgggtcagcctggatccatcaatcaaacagaagataaaggagtccttgctgataacgctaggatcttcggtgcatgatgctaggcatacctcatcacaagtcattgccaaggttgcatccattgagatcccccggcgtgaatggcaagaactcattgccaaattattgggcaacatgacacaacagggtgcacctgctccactaaagcaagcaactctagaggccttagggtatgtctgtgaggagatttctcctgaacacttggagcaggatcaggtgaatgctgttctaactgctgttgtccagggaatgaaccagacagagctaagccctgaagtccgtcttgcagcagttaaag

SEQ ID NO: 56172 - DNA, 5949 bp, Oryza sativa
ttccagctagcacaactgcacttgagtacttgacagtgcactattaattattccttgcgagagttgaatctgttttattttaacagttcatgcttgtaactattagaaaattagattctcagctgtttcttttttctcatgtgcaatagtgtttaaaatgctcactgtagcccataaggctcataatatgctaactttggtcctatttttgcttttcaggaagtttcaggaatggccacttctctaacgaaagagccacagcaagcagctgcctctccggattctagtgaaccatcttcttcagggacaacgaaatgagacacgaatgagatcttctaagcttcttcaagaagtatgataggaaatattgcaaactagtaggttcacagcttgtggtctgagaactgtttctggtgcagtgataggaagtattgatgatgatatacttgtgttggtgatgcttcttatgagcacttgatttgaataaattaaatgtaaatactttagtatgtttggcccacaatttgtaatgaaggaacatggatcgtgatgtttctgataaaattcttgaagtgcctagcccgcgttcatgtttagttttttttttatcgcaattgtggtgctatgctgtaatgtaatgaataatgtgcataaatgtggatgatgaatcagagccgctcctgtagtagtacacacatgtgccaatgctgtaaaagtggcaagctatacgctgcaatttgaagcaatcaggagtaagtgaaagtatcctccctctatccagcgtaaatatttcacagaaatctacttggattcaagaacaagcagaaatccatctggttgggaagaggagaaagagtcaaggacatagattaaatattgtggcttaaagcctatatcaagtgtgtaccaggagatgacagaaagcaaagatgcctgtcctaggaacgaaagagctgttcagaaacaagtaggcggggcatatctgctatagcaattagcatgaaaaaaaaaattctacattcacctaatattcaaactttgatcaccaactagtagtagtagtactagtatttcagtgtggtttatgtaagtgaataaaaagcacatcatttcctcatacctcagaatattgttcattgggcgcagcaatgacaaaacgaacacaatttactcgcgtctattttccttcgatttcagctctggtttgcaccgtgcctgttttgctccacaaaagatcgcaaacaagtaggttcacagaacagagcatttattcactttcagatataaaactgaacatccacagcaaagtatatcatcaaatatcccaaagcctgtcaatatcatcatgtattaaagaaaaaaaatacccatacctatatatgtttacgtcaaagtaatgacaaaccgaagaattctccaaaaccatcgctcaatttgctatgtaccccctgcagtggacaaactttactcgaactgaacaacatcctaagttcttacaagtaaacctatacctccgatttctcgtgttgtcttgcacactgtttcccttggattgaagaaaaaccgccaagggcagcagacgattcgaaagatcaattatcagacactatacagaatgcctccagtatccttcgctgatgtaaaaatatcctgttactgttatgcaatgttcttgtagctcctatgcacatttcatctcttcttttttcccttacatttctgaagaggaagacgatagctcaacctacaaaagcaaaaggtaatggatttccaatgagaacatgagatgacagatgaggcaaaagtgcaccagttctaaagaaacaagattaatttcttcagtgccgatgttttgtatacttgcctgagtttctgaacacccatctggcgtagtcgagcaccgatggtctctctcgtggttgcggctccgacaccctcaacgcctcaggatcccagctccccgaccacgagtcggtgctcccagctgccgtgcgccgcgaggaggacactggtagctccattgcggtggagcggctggtggtggggaacacggcccagctcccagagagtgtggccagagaagagcggagccagccgcgagatcccccagcatcatcgtcggctgcagccacctcttcatcagcgagaggcagcaccggcagctgcagctgcagctgcacctccgtctgaacgccacgcgagtcagcgccgaggtggaggtggcggccgctcgtgctgccagtgccagggctccagcttccggtggtgcggcgcgacgaggagcaccccggcgccgccaccgctgcgacggcgcggctgcgggagcacgccctccagctgccggagagcctgtccagcgaggagcgcagccacccacgagatccccccactgcctccgccaccttctcgcctggcggcgcgggcaccgccagaatctgcgactcgatgtcgtactcccctgagcagaaggttggaacgaggcttctcttgtcggtgcggcagcgggtggtgatgggagcatggcactcggggcagcatagcagcggcgtgacgcggctgcggagccaggcgacgaggcagcgctggtggaacatgtgggagcacaccggaaggacgaggtgcagatcagttgggagaagcagtttgttgcagatgaagcaggtcgccgtgctgccgctcatcgccggctgcaacggcgaaggtggcagcgagagcagctccaatatcacccgctccacctccggcagagacggcgcagacggcggcggcgccatcgcagcagctgaggtagccgaggacgccatcaatccagccgtcccctgcactgccccttgtgcagagctcgacaatgccactggagggcctctgccgggatcgcctggagctgaagagggcgcggccatttccggccaggacctggcactggcagcactggccctcggtgaagaaccgacagctgcaactgccgcgcgccacatctgagacattgctgatggcgaagatgacaaagcccttggggataagctgcggcgtggggagaacgatgagcaggacaggcggcgcccacggcggtagctgcgtcgaatgacaacaatggcgacagtcacgatggccgtggtaatgacgacgaggacgacaatggcaatgctggagcctatggacgacgacgatgacggcggcgtggctgaaggtggcaggctcggcacagagggatacactacgagctccggtggtggcggcggcggaagtgggagaaggggaccgggtagcatacctgcatcagtgcagctttttctctgattagtcccaaatcagatgctaattcgtaaaaattgactagatagagatcatgcgtaggatgaaggaacagatcatgggtgaaatttcgtggaaatgaagtgataaaacaactggaaatttggaatctgggactaatcacacgagcaggacgcaaaattcgatcaatcacgcaacctaatcgccccaattcccctccattgcagctaacaagttcaggagaaattccacatcagcaggtagcgacaatccaatcacgcatggagttccatcaggtgatccgttcaattccactcccaaatcaaaccacaccacaccacaccaaaccaaaccaatccaaatctcaagcgcagctggtgcgaaaaaccggagaatctctaggtgcggagagggacacgggcaattaccgacctgatgcatcggcggcggggaggggacgaggacccccggagcagcgcagctggtggggcggggggcgcggctagacgctgcacacgcttccctccacgaacctgaaggagaaggaggagggggttaggtctaggttagggttcgggagcgacgaggctgcacttcacgggtggaggaagcaccgccatacatcgacctcgcagcagggccaacacgtacatacctctgcgacgctgccggcggcggcggtgggagaagggggcggaatccggtggatgctgcggtggccgcggccggagagagccgagacgcggcggtggcggtggcgtgagggattggggaggaggaggaggaggcgaggcgaggcggagggggatttggaatggcgcctgcgcgggcgggaggaagaggaggaggaggggagggcccacatgtcagtctcctcggggcagattaggcctggtgggctcggcccacggaggcctcgctagagtaggccacatctccggcccatccacgtgtatgagcctggactggatatctcggcccatccaaacaaaggcccttctgccaatttattcttcagagtaagagagagaattgcacatcaggccagacatattatcaaagtttcattttgaaccatctcttagtcggtactacgccgactaatgtaacccttgaatattataatttatttattcaaaatatataaatattgtacatgttatgttatcatattacttgttaagtatatatgagatggaacaaaaatgaatcaagcgatggtaattgcggtggtatttgtgatatttatgttttgataaatctagaaatgtttatttcctgataaacatattacactaagattaacataatttggataatgattttaatgtttatctataatcattaaagcaataaaacttagttgtacagatcaagcatacatcaggctagcaattggagctgcgtcttatatagctgatcgattcttatgttctgattgataacacaattaaaattaaaagataaaaaatacaataaaaaacaaaagaaatagaaaatatgcgcgcagtacagtaaatgcacgcaatatttattatttatttgtaaaggagttatgaatagatctttaagcagttttaaaattttatatctgtcaagcctgacaaaaacattatgctggtaaatgtttaaattacatataaaagaaagcaaaataaatgtttgaaacgtggtacgtggaacgctggtcttgaaaaatatggtacgaaggggtatacctcttcaaaacgtttgttcgaagggtgaagcacgttccatggattttcgggatgatagtccggaatgatatggaaaatcaggatgcctttgttctgcagagaataatttgaactaaatatatgtaaactttagggcttatatggatgaaaccatttgaatacaagacttttcgtaatattaataaactcaaagggctaaattgaaaaaagatgaatctcttctcctttcaccacatcaggccatcaccccacgatggaatccacaatgggcatgtacggccagatcaacgtcaacaatggcagaggcatggaggaccaagaactcgtcctgcgtcattgcagtgcatcacccacatatctgacactgggtttctcacattctgatcttcattttttattagttttgatcgattgaagaagacaacattcttttatcagttttgatcgattgaagaagacaaatggatacctcttctttcatgctttgatgcctatttttatttcgatttgaagagattgcaagtgatagatagtttggaatactctagagttcagattaatgttcgcgcgggagactgcgcagggttctccaccacctctccatatggacacgtgacagattttaggagggattcaaaccgaaatattaggatgccatgtggtccaatgagaggctagggattggaccttgaaatcggtattaaagatttcactttgaacctactatacgaatgctattatgtttattgttaatcccattgtcctcaaaccttgagaaagttaaagggttagagatgcacagcagtttacagaagtggcaataatgccgtggatagtaagtgtgagctaatggcaaaggttaattttgggcagggttcattcaaatagatacatatgagttagcactgattacgaggccacatgtgcccattgttcccgatacaatgttgttatg

SEQ ID NO: 56173 - DNA, 2817 bp, Oryza sativa
catgctatcatgtatctccatcagtttagccatcaaatcataggtaggttttcttaaaaagacatatgtagacctcaaggtgatcaacatcattacaaatttggaattcaaatcaatttgtactaagaaagaagagaaaagcttttgcacaaatagcagttttgttggccctctttattttattgtttgactcggattcctgtttttgttccttctaacacgaaatgaattctacagatatccacatgtgctattatttcacacttagctatcagccaatgttgagtagaaaatttttatttgcagattgaaaattcaattttcaggcttcaagtttaaatttatgacatgaaagtttcaccagttagttcacttggaatcaccaggttttggttgaagattgatatttttgctaaaagtttgtatgttcaaagttaagaagagttaattagatagttaattagtgaaaattttcactatatagaagctctttcaggtatatttgagcaatagtgtttgtatcagatattgaagtcataaatagagttcactaaaaaaaggtgatctagcatgtgaaaaggaaagcaaatgacggggatttaagaggttagaatgaggtagactaaaagcagcagtgcataaacagtatccattataattcccatcacaaagaagttctgacaataatatcaaaccaagagcatgacctctttccctttgtacatatcccaaaagatatctattaaatgctcctcttctagtgaaaatgtcattccagtaaaaaccacatctttgcagtactttagataagaatgaacttccttcgaatagtctgtacaataagaaaacatctgagttaattttgcaccattaacatgcattttgcaaaggatgccaaatatatataatataggatccaaagttagaaatgccagaaaatatttatcctcgaaactaaaatgcacccactctgtttttgtttacttggcacttttgactatttgacaatcccaaagcacaccttccattttgccctcattaattgccaccagaattagagggtttttcatatgatataaaaacaaatgattgcctaaataaagctgccttagttgcaagtgtaaaacaaacacaaacagaggtcatatatggccacatgagatcaatcaaccacctacatatgcacacgtcaaaacaatgtgttcttctcaaaacaaaaacttaccaacaaaacacatgtctacatataaagacagtatcttgcagactgaaaatagtgtcattgaagaatgcatggaaccaattatagcatagaccaaaactaagtcacaaaagttcctggatcgatgggttgaggaactggaacaaggaacgtaggacgccatcttctaaaaacatggaacgagaggggtatacatcttctaggaacgtgttcctagtttttttggaacgataatcaggaaagttttgctatattttctggaatgagagtgaaatcagtatgctctatcagcagatgaaaggagaaatctcacaaactaagctcattgggccatgtgaaagaaatgaaagaagttaaatctacacattgtcatttgcacaaaaagaaatgaaaaaagcatatcttaattggagatgcaattaaaggtgctccaatattccgcatgaggttgaactttttctgtaacattctttgtcgatatgctgatatgataaccttttataggactatccacaggtaactaagaacagacaagtccatcagtggaagttttgtgcattatttttgagacttcacaatggcagtggctaatgcacaggcccaacaagagcaagtctatggcattagaagagacaagcaagcattctggagctctttgttctctgggtgaggaactattatgtataagatccagaaatacgcaaatttattcattgcctaagcacaagctacaaatgccatctttatgccgattaattacctcttccatagttagacatagttatggtttcccttcaaaaacaaacatagctatggtgctagtataagaaactagtttaaactaaaaacgatcagcatatgcatgactaaacctgatgtgagtttagcaaagaaatgataatgtggaattcaaacaatgatcatccaaagttaccatgtccaacattgattttatcataagaagctgcaagagtgcacaacagttctcttgcatcaaactcctcactgttgttgctgtcaggctctatagaatgtggtgcacttgcttcaggatcagatccaactgcattttctgtctgagcaatactctagaaaggaatgaagttcagttcatcagtatttaccacaggttctaccacatgacgtaaagagcgtggcctatatggaaaactcacctcccatatcccttgtccgttgatgccatacagaactcttagagccactattagtatagccattacacaaacccgtgagggtaccctgccaggattactggacaaccaaagttctgcaggcattgcccactcatagatgcgacatgcatgaggaaggattttttcaattggaagagataactccttcaagaagcgctgagcaatcaagtagaaattaacagaaggaagcaacagtcctatcttttgcgctatggacccagctgcagcttccagctgccatgctccaatcactcgagttggcctaaatagctgccgtgaactcaacgggcagtcgtttaaagaacttccaagaagcttgtcgacttgggtaaacgctgccacataaggaagcttcccctccattgcccacctgcaaatgtc

SEQ ID NO: 56174 - DNA, 3165 bp, Oryza sativa
gggttggtggcggtgttctgggtggaggtgtggatggcggagcactgccggcacgtgaaaaagccgtcgtcggggtcgtcctcgggcgtactcgaagccatggccgcagtactcgcagacaagatggatgccgccgcccccgtagtgacccggcgagccaccgccgtcatcgtccatgggagggatttttgtttgatcttcttgcttgtttttgctcgctgaaaggggcggagaggcccgcggcggcggcggcggcgacggccggtgagcgagagcaaccgagcggcggcgtggaggtcaggtggggttttttttggggaaaaagcgtgtatttttgtgggaacaatcctctacctgctggttttacaacgcaggtaaaaaaaacaaaaaagaattttcacttctcgcaattttatactccctctatcctaaaatataaatatttcatccaaaatccattatatcttgggaataagaaaatactaggatagatagagtattttcgtgattatgggtaagagcgagggccttcttgcggaattgtgtggcacagccacacacacatgagacttgagagacgcttgtttagagatggcaacacgatttgatcaccgattttccgtagtgaattcacataatggggatgtggatgattgatatctatcatttatgggaaattatattgtctaaaattcatcatcatcggggatgacaaaggtggggacgacgctccaccctccgtcctcagccccccacggtgacccgcgttatgtatgaaccaattctagactttttcagtcgtaatagcttggctgacccataaatttaaggcccctagactaagtcaacccttagtctcattccccatctccaccactgcaccgatccactgcgtcgtcgccgccgctccagactctagatgatttgttgtttaagcagggacgagggcaaccacggggaacgaattcaccgcacaagggggaggggaggggatgggggggaggggttgggatggataaaatgtacccccgtcgtggtgggcgggggtggggacggtaaaattttaacatcgtgaggacggggacacgaatgtgacacccgatggcgaaatatccgttgccatctctacaagggtgtcgttattcccctgtttgagcgtttgaaagcaagtggggtgggttgtggctgcctgtcccacttcctctatgtctgttaagatttatgttgataatccacatctcgcatatgaactgttaagagttaccactaaagcccgtgaactagcccacaatctattttccggtggctagctcttcttctttgtcaataggtcgataaagttgactacacaaataatttttctagatgagcagtcccctagattccaggcaacccataagttaccgtgcctaaaaaaccgatcccttgagaaccggttcacataccataggcggcaatcgatcttcacgtgtggtcgcctcaagcggccagcatacgaagacatatctttggcgtgtggctgggccacccgcacgcgaagatggtgatcttcacagactttttgggacaggcggtgcgttcaatcacgcatgagaatatgtttaggccatttgcaaaacctgtttttggtgttagtaaagttattaaaaccaagtgaaaacaattatgcatttttttgggaaaattagttatgtctttgatcattccatatagtttcacttgagcatgtctacttacattatctatatgctctatatagttggcaacaaaaactaaatatgcattgagccacgtcaccagcaaaacaagagccattcgatcattttcatgcgccatcacaaacatccagtaggcattaaatatcgccagttagtatcatttttcattcatattcatttgaccacttagtgtagtatgctgtaaaaaaacactataagaagtatttcacttttcatatgtgtcaacggggatacccgtagaccagataaatagggtattggggtacgtaggcatgatgatctatacgatacgacatcaaaacaaacagagagacaaagattatactggttcagacccttcgtaaggtaataaccctaatccagtttatatgagattgatatggaaaaccacagagtacacagagaacaaatgaatccggcgagacccttgtcgagatgagtcgacgagatctcccggtgagtaggcttcgcgtcctccggctgcgtaaactatatatggtgggtgtgttggcgctatgattcgatgatctgaacccctcgaggggtgtgccttttataccgtgagttgccttagtctctaagtacaactcggagacaatgaaccctacacgatatagaataaatccaatcctctctgagtaggactctgttaatcaccagcccatgaggatattttctataatatcttgtagattttcttaccgcatacgaaaatatatcgtatggacaatggtataccatacttgtatatttcgtaagtcatagataggaggtatgtcttatccgtaaccatgacaatatgtgaggtgcttttataggttcataatatttctcatatttatacattaaaatttggggcaattgcatgggtgcccccactttcgaagccaattgctgttctaccctcattttttagggtttgcagttttactcctactttttgaatctgaatcagccgtgtacccccacttctaatagccggttttaacgacgttagttgtagaaaaaaagacatttatacccttggtggttattgcatttttgcccctatttttttcagctttgtgtgattttgcccctattttgtgatttcagcttgtgtgatgagcatttcgaccaaatatgagcatctcttgtgatgtttttttactttaacaaaaaaaaaatcacaaatactatgcaattacaaaatttgaccaaaatttgaacaaaaatcacaaatactactagcactcatcgtcgatgctagtctggacgacgacacatgcgttggtgaggaactgcagtggcagcgcgaggtagtcaaggcggaggcgcgaccgtcgacggcgaggggcgacgccacctcctcgagccacacctggaggtaggcggcaacctcgacgcggccgtcgctgactcgcgcgcgcccatggctgccgtagcg

SEQ ID NO: 56175 - DNA, 4726 bp, Oryza sativa
ctggtcacctatttgttgcttcaccgggaagtcttttttgtggatgagggtgtcatgtcctgtcttcctgaggcctcctctttgcacgtattgggcccatgcttcatctatcgctagttgaattggggtccaatcatatgcgttcttatcaattctggagtttaggtagtgacatgtactccacttaggtgttatgaccagaaggatccaatgggcactgcggcattaatatagtgaaagttaattaagtactgaaggaatgtgtcatgctattgtgtatatttagataacacacttactattgattataggcgcacataatgtactccttgtctcggcgggaccacaaggtgtcgtagatgtagttgaccattccttgacggtcattctggagatttgtgacagtgaccacttgtggatcaaggaaggcaagttctggtgcattcttctgataccattgccaacttaacctacacacaggataaacgatcttgtaagcgagttaatccgattgttattaccagattgagttgggcgacaatacttacaaggagtagcacttaaggaggcttgtgtcaaccgctcggagcctgtagaggtcgaatagatccttgaagtcgacgacgatataatttgttggaccaaggaatggctttccatcgtgctctccaaggatattggtagctttattcggcttcctggcgttagatttctccatgtagtatgcgtgaaggtccttgcaagcggtgcccattgcggcaagcacgtcatctccaaccaatggcatgcctagttggaactcctgtggagtgacgtattttttcttgacctctttgcccttagtctcttcctggccctttcccagatctagcttccttggagctagaagcgaggactgcacctttcctccccttcctctcccctttgcttcgggtttatcgagagtaattctctgaggggaagagtgtgccttcctgctcttcttcatcggtgtgggttcatgaatcgccttgctgtcggcctccgttcggtcctccccaaaatccgtgtcgtactgcaattgcacatcgtaagattgtgcatgacgatcttgagcaggaggggctgaaggagcagaggcgggtctctttggtggacgaccgcctggtgcagtggttggcctcgctgtaatcttgatctcaatgaggtctttgggccattggatgaaggtaccacgggcatttcctagtgagaggacctcgtcattcggtggatactttagtgggaatagctcatattccggcttcatcgagtcgacttgaacttttgcacagtcacccctgagttgcgctccatgcactcttgtctctggggtcggcttgtacgcaagtccctcggctgctggaaccgtgaaggtcggcatcaccctaactgtgagggtgcagctcgttggttcctgcgatagattaatcaattcttttagaatattatatatcatatggactcgttaagtctttcatgcattgtggacgaaacttttaccgttatgtggtcgacggcgctgtcgaccgatgttggattttccgccacctcagttgatgcgcaactgctgcgtttttgggtgggacttcctaactcttcgtgcgcagcagcagtggcagcctgggggttctgttgctcttctcggatctcttgcctaatcttggccctcatcgactcgagcttttcgtcgaattcagatgtcagctcagctcttatcgacgcccggatcttggcttcaaggcgtgcatctttctccgccttgttggaagtccgcttcttgtactgccacgcgtagtctggaaatccatacttccagggaacagaagacccaacgccccgtgtccgtccacggtgttccttgttgcccaatgctttcgtgaggaggtcgtcctcacgtctttgagagcaggcctcttgcgaggcttgttgctcggcaactaactccttctgcattacaatttagtggggttaaataaactgcacgatgggaaacaatgcaaacatctagtttgactagacacttactatagcttcgtatactcgttgatcttctgcatttggcatgaagattgtgccatcatcattcttctagtacctggccctggcccagttcctagcccaagggtgtgggatatcaccaaacacgagcggtgtgcacgattcctccgcttcttcatcctcacgctgccattcctcttccttaccggcatatccggcggtgccaagccggtgcggatgctggtttctggtctggagcaagcgatatgcctcgcttctagctctggactcgggggtcgacttcttcgcatggaattcctcccagacctgttccgtgatccaaggaaatttctctcttggatctggattcgccgggttgtagacgaactcgccgactagcttagtcttgaagttcttccaagcattgcccataaccttgaaagcagcgcgcctgagacagtcctcatgctccgcaggataatcaaagctctccttgaacgttagccaaacaatgtccttctctacggccggcacgagcttgatgtcatcttgcagaatactgaatttctgcctccctatgaccccgcagatagacctaaatcggctcaatattttccttggagatgtcggcaaccctacggcgtccaccgctgttatgcggaaccgttccttagggattttgttccctgtcctaggagtacgtgcccttgaggacccactagttgtcgtcgacattggttcgccttgctgagacatcgtctacttttttctaaataacgaaaatacactattcagtgcttcaatggctaagaatccaaagttctaaaatctattagtcacataaataaactaaattgcacatctcacagtaataaaatgaattgaatgtcacataaaaataaattaaattgcacatctcacataaataaacctaatgtcacatcacatctccttctaaatttcactaagtcccaagaatcctaataatcctaataattccacatatcatcaagtcctaaaatcatacattcaccacatttcatctattcatccgaccacatttcatctattcatccgaccacatttcatatattcatctattcatccacatgggcggcgcgatggaggactaacctgagcacggtgagaatggccggtgtggcttggtagcgggctcggtggaggcggcgcctggctcggtggagggcgtcgccggtcggtggaggcggcgctaggctcggtgcatgcggcggggtcggtggaggcgccgggctcggtggaggcggcggggtcggtggagggtgtcgccggcgaaggatgacgatggcagcgaaggaggagttggcggcggcggcgccgggctcggtggagggtggcgccggtcggtggagacgccggtcgggcagggcggcgccgggcgggcagcgtcgggctcggtgggggtcagcgacgtgcgtcggtgaggacgcgggaggtgacgacgaggaaggccgacgccggtcggtgtagaggctcggtggcggcggcggtgggctcagtggcggcggtggtgggggtcgtcggtgaggaggcggcgtcggtccgaatggagggcgacggctgcgggctcggtggcgacggcggcgggctcggcgatggaggatgacggcggcgctagggttctaaggaggcaggaaattgtagcgggacttagaaaaattttcgatccgatctgagaaaccctagttatagtagagtgatgagtcatctcaatcgggctttgccatagggcccgtcacaaatgactcatctgtgatgggctccatactaatgcccgattgagatgacattcaggcccgtcacggatgactcatttgtgacgggccctaagataatgcccgatagagatagattaatctctatcgggcttaaactaaggcccgtcaccgatgactatttttctatttttcccatcaagtctttatatttgtgagtgcaaaatatatagctgctatataataattcaatttattagtcaaaatatattttcggatagtaaatgatttcaaatcgaaatatggtcaacaacaaaattgtagagcttattaagatctacaacttttattttagtcatttgtctatataactttgttcccaacagcttgaaattgattttgaaaatatgacaaatctaaacagcatttgtaaatacaaaatgatttcaaatcgggcgttagtatagagcccgttacctatgagtcatctgtgacgggccctacggcaaagcccgattgagatagattaatctctatcggccgtaaactaaaggcccgtcaccgatgacttatcaagatctacaagttttattttggtcatttttctatataacttttttcccaacatcttgaaattgaatttgaatatatgacaaatataaacaacatttgtaaatactaaatgatttcaaatggaaatatggtcaacaacaaagttgatcctctcatcaggatctacaacttttcttttggtcatttgtaataaaacaaaattagccatattaatgactacacatatcaagtctttgcaataaaacaataaaacaaaatacttcattcattacaatagataagtacaaatgcatcggtcacaaggttatgccttccgtatgatctgaacgagcatatgccacatgctcttggggatcatcgtcaaggtcaatgtgaggtct

SEQ ID NO: 56176 - DNA, 1256 bp, Oryza sativa
gcgctttccatccctcacgatgtgcatcttcttgtttgaagggtcttttatgtagaatatctgctcaacttgtttcggaagtacaaatggttcatcagtgtatcccacctttgatagatctactaaagtgaaacctttcttgtcggctttgacaccagtgcgtagattcacccaacggcaacggaacaaaggaaccttgaacttgacgtagtttagctcccagatctcctcaatgcggccgtagtatgtgtttgacccaacttgatcctggaatgcatctatacggacaccgctgttttgcactgtgcttttgtcatcttgtttgacggtgtaaaatgtgtatccatttatatcgtatccttgccatgtgtctacggtccaagacggtcccatccccaacaactgtactgtctcatttgggacatctgtggacattgtcacatgattcttgaaccattcgttgaaccgagaattatgttctctgttaatccatgcatcagatcgccccaagttctcatctcggattttcgctaagtgctcctcaaagtatgggccaacttctgccatatgttggagtacagcgtaatgagcctgcgcgtacgacgcttgatcgggcctaattcttttcctttcgattgtgccaacacctgacaaccttccctcgtgacgagacgcaggaactccgataggatcggcatcggacatgtaattgacacagaactcaatagcctcctcggtcgtgtaaccttcaatgatgctcccctcgggtttagctctgttacgaacgtacgactttaaaactcccatgtacctttcaaacggccacatttcccttagaaaggccaggccacatagttttgttagcttcaccagatgaacagggacatgaaccattatatcaaagaaagatagtgggaaaaacatctccaggtgacaaagggtattcacaatatcggtcggtctacaacccatctagatcttctggatctataaccttctgtccaattgcattgaaggaggcgcacagacgttggatcgtgtgacgcactttcggtggtataatgcctctgatagcaactggcaagatttgtgtgattagcacgtggcaatcgtgagacttcattccaacaagttttagatcatccaatttaacatacttacttatcctcgctgaatagcccgatggaactttaatatccttcaagcatgataacattgcaatcttctcatccttcgacaatgtgtggcaagctgga

SEQ ID NO: 56177 - DNA, 1242 bp, Oryza sativa
acctgtcgtttttgtcaaggagttaaatacatattatccttgacacatccacaacaggacaatcacttagcttgcataagatataccggtctttttcaaccttatattgtcattgtccgtcaacttggcttgatagtgtttattctaatattctttatatattgcttcttattctatcatattgttttaactaggttagacgcctcttatgctcagcaagacctgtggcaatacagacacccaataatcctagtgtgtctgatcaggatctacaacaggttctcttcatgctatttgattgcaattactgactacatatagtaaattatcgtttcacctaacaactacatttattatcacattatattattgtttctgcttaaattcgaattacaagaccatgctcccattgtcactgtgaccttcctccatatgctgtgcatttccgctctgtggatctttcatttctttatgatatgtcatttcagttttcttaagtatttatatattcaaaatactggtaaaaaccattttttgtcagggtactaattcagttcttatcgtgatctcaacagttatgagtaaccttgtcccaacttatttcttgtattttcagcaacaactatggaactttgcacaaagaacaacagctttaccttttgggcgtggggcttttactttagctacaacttacacactgttaacagaggtatgacttcacagtcattataaccggatggttatggttgcatcttatccagtattttactaccttggccagttgatgttctctatgtcatcttgttatggggccattttcttttgctgcaggctctggttttcccaaagcttgttttggctggtcggttgcctgcacaacagaatgcaacagtaatgttacctcttatgtaactcaaattttatctgttttctggtagacttgcattctgaagaaatcaactgttcacgtcgccatgtagcattaatactgtgatataattgcaatatcactgcctatgtcatgcgtggaacggggcctcccctattcatgacagaaaaacaacatatctggtactgctgcatatgccagtcttagagatagcaacccatattagttaatgatatgaagctacctgtgatatttcagggttggttggacgctctttttagtccttttgattggctactcatgtcagctgtactctatttaacccgtttattaacaaagcaacagaagctaag

SEQ ID NO: 56178 - DNA, 5003 bp, Oryza sativa
  unsure (1)..(5003): unsure at all n locations
ttgaaaatataaaatttatatgaatagatttgtcttgaaaaatactttcataaaagtatacatatatcacttttcaataaatattttttatagaaaaaagaagttaaagttgtgttttggagaccgtgtcgctgtcctaaacgacttcctttacgagtacggagggagtacaccagagttagaatgaatcaagataatcttctattgtgggtttctgccttttataatttattctttgccatcttgttgtcatgtagtctgtaatagcaatttcttatccctgtcacctgctattgagtgattgatcattcatgattataagcttttacctaatatttttttgttgtaattttttatcaatcgggtaagctacattccctgcaatttatgccttcttgcaggaaatattatccatctgctcttaaaattttcatattttctattcttccagtcagcagcagtgatgggaattggacttctctatgaagggtcagcacatgcattaaccatgaaaattcttctggtactttcttggccgtgctatatgattgggattcctttcactttctgttagttttcttttagcaaaggatcacttcatttcagttgtccatgacactaatgttgagagggtaagggaaaggacattagctacccacaaatatcaattgttcatcacattttgtctgcaagagttatatacacacacaagacagtcatgagtgccccattggccaatcctagactatggggtaaagccatagtatactataaacatatctacacttaatcttttcctttggcattcaatattctatcagttcgccagagcagaaatactaaatatgttccttttttttaatctcctgttggagttggatattttgccctcacagcggtttcatatctacaatttttttggtttgtttggggctcagagggagatctgacactgacctatccgagtggattgtagaatggctttaggtgaacgagggcacaaactggcaaggaaatagtctagagtagctggttaagaaaatgatctgcagaactgtagggactatgagacagtgttattcatccttttgctttacttaataaatctgctgtccacttaaatagaatcatggatgtaacaaaccaatctaaaagacactaagggtacaaagaaggatataattgaaccaaactaaagataaggaaataattgaactaaactgaatccgaagcaaagtctaccagcttcttgggctatattgatgtggcattgtgcacatgataatatatgaaccaatttggactaggtcatatttttttttccttttcctaatgttgtttctttttacttatcttgtgctcattacattcagggtgagattggccgaagaagtggtggtgataatgtgctagaaagagaaggctatgctgttgctgcaggctctgcattaggacttgttgcattaggtgaatttcgtttgacagattcatgttgcatatcttaagctggcacttcagcacaaaaataaccgaagcttttgttgaaggtcgtggaagcaatgctttcggattcatggacactttcctggaccggctttttgaatacattggcagtaaagaagtctaccatgtaagatcttattagccctttatccttatttatctaatgctgagtgctgccctaagatggttggttcttaatgcgtatttgttcaaagcatgtcatgacttgtgagttttgatagtacggaaagaatggagataacaactatgctcaatgggatgacaagggtctgtgcattcttgtcacctttggcagagtggtgagaagatagatagattgtgttttttttttcttgattgcaagttttcaaccataagccaggagcccaggagtagaactactttaatagagccagccctaatacaaactaagatgaaggcttctctttaagcctggatggcgtctatggcttgctgtgccaattcacgccatccagtgtatctcccccctctcctacacacagtgtatctcctcccactatggtactggtgcatactacatggtccaggagacaaggactttgtacccccattaacttctacctctgtttgataccttttgctttatattatggcattctcatcttgtgaagcaattcagttttgctaatggttttataaattattgttaatattatcaggaaaaacacttaaatgcagcaatagctgctgatgagcaaagtggcaacaccggacaggtactcactctttgcagtcatggcacatccataaattacatgtgaaccatatatttcatttctgttactatcttgtttgtacagatgatggaaggagcacaaataaatgttgatgttactgcacctggagcaataattgctctagccttgatatttctgaaagtaacatcacttagtcctttgtatcctttttaaatcctctagaaacagtctacattttagaaaagattcttagggttttgcctaactaatgcccattttacaggcagagtcagaagaaattgcagctagactcagtgttcccaatagtcactttgatctgcagtatgtgagacctgattttgtaatgcttcgcattgtagcacggaatttaatattgtggaacaggtaatcttgcaatttcaatctgaaatcttagtgtggctttgtgataaatcatcaacggacttccagtaaactggcataaagctaagtattgtttttatttcgtagaatacaacctaccaaagattgggttgagtctcaagttccttcatttgtcaactttggtgtttccaatacgagtcaagaggctatggacagtgatgaattggatagcgaagctctgtttcaagcttatgttaatattgtcactggagcatgcattgcacttggtgagaaatcaacatttgttctgtaaatccctttcttcaccctatccctgccagtattactatactgcttgctatatgtgatctgggagtctggaaatagcatttatatgtgttgactttgtcccacgtctgcttgtataagtgggtgaatgattatctgatgattctgagtaaatctgagagcaggattgaactagggacaccttttctctgaaatacatgttgccctttttcacttatccattgaccagtgcttgtctaattagtctaaccatacctacagataggctaaccctcttaaccttcattttcccctctggaattgttgagcttttcttttgcttaaaagttgactttaaagctgtccctcttcactgttttggacgggtggatcaacatcgagtacttctttcagttgagaagagatatctattggcttacgttaactcctagggaaggaaacacagaagctatagcctattatatagctcaactctctcccttcctgaatttgcagcaaagcttctctatctgtcattaaaggcatggcctgttgctgcagtatgccatctcctttgccgaactatctattatttattgattatgggttcattaaacaccatcctggttactgccttcgtacttctggtggcactgcatttcattgatagaacttacttaaatttgcaaatgcacaagactattggtgttggttaaccagtagaaatggcattaaatattcttatgaacctagcaaatttttctgccatttacagcagttatcaataatttcaggtctcaaatatgctggcagtagaaatagtgatgcccaagaactactctacgcttatgccgtccattttctcaatgaggtaccgacatacatgcctatccaatgttgttcctatattggattctgataatattgttaatatttcttatgcagatcaaacacatatctattcagactgcaagcatattgccaaagggattgttgcagcatgttgatcgtggaactcttgagctctgcttgcatcttattgttctctctctatcactggttagttagaatgcatatttctctgttttatgtataacaggtacaacattcttgttgtatttcaagcttttcatgaagtcttttagctttacatatcttaaatatgggtgatcattataataaaatcaattttctcgactttgtttttgtaatttgtgtttcttttttgttaggtaatggcaggatctggacatttacaaactttccgcttactgcgttatctgaggggaagaagttctgcagaaggacaagtaaattatggactgcagatggctgtgagtattattactgtcatgaacaactgtgttctctttaaattcaaaaccagatgaggactgattatttcattgccctttttagaagtctaatggggcaactttttttgaattattcctgccaaaagaccctccagattcctgtaactaacctgggactatttcaaccggttcattctgtaaatagcatctttttatgtttatatttgacctgatgttcatataggaatcctggatagtttagtgagagcttgtctggtttatatgcccaagtttgcaaactgtactcagatcttagttaccatatggttaattcatcactgcatgaagttcaaatataaatctgccaatcgcagtctgttaacattctgatagcttattttgtgagaacactgagcaatctggacagatagctccggcaggtcatttacgatgtgtaggtctatctgtgcatttacctgtcttgtctacaatgcaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56179 - DNA, 732 bp, Oryza sativa
ctgcagcccggcatccttggtcgggtaggaatttcatggttatttccagggattttggccctctttgtttaggcttaggcttattggcctagacttttaagtcagtttattgacttatatgatttataagccagtggatttaatgtcctaagtttagtggtggagtcatacatctatctcatataagccaaaaaaagcttctccaacctagcttttggcttaatagtgttagagtggcttatggcttcaaaaaagccaaatgaaaaagctgcttgtttgttttggcttaaactttttgacttataagttggcttataagcctaaacaaagagagcctttacatcaaggagctcatttttcatacaaatcaaggaaaaaaactcatgtgtaccaaaggaagcttatgtttgagttcaaattggtccaactacactgatggggttgaaagaggtcaaaggccctcaatggtttagctggctgcggctgttgctgttctgtagctgaagtaaccagcaatagagctctattgtggttgtgcagctgcaggtaggtaagttgagtactacccccaaacgaggaagcaacatagtagaagttagacggagatgataagtgaggacatctgcttagtagtgcccaactagtggtggatactaccaagcttggaggaaataaatctcgagttccttatgtttttaaacatagggaagagaaaggagaaataagacatct

SEQ ID NO: 56180 - DNA, 5960 bp, Oryza sativa
taacatcacaaaaccagattggcattgtcgtgaggcagctacttttgcatttggttctatccttgaaggtccatctgtggagaaacttgctcccctggtacaggctgggtttgacttcctgctgaacacaacaaaagacccgaatagtcaggtaagggacaccactgcatggactcttgggagggtatttgagctcctgcattctccagccagtgcaaatccaattataacaagcgcaaaccttactcgtatcatgactgtcttgctggaaagtagtaaggatgttccaaatgtggctgagaaagtctgtggagccatatattttcttgcccaaggttatgaagacgcagagtcgatttcatctgtgcttacaccttttcttcctaatctcattgctgctctcctttctgcggcggatcgtgctgataccacccacttcaggcttcgtgcatcagcttatgaagcattgaatgagattgtgagagtcagcaacatatctgaaacgtcaggcattataggtcagttactgcaggagatcatgaggagattgaatctgacgtttgatctccatatactttcatctggtgacaaggaaaagcaaagtgatcttcaggcattactgtgtggtgtactgcaggtcatcattcagaaattgagcagctcggatgctaagtcaataattgcccagactgctgatcagttgatgtttctgtttctgcatgtttttgcttgccacagctctactgtacacgaagaagcgatgcttgccatcggtgctcttgcttatgccactggtacagattttgtgaaatacatgcctgagtttttcaagtatctggaagctggcttgcagaattatgaagagtaccaagtctgttccatctctgttggagtggtgggtgatatttgccgtgccttggaagataaaattttgcccttctgtgatgggattatgactgttcttctcaaggacctgtcaaactcgatgcttaatcgttctgtgaagcctccgattttctcatgctttggagacattgctcttgctattggtgataattttgagaaataccttccttatgctatgccaatgcttcaaggagctgccgaacttcttgctgttttggaccatacagatgaggatatggttgattatggtaaccagctcagacggggaatctttgaagcttactctggcatactccagggtataaagggtgcaaaagctcagttgatgataccctatgcaagccatctattgcagttcactgaagctgtctacaaggaccgcagcaggttaatgtcatgcacattgcaatttatgttgtattatattggtaagtttttacctgcttagcgcttacatacattacatttgtgtttatactttcagggatgagagcgtgacaaaggctgcagttgctgtcctgggggatcttgcggacacactcggctcaagctcaaaggatctgttcaaaagcaacctcttccatgttgagttcctgagggagtgccacgatttggatgatgaagttagggacaccgcgtcatgggcccagggaatgataaaccaagcactggtttcttaagaggggattattttgttttgtcagttattggggaggtttcttttgtggctgtgccaagaccatttgccacagattgaacgaaaggataccaacatatatgtagcgtcagtcgtaggctgcttctgtgcttttgtcgtcagtctgtcaagtcagtttatgcgtcgcatttggcgtgggtggattctggcattgaatgtcttgaacagctaaacctgttaatgttaatgtattctacctgtggtgtttatccattcgattctgctgatgttactgcctgcctaagagcaagtttaatagtatagccaactattagctctaatttatctatagtcaatttattagctcattcatacaatagttacatattacactattaatatctggtcccacatgtcatacacacactccttcttggagtccgtgctacagctggctacaaatctgtagcctgctgctcttttttttcctcatttatctttttaaaatatgtttgtaactggcttatagcttgctaaattatgctattgtacctgctctaatactcttatcatgttcaggtgatattaaagttgccagcctgtcatgtgtatttgcaaatgcaatgttcttgtcaattgtcatccttgttggcaagtcatttcaaacttgtcaagatgttggtttcagttatatactagacgttgtgatgctaccacacaactttgcttttgttgatactcgttgaacttgtatatgctttggtttcagatattatgtgcaggatgaatgttatgcagaagctgtacagctcaggtagattggtttgtgaaactacacaaggttttacatttcaatctcgttaaacacctcacaagaatctgcacgcacactacatatgaaatcccctcattgttcatgtcatatttacagatggatgcaaagtaggttcatttcaagagcaaagttacaaatactggcacgctggtcaggctgcctcggtggagatgatctcgagctcggcccaccagagcggcgacaccttgggggtggcggcgtcgggcggcatggcggtgatctccctgagccgggccgcgacgtcggccatggaggggcgccgcctcgggtcgcggtcggcgcaggaccggacgacggcgtccaggcggtcgacggtctcggcgtggaaggcgccccgcagcgccgggtccatgacgtcccgcagccgccgctccccgcggaggagcgccgccgcccacccctgcaccagcccgccctccgacgccgcgagccgccccgccatcatctccagcagcagcatcccgtacccgtgcaccacgctctccctgtccgccatcgccggcgccgccgccgccgccgccatctcctcctcgcagaagcccacgtcggagatcttggcggcgaagtcgtcggtgaggtagacggtggaggcgtccagcgtccggacgatctccggcggggcgagctggtgcatgtgctccaggcagtaggcgacgccgaccgccacgcgcagccgcgtcggccagtccaggtgcccctcgtccctcgctgcatttcccaccgtcaatgtcagctgccatttttcgtgcttgctacaggtcggggtgtcgaagtaggtagaaatccaaagttccaaagaaattaccgtggagatgctcgaatagtgtgccgtttggggcgtactcgaacaccatcatcctcgtgaacggctgctcctcctcgcagtagccaagaaggttcacaaagttcttgtggttcaccctcgacaggctcgttatctggaacaaccccccaacacaaatgacacaatgttaggcaccgttatctcgtaaactttttcacaggaatcagtgaatcagttcaatttcatagggacctagggaaaaaaataatcaagtattgcattattggtagtcaaaattaaaataatatcaagggaacgtatcttacacacactaaagattctagatatgatttgtgcatgtactctaattgacaattatttactctggtttttaatacataacgtcattgaccattgtccttatttagcttttctttgcaaatatttaaattacatttaatgataaaccaattcacaataaaataaacaataataatagtaatatttacaaagggaggcagtagtaataccttctttctgaagtgtgcctcgcacttcttggaccagtccttgggcgacgtcttggtggtggagacgacggcgatctcgacgccgctggagagcgtccccttgtacatggtgtactccggcagcgagccgatgacgttgctgaagtcctcgcacgccgcctccagctccgccctcctcaacgccggcacccccgtcacgaacgccctctgcagctgcccgctcagccccgtcgcccacgggcgcacgctcctcaccaccttgctcgaccggtagcacgccgcgaacgccgccgccgacgccgcaagaagcaccgacgcccccgccgccgccacaagaacgtagttcgtcttgccgccgccgccgccgcgcctcgttgcgctcccgtccgtcacctccggccggctggtttcgccggcgtcgccggagctagacgccggcggcaacgcgatgctgcgggggcgcgcgtgttcctcgccgcgccgcggcggggccgcgtgctcggcgaccgcggccgacgacgctggcgaaggcgcaggggaaggcgaaggcgagggcgagctcgacgggccctggaccggcggcatgtcgagccatggcggccagtccttgagcggcggcggcggcggcagcagcatcgggagtccgaacgggttcgacggcgtcgacgacgtcgacggccatccggccttgctgccggcctgcctgctccgctgctgctgctgctgctgctgcgaagatgatgatgacttcttggcatggatcaacctgcgaatgattgagcagagatgaggctaaagttgacgagcaattggacaagaacatgcgtgcagcccggatggggtcgaatggttggttgttcagctgtccatctctgacagccacgacaacattcctagcacaaatttttttcctaccattctatatctactttgatttctatggaaaaatgtctttgtgatgaacattcacggataattcaggcaaatttggcctatgcttgttcaaatgcaggggaaacttgtgatggaagagaagaagaaattatgcccaagctgcaacctaattataacactgtgaattattatttccttaaaggaaactctattattgcggttttttgaaaataaactttattactactgcctataattaagagtctctgaattttgtcaaaatttagactgaaattcagggcatgtacgaacatgaaagtgagccaagaaaacatcaatcgttctcaccgagctgcagggcgcacgccttcattccaattcgccgttccatcaacaccacatcataacaatgatttcaaaacatacacaaatcagctaaacagaaaccagaacattcttggacaagctgatcatctgaacaaacaaaaacaaacatacaacacacacctcgccgagcaccatggccgccgccgccgccgccgctgatcccaagctgaagctgcaagcagagcagcagcagcacagccaccgccaccctgctcatcctctccatgaagagcaggacggtcttaagaagggaaagagagagaagcctgcagcaatggcgatgatgatggagctcttgcagaggaggcagggaaagcaatgcaagagagataagcttaagccaagctaagctaggcagcagcaagaagcagaggcgagaagatgatttgggcgtgaccactgcggcgagctagcgagagccacgccgcccacggcacgcggcgacaataaattcttgtgcttggctcgacttggattttttcgacctaactagtgctactattgcttaggagtatgcatgtactatgcccacttcatccagtggttggggttcttgcgataggtgagaggtcacaggaggatacatgatagtagtagaattgttacggatttcgcaaaagaagggttttaattagtgtcctaatcctagaggggggcttttaatttgtactagcaattaattgtctagaaagagaaaaaaaaagagaggtttgtaattaaaggaggcgcttttatcacgagatggtgagataggatcaggttgctatggtatagctagggccaaggtattagttattccttctgaattacttcctccgtttcacaatgtaagtcatactagcatttctcacattcacattgatgctaatgaatttagatagatatatatgtctagattcattaatattggtatgaacgtgggaaatactagaatgacttacattg

SEQ ID NO: 56181 - DNA, 2275 bp, Oryza sativa
gcctaacgctacaagatgggtatgtgatcttcgatcacagggggagttcagctttggcaaaatctggtatgactgtaatattttggccatcattaatatatataaaccatgtaaataagcgaatttcgtacgattaattattgtttaaaaaactagattctggacaggttgcgtgattttactcttggaaatatgtgctaatatggctcaagactgaggctatttaaaaaaaataaaaatagtgaattacttccaatatttgttggaaaagcgctccttttttggtaagtgtttgctacctacaaaaatttcggatgcctgaaataagaaaaataaaattggatggcaaaaaatagttgtgaagacagatctacaataaaatcattatttatcccatctaaatgtttaatagatgttgcactctacagtatgggaaagttcgattagaggttgcaccaaatgaaaattttaactacatttatgcaagtcaaatggtcaacactaatgacaaaggatgcggtctggttaattgcgatgaaatatattgagtgggccattgttcacctcacccaataaatgttcactttctactctctccatcccataatatactacccccgttccaaaatacttgtcgttataggttgtttagcatatagtaatatttgaagaaaaatactataataccccttaactaataatggataattggatgtgggatggtggttaggggtagaatagggagaaatttgaattggaagtggttgatgtgacatgtagtacttcaaaatggcaactgttttgggacaatttttaaatgctagaaagacaagtattatgggacggaggaagtaagagattttattcctactattagtcccacaatgggactttgctatactacttgtcacattccattaattctaattcaaatttctacctattttaaccttcaactacccactcgtcacaaccaaaatcacattcaatagaggcattgcagtcttttcttttcattcttaatctttcccaaaaggaaataatcccttatattatggaatggattagggagtacatagtttgtgttgcgcaatgggattaattgacaaaaccagcttgcatctctaactactaactagtcaaatttcaaactcatttttgtttttctgtttgaggcccgaattcaattttgaattttgaaaacgtcgttcacactgcttcatgtgcctcaatagtccagttatttttttttacataaaattctggctatctactcctagctagttctgccgttgaggtagttgaagaggatgagctgccaaagacaaaggggatgctagctactaccatgcatcaagttggtcaggtcaggcaggattaagctttagaaagcgtggtagatggtacatcaacaaggaaactgatgtgaggtctcatgcagatttgacaccaaagcaaagcattctcagagattttcctaacacaccgcgtgttgattgcgtcgtttgtgatatcttagtaaccaagcagattaaattaaattatgacctgtcccataaacagaggaagacaaatagacaatcccgatgggattagacaatccagaggaagacaaagagttcgtcagaagttgtacgtcgaagtgtaccgcaagctggaaacttctacgtgaactgattgaatgtgaagaactgtgtagtgaaccgtaagatcattggctcccattcggtgcgcagcctcagccagctatgccgatcgctaatttcgttcttcatttttatcaattacataggagacatgcttgttttactctacttcaaccgaatttaaactagataatacgggagtttggcatggagaaaatgcccatttaatgaaaatagataaactgtaactaaaagaatttctcagccaggttattgacactccccctcttataatgtgtgtagctccaccctcacagacacacgcatataaagtcgtagattatttcaattacgtagaagacatgcaagcgcacacagactcgatcttgctctcgatcgattacctcttgtaatataagttagttccattgacacacccatatatatataaaatcgaagattatttcaattacgtggaagacatacacgcacacaagctctcgctctcggtcgatggaggccgggggagggtggcgcgttgctgtagctagttgcatgcgcgccgctcgattgctgccgcgcgcgcgcctcattgcgatttgcgatagatggggatcggggctgcagga

SEQ ID NO: 56182 - DNA, 2306 bp, Oryza sativa
ttaagcaaacgcacaggtggagaaagcctttatagtcccggctggtaaccccctatagtcctgtttttttctaaccgggactatgaatccgggactaaagatcgctatctttagtcccggttaaaataaccgggactaaaaatacatctttaatgttaccaatcgggacaaaagatggcagcgcacaatcctggttggtcaccatttttttattgtttctttccaaatccagttgctcctcccaaatgtccctacatatcccaaatcctatccccaaatcaaagtatcatcacaaatcagattcacatcacaaattctaaaaaaatagatcacaaattttaaaagaaatacaccacaaattacatacatcacagatccaaacatcaatacatcacaaatcacatacatcacagatccaatgattcacaaattcgaaaaaaaagggttgccgctgccgcctcctgcctcccctccggcagaggggaggccactgcctaccgccccccgccgcggcccgctgcccacagcgccagccgccgtcgcccgggctcggccgtctgggctcgctcgggtatgggaggtggaggtaggtagggggaggagaggagaagggggaggaaggggagaggaaggctgagatctgagagaggccggatctgagaggaggttgttaatgagagggaggagagagagagaggaagggggagggattagataagatcgagactactggcgtgcgccgctcaggtggttttatctttagtcccaattggtataaacaatcgggactaaaacctatttttagtcccggttgtttataccaaccgggactaaagataattggggtctgaatttgacccaacaaccttttgatcgcgactaaaaatgatctttagttactaaccaggactaaagattaaattttttttaaccgggattaaaaatgatctttagtctctgttcctatttaaaccgggactattgtagtttttaggcgaccgactaaagatggtttctctagtagggacagcttcatctgtgatacatctggtaattaatgtacgtacgtgcgtgtactgatcgatctactcctgatctctggacaaatactccctctccgtcctttttgtttgacgttgatttgcactaaccaacgttaaacattgggagatgttgatatatatactggatatactattcatttatttttaaactttaactgctcgccggccgtcattttaagaaaatgcatagatcgatacttcaaaaatatttggtattcaccaagtgtgttttgtatccttaacatagatatacaatacttttgtacactataacggataccctcatctcaatcgggcggtaagccccatctcaatcgggtatggcgtccgtcacaggctagaagtcactgatgtgaagagctatctcaatcgggcaaacggctgtcacggatgattctatctcaatcgggccctaagtaaagcccgtcaccgatagctttgacccagacgaccagttaatgcccgtcacagatgagtatattccaaaaataaataaattttattttctggctagccctcactcgtgtgcacccacgtgggaagtttaaacttcccagacgaccagttaatgcccgtcacagatgagtatattccaaaaataaataaattttattttctggctagccctcactcgtgtgcacccatcccaaaattgctccagaccaagcacacttaacgtcaaagttctctagagattggcttccggaaaagtaattgtaacatgttggtatgagtattgtattaatcctattatgccctaggccaggatgtcaaattggggttattaaatgatttcaaatggaaaagtcaccaaaaccaaagttgtagaactcatcgaggtgcaaaatttttattttggtcatttctccatctgactctatttaaacaatttgaaatttgaaattcaaagtttgaaaagttcaaatagaattttagatcagtgaacgacttcaactgaaaaagtcatcaacaacaaagttgtataacttatcaatatttacaacttttagtttggtcatttttcaatataacatttttttgaacagtttgaatttgaatttgaaaatatgacaacttcaaacaacattttcaaatactaaatgatatcaactgaaaaagtcatcaacaacaaagttgaataactcatcaagatctaaaacttttattttggtcatttcttcatacgatcaagtgatagtaacattgttcataaaattgacatatctcttatctggtcttata

SEQ ID NO: 56183 - DNA, 814 bp, Oryza sativa
tcttgtgggtacagttgtacacctctgatcagagtaaaactattcgaatagccgtgcccacggttatgggcggtcaaccagattcaccgtgattagtctcaccctagtgtaatcttttgattttggatagtttaggtggatggttgggcctgttgcaacgtgggatagcgttggacagtggatagttaatgttaattaattattacaactgtttaaatctttcaacttctgtttttaaatactcgctttatgcaaagaaccactttagctcttctttgataattccctgcatcatgcctctattccggtatgacttgctgagtacagtgggtagtactcagtcttgctctattttccccaaccccagagtacgagtatgtgtcagatgaaggtttctccgaggagtaggctttgtccgtgccgtcgaggatgcctgtggagtggtgttcccgctgcagatctagtcaaggcttagctcctgttgtctttcgtttttccgctgcatttatgtaagacttttaagatgtttgtaagacgtggatctgaatgtcaacattgtcgtttgtgtaccccggccggtcctggacggggattttaatgcacattctgcttggaattctattcggaatttctgggcctaacaccaccgggccgtacaacggcagcgtgattaccgtgctcggcagcaaccacatagtggacgatgtccgtgagatgccgatcgtcgaaggcaccggcgcctttcgctttgctcgaggatatgtgcaggcacacacctatgtaggatcaaatcacaagaactaagccaacaaga

SEQ ID NO: 56184 - DNA, 816 bp, Oryza sativa
aattaagcttaaatcaacaatcaaaattcatgatttcatacaatttataatgcaacatcttaacaagcacataggttgaaaaataaacactaaacacatatacctattgcatttatcactctttctcaaataacctttagcacaaaataaccaagagaatttttgaattttttcttttcttgagcctttttgctcatatttttctcttttattccaggtacatccctgtcgtcaagactgtttccagggattcagcacccattattttgctcacatcgaatacgtccttgtcgtcaagactgtttccaaggattcggtattcatttttttcatatttttattctcttttcacaatgagcaattaaagctatttgaggaataacaattcaataaagcatatatatatatatatatatatatatatatatatatagcatttacaaatcaaaccatatgctagcatcaacattgcatatttgcttaattcaagtatagaatttaagtgtcatgcatcatctcctttaaaagcgaaatctaaatctcatgaaaagactagaatacatacaagctatgctatagacaaataaacctttaaattattgctagcatgcacaagaaaataccatatgcataaacaaagctctcttttatcaatttttctcattgtcatattattgcttgataaaaccacgaggtacaaactccccctcaaaccatgccaaaaggatgaattatgcccaattcaccacgaagaaaagcaaagcgattagaatccaaaggtttagtaaaaatatcagcaagttgtaactttgtgtc

SEQ ID NO: 56185 - DNA, 10098 bp, Oryza sativa
  unsure (1)..(10098): unsure at all n locations
cgtttaagtgagatttgtcaaaacgagtcagtctagggttttagtaaaactattgagatttattcgtcagtcagttgggatttgatgggtgaaatgcattaggtcctagctcaggaacatgggtgtagcgcccgttccgtcgtggcacctagcgggaaaattatctcttaaaaaccctaattgcgaaatttgtttctttgcttgttgtctagtgtccgtgccatctcaagatctcaaatccccgatctatcgtcgagttcaattccgaatccaaatccttccaaatcaaatccctccgcaaaagtctattttacctcccccggggtcgatgggccgaatttctctcggcccatctcccccgggggcggggcgctcgctccctctctctccctcttcccctccccctccgctccgcccgcgcgccgcgcgcgcgtgcgcgtgagccgccgcgccgagcgccccttccccgcctccatccctggcaaagcccctcacccgcgaagtcggcccccgcgcgtcgttcgcgcgcgcgcgccccgtggtcgttgcccgcgtcgcgcctgcgccgtctgcgccgcccggccccgctgccctgccacgcctgcagccgctcggccccgcagccagcgcgcgtgctctagccgcgccactcaaaccgccgcgcctcccgttgcattccgcgcgcgcgtgccgtggtggccgaccgcctggtcgccgccgtcgtcagcgcctgcccgcgcctgtcgcccgtgtcgccgctccgctccaaaccgccccgccgtcatccccgtcgtcatcgcctcgggcccgcctctccgcgcgcaagccgccaagggacggaggcagagcccctcctcccactgccgcgacgcccccgctcccctcctccttttcccagagaggcaaggggcgagctccccttttctctccctcttttcccctttttccctctcgccggcgtcacctctgtcgccgttttggccgctagccggagcgctagctcgcgtcttgaccaccctaagtcggttctcaaaccgacattgccatcccataaacccaagcctcccccttcccttcctctcccattcgcctccacgccttgtcgccgcccccgtgctctgttcgccgtcgccgttcgtcgttgcgcatgtcggaggagccggcacgagcaaggacgcggaagaggactccgggcgcaccctcttcttcctcttcctcggcccgaggccggagagattactcccgcgccgtcggcctctcgtcactgcgccccgcccgcacggtagtgcctccctccgttcttcctcctcgctccacctcccccccttagttttcggtggtagcgcgagtagcctccccgtagctagccggcgccgccccgaccattgccgtcgctcgccgtgtgctcgccgccgtcgccgcccgagctccgtagcacccgctcgtcgccggcctcgctcggcgtagctccgcccaatccgacgctagcaacggattcccgtagccgcgtagatgctctctccgccgggaattggcccctcgtgacctcgtcgccgttttccccttttctctccgccggttgccgccgccgtaatccgccgccgcaatccgccgccgacggactccctccggcgaatccgagccgttggctcgtctcccctcgtctcgtgcaactacccagtgtgctcgcttttgcctgtatcgccgtggttcgctccgccgctcgccgctgtcgtccgccgtccgttccggccggcgtcgtcgtctacctcccgccggcccgcgtggcagccacgtaggcgccacatcggcgccagctcagccaagaccaggtcgagccgaccccagtcagtccctccccgtgtgcgcattccaccgcgagccgtgaggctgcgcgtgggcccgccgcatccgcgtccaccgcgaaccgcgcgcgtgcaccgcgtccctcccccaccctagtgccgtgccgcgtgctccctccgcacggtgagccgagccgctgacaagcgggtcccacccgggaccgcgcgtggtgagcccggtccacaggctctctctctcctccctcccgcgcgcgcgcgtcttgggccgctctgggccgccttcttgggccggccggctcgttaagctcggccgagccaccctttctctcaggccgcgccctaaccgcccgagggaagtctattttccctccctctttccttttcttttcttttctttttcaaaaaggatttaattaaatccttttcctttagaccaaaaatccaataatcttagaaactcaatatcttcccaaccgtaaatccgtttgactccgttcaacttccaaaattcctcaaatctcgagatctatctaatggcacgcttagaggtctttaatagggctttattttcgccgtttgttgagttgtcccgtttcgcgtgtagtttcggagcccgaagacccgcagtgcgctgatttcgaggatcaagctccagatctcgagcaaggcaagccacctttgaacatcttgagcctatatttgaaatttaattatgttgcttgaaaaatattatgcattgataggactgcacttaagctgcttgtcccatctgcaaggcagattggcggacctacccaatttgttgcatttgatccttcctttgttaattgtgataccatgtcccccttgtaaccatctagttgcgtctcgatattcgtgcaccctgcacgagtatcgacggacgccttcaaacttaaaattttgagtaacaacttgggtaaaacttgggttttacaaaagacttggaaaacctgacacctgggtcggtgcttgcgaactaaatgaatttccaaaaccgcggaccggggaacgtaccgggtgtacggttttccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctatgacggctttggaaatgccttgtcatgaaagcttggaggtctcccgacgtggctgatccccacgggctgggtgatccgggttagtaatgtcatgtgggtaaagtgtaccccctctgcagaggttaacaaactgttcgaacagccgtgcccacggtcatgggcggatgtgaggtgattcctagcgtagttttgtttaactactgcttgtgaaattgctgttgtggaaaggggttcgatgtttgaaaaatctgtagctgatagaatcagctaggcctgggtggccgtttgaaagttgttggcccgggtggccgtttgaaaagctgttggccgggtgccaaccttgtttcaattctaaagactgatacattacacatactctgaccggacgagacgcactgtctcatccgtgtcgtttgagaagcactcacttagttgtttttagaaaagagttcaaataaaatcaattgcaaaaacaacagcctctccttgaagcctgcattaaacacttatttcccctggcttgctgagtactcccgtactcacccttgctctatataaataatccccccccccagttgctgaagaagatgaagcggatcctgctgatgaggagttcttctaggagcaagccggctacgatgagttttagggtttcggcctagttcccaagtcgcgcctgtgttgtttggtcctagtcctggcttccgctttccttttgtaatgcagttgtgagctcggggcctgtccgcagcccaacatgactgtacctctactctataataaagagacctctattgctgtgataatctgtcttcctgtgataccagcactgtttcctgggactggtatcgattaacaggttaatttggagcgtcacgggctagttccggtcggtactagttcggggcgtgacaatgggttgcaaggtatttatgctcttagtgttattattagtatgtatctaatttccccattattttatcgttatgtgagtctgtcttatttattcgctctcatgcaaaatgatctatgcataaaatttcgctcttattcgattctcttatttgagtcttttattgctttatttaaatttggatttgagcatgcattgatcctactcctttgtcttctctagatggccggccacccacccaaccaccgcggagaaggcatgattgactttgtggcagagttggcacgtatgacgctggtggtgggctaccccaacgcgccagagtacacgactgttccaccactcagtggcaagcttcctcaccgtgttcgcctggaggtccacggctacgtgggtacctgcctagctaatatggtggttgaggcatccggaggcacagcagatcacgcctgtcaggaggcagcatacctgatgatggccagactacgggagcgccacaactttatcttccacgacacggcgtaccgatttcacccttgtcgagccagcggtgatgatgtcagtactttccgttcgacagccggcgagaacgacaccacctttggtcacatgtgtgctatgatgaggggattggataggatgcactcggacctgcacaaggcgtccaaggccttgaatgatgggaagctcatgaggatcgtcgctctgaaggacgagatagcgcgcctgaagaaggagaatgctcagttaaagggtcttcccgcgccaggaggagtccggatccgcactacgccccgcaagacgacgactgcacccgtgcgcatccagcttgcgcccaggaacccacctccatcagcagctcccgcagcacctccagttccgcccgcagctccggtagttcctgcagctccagtaccagctccagctcccgttcacgtgtcagctcccgcgtccgctctctccttcgctccagcatcagccgccaggggtccagccagtggcaacggaggttggttgtctgctactcccagtggcagccgcgatctcagcagcagtagctccagtggctcagagccgggcggcggcgagacttatctgccaggctccaggagtcgctcagagggacctggtgacgagcaggaggacgccttcgactccaccgaccgcaggagccgttccgagcattaggctcgctttccattagtttatcgactgtctagtttctgcttgttagtttgtgtgtttaggttgcttgcttggggtcagtcgacggtcgatatcatgcgcctatgatatggctgtcttaataaggatttttgcttgctttttaagtgttttaattcagatccgaacaattgcagtttaaattcctatataataaagcttagttcctgagcatctgttttccttcttttcccccgtctgattttccctccagatggtttacaccaagaatggtagccgcgcaacaggcgagggcagcaacggcgaagagcgcactaatggggtgcatccccacagcgattccggcaatggtccgccaccacttcccgagaatccgacgctaccccaagtgatggcacatcagactcagatgatggcatccatgatgcagcagatgcagcagcagcaccagcagatgcaccagcggatgctgcagcacgccgaacagcagcatcagcagtttggtccccctccccctcagtccaagttgccagagtttctacgtgtcaggccacccaccttctccaacaccaccaaccctatggaggcgaatgactggctccatgccatagagaaaaagctgaatctcctgcagtgcaatgatcaggagaaggttgctttcgccacacaccagcttcaaggtcctgcgtcagcttggtgggacaatcacatggccacccgcccaccaggtactgaagtcacttgggcagagttctgccgtagcttcaggaaggcgcaggtgccagacggggtcgtggcacaaaagaagagggaatttcgggcactccatcagggcaacaggactgtgacggagtatctccatgagttcaatcgcctcacgcgatatgcaccagaggatgtccgcaccgacgccgagaagcaggaaaagttcatggcaggtctggatgacgagctgaccaaccaactaatatctggggactacgtcgactttgagaggctggttgacaaggcaatccgtcaggaggatcaacgcaacaagatggacaggaagaggaaggccgctcagttcagggcacatcagggaagtcaccagaggccgcacttcactcctggacagcagggtggacctaccaccatgatcgtccgccagtaccgcccgttcaaccctagcaattttcccagggcgccagtggcagtcagaaccaccatggaggtcagcccaaccgcggtgtatctccacgcccaccaatgacaccggcacagtcaggcccgtccgcgcaagccaaggagactggagcaaaaccagggtcctgcttcaactgtggcgagcttggccatttcgctgacaaatgcccgaagcctaggcgtgccgggccaaggtttatccaagctcgtgtcaaccacgtatctgcggaggaggcacaaacagcaccagaggttgtactgggtacgtttcctgttaactcaatccctgcaacagtactttttgattctggtgcaacgcattcgttcatttcaaagaagtttgtcgggatgcatgggttaataagagaggaacttagcacactgatgcgggttcataccccagggaatagctccacttcggttcaattcagcccttctataacaatagaaattcaaagatcaccatttctagccaaccttattcttctcgaatccaaagacctagatgtcattcttgggatggattggctgaccaagtttaagggagtcatcgattgtgcgaatcgcacagtcaccttgaccaacgagaagggagaaacagtnatgtacaaatcaccagactcaccaaagcaaggggtctctttgaatcagattgaggcggaaatcccagtggacaccgtggagaagaagttgaggaaattggaagatatacccatagtctgcgagtatccagaagtgttccccgaagaccttactaccatgccacccaagagagagattgaattccggattgacttggcaccgggaatcgctccaatttacaagagaccatacagaatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattaccgcgcactcaacgaggtcacaatcaagaacaaatatcctttgccgcgaatcgatgatttgtttgatcaactgaaaggagctaaagtgttttctaagatagacctgcgatcaggctaccaccagttgagaattcgggaagaggatattccaaagacggccttcaccactcggtacgggctatatgagtgcacggttatgtctttcagacttaccaacgcacccgcattcttcatgaatctgatgaataaagtgttcatggaatttctggacaagtttgttgtggtattcatcgacgacattcttatctattcaaagaccgaagaagaacatgagcaacatctccgtctggtactcgagaagttgaaggagcaccagctatacgccaagttcagcaagtgtgacttctggttgacggaagtcaaatttctaggacatgtcattacagctcagggtgtggcagttgacccatcgaacgtagagtcagttaccaaatggaccccaccgaagaccgtgtcacagattcgaagttttcttggacttgcgggatattaccgccgattcatcgaaaacttctccaggatcgcccgacccatgactcggttgcttaagaaagatgagaagtttaaatggacagctgagtgcgataagagttttgaggagctcaaaaagaagttagtatccgcaccagttttgattctgcccgaccagatgaaagacttccaagtctattgcgatgcatcccgccacggacttgggtgtgtcctaatgcaagagggcagagtggttgcgtatgcctcgcggcagttgcgtccacacgaagggaattatccgactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagcattcactaccacccgggtaaagccaatgtggtggcagacgcattaagcaggaaaagttactgcactgccctatgcatcgagggcatgtgtgaggaattgcggtaggagtttgagcatctcaacgtgggaattgttgaacacaggttcgtagctgctctggaggcacggcctacgctcgtggatcaagtcagagcagctcaagtaaatgattctgaaatagcagagctgaaaaagaacatgagagtcggaaaagcccgggatttccatgaagatgaacacggcacaatctggttgggagaaagattgtgtgtacctgacgacaaggaactgaaggatctgatactcaccgaggctcatcagacccagtactccattcatccaggcagcaccaaaatgtatcaagacctcaaagaaaagttttggtgggtcagcatgaggagagaaatagctgaattcgtcgcactctgcgatgtttgccaacgagtgaaggcagagcaccaaagaccagcaggtctactccaacctcttcaaatcccggaatggaaatgggaggagattggaatggactttataacaggactgccccggacatcatcgggtcatgattccatctgggtagtcgtggatcgactcactaaggttgctcacttcataccagtacataccacgtatacgggcaaaaggttggcggagctttacctctcgagaatcatatgtctacatggagtacccaaaaagattgtatctgatcgagggagtcagttcacctcaaaattctggcagaagctgcaggaagaattggggacccgtttaaattttagcacggcctatcacccgcaaactgatggtcagaccgagcgagtcaatcaaatcctggaagatatgttgagagcttgcgctcttgattttggtggagcttgggacaaaaacttgccatatgcggaattctcgtacaacaacagctaccaggccagtctacagatggcaccgtttgaagctttatacggccggaagtgccgcacacctctcttctgggatcagacaggcgagcgtcaactgttcgggacagaggtattaacagaagcggaagagaaagtcagaatcatcagggaaaggttgaggattgcccagtctcgacagaagagctacgcggataaccgccgaagggagctcacttttgaggcaggagattacgtgtatcttcgtgtcactccgctctggggagtacaccgttttcagacgaaaggcaagttggcaccacgcttcgtgggaccctacaaaatcttggaacgaaggggagaagttgcttatcagttagaacttccatccaatatgatcggcatccatgacgtgttccacgtgtcccaattaaagaagtgcttaagggtacctgaagaacaagctgattcggaacacattgatatccaggaggacctaacctatgtggagaagccggttcgtatacttgataccagcgaaagaggaaccagaaacaaggtcaccaggttttgccgagttcagtggagtcatcattcagaagaggaagcaacctgggaaagggaggatgagttgaaagccgcccatccgcacctcttcgccagctcctccgaatctcggggccgagattccgtttaaggggggtaggtttgtcacaccccgaagttctcctcccaagccaaaaatttaatttataagcga

SEQ ID NO: 56186 - DNA, 5889 bp, Oryza sativa
ctacgtgaaatctattaactacagggacatgaggaaaacgaacttccgagagcggagtaaactaaggctgtgttcgaatggacatcttgcctaaaactttcaatgacacgtaaaaggagaccagtcattagcacattattaattgagtattaatcatttcaaatttaaaaaataagtttgtttgatttttaagaacacttttatataaaaatcatactgtttagtttgggaaacgtgattacgataaacgaaggggtagtttagcctattgtagaattttctgcgtgaaagattgtaattggacacttttacacatcagccaaagatccaaatgcccgataaaatggacaaaacatgacaatgcatgcgaattacaaagaaacacaaaaacgatgacttagcttatacagagaaagatcgttgctattaagcctaagtaagacaagcacacatccagacgctcgcgtatatattttgattgaattctattatcgacaaaaaagaaaacttgcatattcgagatatgaaccaatcggaacgatgatagaggctgataatggagcccacatgttaaggtacacgtgccaaattaagttggtcccagataagaatatttcaagcaactaaaatcttgttattcatttccttcaaacaggtagtactaccgtgtaagtagaccaacatgtcccaacattttctagaactaagatatgcatatggtctaacttttgttcataactaacttgcactcgaaggtttcctgctagatcttttagatgtttgtgtatttatttcttgggaaaattatatatttacattttttatgctccaaattcaggtttaccctcagaaagaattaaggagctctaagccagtgttccattattgcaggaattttgtgggattagtttaattattttaggaatcaagaagaattccctcagcaaaaatattatttagtatgagcgatgcttatccatgtttttctttccaaacattggggcggaatcaaaatgtcacggattatgcaatcagctaataagtaaatgtttagttttacaagatcgtcttaaggtgaaaaaggacacagtgaacaccatgaacatgatcttgatatttccttaattaattaattaatacagcacagctagcccttatcttacggtttacactatcccgagttccaaaggctaattggaacattattgcaatcagcaagatctagctagccagctctctgcagaactgtagtgtactctactgtagatgctagatatcctatgaaacaagttccaaagacacaagtcaaacataacagtatatgactgtgtttagagttaggggtgtaaagttttgatgtgtcacttcggatatacggacacatatttaaaatattaaacgtagactaataacaaaataaattacagaatccgtctgtaaaccgcgagacgaatttattaagcctaattaatccgtcattagtaaatatttactataacaccacattatcagatcatggagcaattaggcttaaaattaaagatctgttttgcaatttacacacaatctgtgtaattagttattttttcgtttatatttaatactccatacatgtatccaaatatttgaaagtcaccgggtaaaaatttttgtcagggtatctaaacagggcctatggattgcatagattgtacccattttgcagcatatataattgactttgaatacatccaaacatttcgcatagattgtaccaccattttgcagtatatataattgactttgaattttttttttttggtttttcgctaaagcagggagcagcagctagatagctagcacaagtcccatccatttctttttgcatcgctgtttctttctttaggtaaagctaaagacgtaccaaagctgtggcgacagctcaaaggatcgtatctctggccgaatctttaattttctgctggtatatatatatgaatatatgcctagtagaatatgaggtgaaacttggttggtataagctaaggattttactaatcagtgttaaataaaggtccatatatatatatatacataatatgaggtagtacaataaacagtacttcaccgagtagtcaaccagtttaaagaaaaccctagttaactccctaaaccatatcgtccttccctccctccctgatccctcccacttggtccccctcatcccttcaattcccagctgctttcacgcacttgacgtgggacggcgacaccggtcgccgacgacaccgattcgtggctcatcccacctccataaactccccgagccaccctatttcttactcggactctaaagagccactacgcgtcgtgtgggcagtgcccggcggttaatttggcacctcatcagtctcaactcaagtcaccggttcattgctctcctccttggctctagtcctcctcccggccactcttcggtgacacagattaaaactctaggcttccctccctatgccatctgcgtcgctaccgtccaagggtcgcgagctggctcgatcaagcatgtcaacaaaccgagccaaacctcaattttaattagcttgttccccatatcaatcctagtcaaccgaatgccccttatttctaccagaaactggctagagagatgagggtgagataaggctattttgcataagcacccttatacttatcatgtttacaacgtcatccctagaaacagaattttgtcttccttgcattatattttgtaaaaaaaaacgagggccattccagataaaacaccacaggctgtcaggtagtggaagggtctgtttaaaattctatatatgcatgaggagtttttttttttcaaaataaccaggctgcgcgtggcatgtgtgtaagttgaaaccgggtacacacggttggccaaaccggacactatgcaaagcacatgcaaatgtaaacatgttattgaccgtatcaaccgtttctaggtagtctgctggcccaaacaaggagcctgcaacttatcttttcacgttgcacgtagtgcgagtagcaaaaaatagttgaaaagaacggagaaaaataaaatgggagccgctgttatcagctgatgattactgcaaaagttgatactccctccgtctcaagatataaatatttttaatatagtgtcaagttaaatatttgtaactttgactattaataaaaaaataaaaaggattaatcttataaatttaatgttactggatttatcattaaacaaactatcacaatatgcaactcttttattgaaaacatcatacttttatagatatcattgttaaaatagcatctcgaggaccgtatgtatcgaagttcaaaagtgtttacattttggaacggatattaattaaatgcatgcaatgcaacacgacataaatttgatttagatacgcgtaaatcttagcgtggttaaatacaactagctatagctagcatacacattgctattggcgtttaatttctaagtggatctaagagacacttgtcagtgctcttatgtatttatttatttatatatgttttctacagcatgatatgagctagggaatggtacacatgtgtcaatctcagatgcaagccactaaaattaatgaaaggtacgcataacttaactatagctagctagctagtccagttagtgtcaaggaagatttatttaattgttgaatgaaaagaagcaccaacactactacgcatcgggaatttattaattagtcaacattattcaaatcgcagttttatattcagcagtacgtatatacttcctttggttaaaaatatttaatgtttagcacaagatatgtatagtcaaaattttaaagtcatgacaatcaatattctcaaatacttatcagttactttaaagaaaatggtatttagatttgcctttaaaaatattgtcaggatatcataaatttattagatttcataaacttatatattctactatacattgattgctatatttgaaaaggttaaataaatcttgttctagacaataattatttatgaaaaggagagaataattaattaatttggaaaaatgctagctaaggtcaatgcggtagctagctgtaaagttatgtgaattatctcagttacgtagaccatttgatagtgaagctgcattctaattaggtatcatcttgagattctagaacaaacatagtcctttacatgctagtaattaattaaatttaaccaagatcattcaataattgcggaacagggaccacaatatgattggtcacaatcgatggtcttcaccagatcattcaacacacttaagatactctacgacattcttaagctagctaaatgcatgcattatgcatctacttgtcaagacttgcacgagccaatcacttgatccacaatgagtagttgtgtcaaaagtgttgtagtcttcctcttcaattcaggctagatcatggaatcattagagtaaggttaggccaaaggcatttgcacatttggaccgtccaaaatagttgctagctaaattacaagtgccacaatttcaatggcacaagaaaaggcccggataattctgtactcagtatttcatagataatgtagaataaaggtcgatgtgttggtaggggatatttatcttttgcagtcgaagagggaaataaaattcccatccagctgcctggatttttcacattttggtccttttgaaaaacttattttgtaagtagacccctagaaaaacttatcccaaaaatggtcctttttggggcgccagagtgcctggcgccgtcgttcaacagtacggcgccagcctctttggcgccgtccccctgccgacgtggcggggcgatgctgaggtggctagggggagtgcgccagagtggttggcgccccccctcggaaattttttatttttgttttatttgtttgatatttttttcacgcttagggacacacaagaaccaaccatagaaaaattgaactcaaatggacgtaatatgtgacatgtagaatttttcgtttcctctcctctctccgaactagtgcagaggagagagatgtgcaacttttttatttttattttatttttttgatatttttttcacacttaggaactcacaggaaccaaccatgtaaaaaataaactcaaacggacgaaatatgtggcatgtggaattttccaaagctccaccgaaaaacttctctcctcgaaaacacaatcttgcaagcggaatttggaggttttaatatcgccaaacccggcaaagcggtggagaatcggatgtaactttttctgtagatgtccgtgcatatattatttgcctgattccgtgtccgtatgagaaaattatgcctattttaatagatgacatattttgtccgtttcggtagagttttggaaaattctacatgtcacatattttgtccgtttgagtttatttttatacggttggttcctatgttctcctaagtgtgaaaaaaatatcaaaaaaatgaaataaaaataaaaaattgcatctctatgtactgtttaacttatatatgtcatttcatgtggttatattttgaattagattaagtaatttcatatagtggtagagtgcattatgtttaacatgctgatcaaagagttttactaaaggagttatggtctaattttagtgaaggtgcaaagtagactaagtggtatgctagatattttcagacttagctaggtggtagttcgagtttaaattttttttgtggttggttgtatcgtgatcctgagtgtgaaaaaacatctaaaaaaataaaataaaaatgacaccgttgcaactccatacagagaaacaggaatggaggcggcggcgccagccatgctggcgccctcctccctggggcgga

SEQ ID NO: 56187 - DNA, 10436 bp, Oryza sativa
agccactctggcgccccaaaaaggaccatttctgggataaattttttcaggggtctatttgcgaaataagttttttaaaaggaccaaaatgtgaaaaatccagtccagctgctctagctgtaaagggatctttccaaaatgtgcattattgcatgccgtatatttggcttttccagaaaaacaaaaaagacagaactatactataagaaatattcttctcactcccacttttcttgcatggagaagaaaatattttgtactttaattagatgtagaagtaatgtatctaacacagacattcaaccatacgtacgttaattagaatttcacaaagtagtaaatttacttcagtctttttacttatggatttaactactagaaagtattaattatatttcgcatcgatctcggacctttgtaaaaataaattaatttcacttataagaacttatgacaatgaacgctcatgaaaagccaacttagatgttgtacaatactatatatgaaatgataaacaaaataagggaaacatgaaaaattaatactacacaacatatttgttcccattgtatatgtatgtagcatatctgcttatatgttgctcccacacggtaacaattaatgacaacctccagttgcaattatactcacatagtaatatataatgcacaagagatcagtcatgcatcgacagcatcattctgcaaacgttatccaatagctagatggcacctagcatgcatgacacagatgttgagatggaattggactcaatccagagaatataattcaggacatgatcgatcgatcgatcgccaccagtagaacaagaataaaacaaaccgcatacagtactgtgctaactcttatctcatgctgacgaaaactaaacaggaagagagagaatattatctcacatatatcatgcaatgcatcgatcagtgcatatgataattaagaaacaaattaatcagagtatatgcctagctagggtctctctctctgcaggtgttgtagtactgatcaatcaatcacatatatatcatatctgagcacagcatatagtatgtgtcaagaattatatatatactcttcatatcaggaatcgatcgagagcttgtcacgcttagacgctaagtgctctctctaccaagcgttcgttggtcttaatcattggtcgatgcaatgcaaatatttatatgtgtttctaatgtgtagatgctacctggctagctagcttacacgttacatgcacatatatgcatgcgttgatcactctcaagtttgttgagtttgtctttcttttgaaggtgaatgacatgtagccatcctccaaaaagcagcttttttttccctctcctccctttcatctctatctgtcttaatttctgcactatgcacatgctagcatagctgcaagatattgtagtcagtgatgatcgatcttaatttggatggacaacaggttggctgccaaaatattggaggtcagatgtctacatatttctcataagttaaagtgtatgtacttttcactaataaggtttgtgctcaaaattgcaaagttgacaaaaagcaaacggtcatactccaaattctcagtaatatagaattaactgagatttttttttcaaatagtactaatttaataaaaaaaattgcaaagattgtgtccgatttcgccaatgagagaagacacatgtttgcaaaccatttgccacaagaaacccgtcacaaatgaaatacggataggtcggttgcgttgcccgtgcactagctgccccatataggcatgtcagaatcaaattgccgacaactcccttatattggcagtattgagtactacttcagtataattattatattattgaaataatattatctaaacataaatcaagcaccgaataataatcaaccgatcgaaacataattatcaggccacattttctcttcttttggaaaaaaaagaaggaaatatcttgcatctgctagctagctagaatgctagatgttggaagccaacaccggatcgatcatagatcaggtgctccataacatgctgcacgcatgatcgatgcaggtagccaaccagcaacaatccagcaaaaaaaaaaatctgcctttttttttctgctgcttttcagcggcatcctagcttgcgtcgctgcacctggcctccgatccttggtgccaacttttctgtggccgtagctttgcacgtggaaggccggccggcgaagccctgccccacctagttgccggacaattctcggtgggaagaaccgatcaaagcatccatagacggtcaggatgcgtgcacgtttccagcctagtggactatcgatctccatgttcattctcaccgtctgattgttgcgcggaaaatgcatatgtataaattaaagttatatacagcccccgtttataaatacgtgtgacgttatttactttcaaacattatgagcctgtttggcacagctccagctctagctccacccctcttggagctggagctcagccaaacagtttcagctcatcaaaactaggagtgaagttgggtggagctctctcacaaaatatattagagttgtggaactgggttttggcagctccataactccactccagactcaactcctggagttatatttaggagttggagctgtaccaaacaggccctatgtttaatgatatagcaagttataacaaactaaacaatagttaactatttatttttcaagaagatgaatagtaaaaactcatgtacaaaagtcgataatgtcatatagttaaaaacggagttagtataataatccttggactgttagcgtatatgttgattaatagttaaggcgatttttgctttttttaaattaatttttattaaattaaagctaaaaaacacgaataatagtgaatgacctaatatcaaataaatagaaggggtgaggcttcgaagtcaggccggttagcccatcaccttaattatggagctagctggaaaacctgtgtgtttctctatattaaagctacacaatgagtaaaattaactcgatccagtagacgagtacagatttacttcaactttgttgtgcacccttatgtagttatgtagatgttgacgaaaaaaatcgaattactatattttatatattgacaaggatcaacacaaaattaaatacaatttttaaaatgtcaaagttgtgaacacatcatttgtttcactcccgaaagaaaacaagtgacatatagcatgccttggatttagttagatatcgatgacctacataatggttgcaaaaaagattgatagataaggggcttgcttttactgaaatagttcttctattaatcagagaaaaaaaatccgtacactccaaacggagtcgtttaaatttatagttacttgtttacacaagcatataaaatatatgcacaactagtgacggtgtacatttatatatttcaatcgtgctgggaccgggcctgacgtttcggcatcatatcacaagcagagaaaaggtgtgaaagaaaaagctaaaatcatgcaaaactttagtaaaaagagtagattaattcccatggtggaggaccctcttcctctcactctctctttctctccattgtgaaaattaggatataccaaatcaataagggtaaattaaatgacatgcgcaatgatgtcattttcatgacccttcttccaagcagattccatggtggggatcaaaatcgattttgttatcacatacacaacaaataatattcaatatatatatgggggacaaaagctcaattaaaggcaaagtcatgctctttttctctttagtattttccagagattatgcccttgaatctcctgtgtgcttgaccacaaccaatgggtgattagtttaatcaaataaccaggaattaagtggagtagtaattattaattttaccaccaagcctttgtcccattggagatgtcaaagctataatttgggcatatatgatatagtagctaggaagatataggttatcatgtatataaccaccagctgcacataatattagttgcagagtttgacgacatatcactttcacctctctctcgcccatttgttaatctttttgtgtccttgatggcttgaccacacacattgtcataggctgatgacatgctatatctaattaattaactgttcatctgagattgactgctcgcactttacctacagtattgcacttaattaatataactaccacgacgaaggcaccatagaaatatgttttcacagtggggtcgagctcgtgcgcttggtgacgtggataattaaatgcaagttaattaatttaaagcagcgcacaagatagtcgtaatggtgaaagatgtagttacctctaaacagaaaggctagaaagagaaacttaattaattaattttgtttctacacttctggtttatttggatcttgcatggattcctttttcttatttatgcaaagtggtttattgcagcaagctgtagatcggggaacaccattttggatgtgttcagctctcatgagtgaaggtctggcaacagcaattgtgaaaattgaaaattggcattacttcttcttgttggcaacttgttactttatttatattaatttcatttattgtgtagcatttgcaaaaatgtatccaccacttaaaaaaaaccaattttcacaacacccctttttatttttgcagacggcataaaaaaatacacacatgtagaagtcgatctttataggtggttaggctaggagagttgtctgcaaaaataactatatttttataggcgctcactactacaggaatgatttttcgtacaggagtcattttagattgcagatgaaccgtaagtggtcgcgtctgtaaaaatcgtgttctattttcgcttgcggctgtttaaaatgaccgcacggaaaaatcaattttcgcaggcgggccacttaacaggtctacacgcaaaaataggcttattttcgcgtgtggacatatcaagtgacttgcacacaaaaatagccacccaccttttaatcccgccgtcgccgccccacacccactcctcccatctccctctcagatcccatcgccctctccgtcccacacccactcctcccatatccttctacgtcccacacccacctcctccctctccctttcaccctcctcctcccatctcccggcaacggcagcggtggcggcctcggctagggcggcggaggtggcggcatcgggttggagcagcggaggcagcggcggaggcgagtgcggcatcagccatggtgggggcggcggagcggatccgtcgccggcgaccgcggggaggctagatccgtcgctggccaccgcagggaggccggatccgtcactggcaaccaccgggacgacgacggcgggcctcgggcaaggcggcgatgacgacggtggtgatggcaacgatagtggtgacggcgacgatggcggtgacggcgtttttgatttttttttttgttttgattttttattttcccatgcagacgactaaagtgcctgcacgtgaaaatcgcgatttttgcgcgcgggtgcgtcacccacatgcgaaaatcgcgattttcgtagacacctcattccagacgggtggaagatccgcatgtaaaaaccgattccgaatgcacagaaaaatcgttattgtactagtggctcctctcaaagtaaaacaaggatttttgtaggcgttcctttaagatggttgcctgtaagaatattgttacgttttgcaggcaggtcttctaacccaaccgtctggaaaaagagatgtgcattgtgaaaacaatagtccctcacccatgacctctcaccatcccccttcctctctccatcacctctggtacgtgctccaagcctccaactaggagtagggtgggggtggtgaaggggaggggaggggttgtggttgaggaggcggatctagtgtggcggtgagacgacattcgtgagtgtcaaatccggtgactccaaagggcatgaaggggcaacaatagcggcaaaggggtgtggctcaatccctctctcgacgatcaggtccaaggtggcggtgttggaaactgggtaaggggagaatggggcagccatgacgaggaccctgacgaccgcgctggcccgatcaaggccactagattcggtggagagggctcaacaactgcggcgagtgcaaaggggaggagcggcggtcgagtcaaaggggagaggcaatctcatccagctggagctcgggaaggagatggcaaccgcttcggggcgtctaagagggtggcgagggctatagcttggtggcgggcaccagatctgccgaaggtcatatagctcaatgctaacacgatggctgttgttagtggtgtgacctaaatccaccggcgggaaggccgggtcggtgcatgccaccaccaatatatggggcttgatgggctggtcatcgtctctcgcccctacctacagcattggttctagcaggcccacgcatgtacaacctccacttctctatgatgtattctctctgctgtcaagacattgtgaatttgtgatatgatcgatgatttagaaatccatgatgaaattgtgatgtattctctctgtttgttatggaactgcatatgtttttttttcaattgtatttttattttttctagctaaaataaatcactgtggatggtcaacttaacctacctgttttctcaggcgggtgaagcctgccatgtgaagatcatcgattttcacatgcttttggtcataggtgagtcgtctagtcacttacagaaacttgttttggcatcctacagaaacttgttttggcatcctacaaaaacttgtttcatagtagtgatctttggtctttctgtctttgagtagccgctttgtctgcaggaatcaagttaattggctcatatgaaaatatgccaaaattcaattgttacggaggctttcactttttgttaagctaattggctaagccatttatatatatgctactaattcttcttaattgaatatgaacagctatttgtctattctctttttcaagaaaaacgaatccaaactaatattttcttatttatttaataaaaattagagaaatctagacaagttagcttaagcgcctttaatttgctgccatctaaaaatttggttgttttttaaaagaagttctgttacactgcatgaatagaaggatccttgttaaagtatatatactcccctccgtctaaaaaagaaaccaacatagaattgagatgtaacataatctagcccatcaaatatagatgtaagcagtctgtctagattcgttatactagattatgtatcatcataattctagattgagtttttatgggacggagggagtagctaggatcgttacaataattaaggagatgaagaatatggcatatatgcatatatacatgcatgaatgaagatttagcatgattttaccaagtcacttcaatatattatcaactggcatcttattatcccttgcaaccaaattttgtggtgcatcatacatagaaagatggaaaaaattcctatttccaaaactgcactgcttacatattcctggggccggcaaaattaaacatatgtgatgtgtacagttcattttcatcatgcatgcatgctgggataaagcaaagatgctcacaaatccagtaagcactgtacacaactaatcaacatacaaaaaaggctataatacatgtacatctcctgacatcctgtacatagagtacctagctcttttgtaggatgaggctaatgcacgttccagggctaagggggcaaggtctcattgttggccccccaaagatactggtgctagatcatatatataaatattcatttcacactactacccaaaacatctttccatacagctaaaactaattttacagacggccaagccaaccatctcactctaatcatttgtaaaaatcactattttcacgtgtggatcatgtcacaaccacacgcgaaaataacttttcacaagtggcctccatggaagccacctgcggaaagcgatttttcaagtgggcatattaaaatgcccgacaacaaacttttttctgaaaaataaaaaaaaataaagaaacgctatcccaatgtcttgaagaagctgccactacattatgccgccgttgtcatagctagtagcccgcaagtcgtggtcgttgtagtagcccacattgcaaagccgcggcaagatccacgatttgtcttggatccgcctaggctccaccaccgccggatccgccgctctccaccgttggaagtctcctatcgccgcaccatccctcccaaggcatctatcggcggatccatcactcttgaggccataggtgacagatctgccgctcccgtcactgctcatgggtagatctgcctggctcatggttgtcgctgtcatggccaccgtcactccagaagactcctgcgcggccacgccgctgggctttcctctgttggcatggctgctgccactctcgaagcgcgctgtgctaccgcctgagcctcccgtcgccatccggagaagtgtggaggtaggctgggagtgggagatcgagggagagacaagagtaggaagtgagagagatgaggagtccagcagtgagaattatgagacagctcgcacattatcctcgtttttgtatcgttctctacttttcaagcagtagtgttgagagctccgcttgtaaaatagccatatttttacgggtgagcctcttactacccacttaaaaattaaaaaataaggattttcacagacgaactcaaaataggatctcctataaaaaatggcattctataaaaaccaatgttcaagtgcgagcctcgacctttcacaggtgactcttctttttatcgccctatgaaaatagagggggtgtatgggaaaatggttttttaagtgtttatgcctccaaaacgacattaatccgttccaataatgtaaggctcatccatgtaggtataacatctggcttacgcatttattctcgctttgtgtaaaatgtttaatccaaggttactactatatgtttgatgcacatgattttgacatattaaccaatttactgaaaagctagctagtaattgagcctatatatacaagcctaacctcatcatttttgaaatatatacggagcataaaagtataatgttattgatctgcacgcgcacaacattctgcttctagactgagacatattgcgaccaaactctcatgatcaatatatagccctagataattcatacatatatcgcccagtggctttaataatttggaatcgatggatgccaatttcattcgtacgacatttctatcacttcattgacatatagatacagtggtttaggtatatatacttgggctagctagtaataagctagcttttgttgctttgaacttgtcacaaaagtgtgcgtgcatgcgtaaaataataggcccacgatgatgtttatcacacataaaaagaggacaatttctagcatacacatttgatataactccttgatacttttcctcaatcgatatcatggattgatatggattgatattatgtaacttttctttctgtacataattatatgtatatatttttaatataccgtgggatgccgcactgttttcaggttaaaaaaaataccttgataatcttgcgacagtaaaatatttacattttatattagtatatttcagtcgtttttagtggttaaatctctagtgcgatgtataacctcttcttactatgcatttactacctttttagccttcgaattttagtttattttttaccataacatacaaaaccaccctcacttttgaacctgaagaaaaaactcattggtaccttttttagtggttttgtttgaaatatgggtgattttgtttcataattaagaaaggttcgatcggagacaaacacttctcataaatcgatcagtactgatccacaagccggccaagctttggcaagaaaagttaaccatggaaattgaagacaatgatttgtactggcagctggctgagtcatcccagcacacacatatataaattaaaatttatctgccataattttctagtattttttagttagcatgtctgaagattaagcacgtacggcaagtgatcgatggcataggggtaacagtgcaagttccctagaatttcctgtccacaaatgcttaactgcacatatccccgaatcttctcatatactccctccgtattttaatgtatgagacaccgttgattttttaataaacgtttgacctttcgtcttattcaaaaaaattatgtaattattatttattttattgtgatttgatttatcatcaaatgttctttaagcatgacataagcatttttatatttgcataaaaaa

SEQ ID NO: 56188 - DNA, 10131 bp, Oryza sativa
tgcatggataaatacatagagccgtacataattggatttattagcatgtgttttgttgagacgccacatctgttccgacatgctttatcatacactaggttgaatttgatttgtcgatagatagaggcgtacacaattggatttatcatgcatgttaatgagaacgtctaatctgttccgacaagcctatacgtgaggttgagtttgatttttgggtagattattgagtctgatttgttacaacattcttattgatttggactcttgcaaaagacaaaattaaacaaacggagaaatgaattgtgatgccgaccgggcaagcaccaagcttgctaagccaccaattaaccgtttgatctcagataaatccacgtactgcatgcgtggccaccctgcattacttgacaacctgaaataatatctcactttcactgcccagtccctctcctgttatcaaagtagcccatggaataattaactttaatccttttcctcttcttttttcctcaccgtaatttatgtatgctagctagctaggtcgatctggagcgactactgatcaatcgaatcttttattggatcatgatctctatcagttttgttgatcagtgacacaaaagggattgatcaagtagcagtgtaccactgcaagtttgtgaatgcctctcatattctgtccagataaaattaaagatattcatcaattcacatcaaataatatgaaagtatatatactactccctccgtattttaatgtatgacgccgttgactttttggccaacatttgaccattcgttttattcaaaaattttatgcaaatatgaaaatatttatgtcatgcttaaagaacatatgatgatgaatcaagtcacaataaaataaatgataattacataaattttttaaatatgacaaatggtcaaacgttggataaaaagtcaacagtatcatatattaaaatatagaggtagtaatatgaacacttctttttagaaacataaagaaatggctcacaatttccagagttgcgagtagaagtggcttttgttgatatatcgatcgacagagtactttgatccaatccggaccagaaaaatatcagaaacttggcctctcgtgtcgatccacggacaacgttgctatctatctgttcatcctgttgcattgtgccaattaactactgtaactatctacagatacgatcgattgcagagtgatgagtaataatttatgtgcgcgcgtgttcatagatcgtgcaggctcactaaaccatgcgtaattcatatcttgcattattgttaatatctgaatcgatggcatagtagtgcgacatctttccgatgtaatcagtgcttgcattggcggctgcttttatttaatttgcatgcaacatatatatgaacggctgcacttctagctaggtagcaccatgaccgatcagcatgcaaatatatgtaaactatgactttatgaattaatatatgcataccgataattagagcaatagctagctgaccatagatttggtctatgatcgtgctctctgagcatccatgttattagaattgagggaacaaaattacacaaacaaaacactatgatccataaaagacagttaggttggttatacactagattgtacatcaaggaaccacgcacatgcaccaaccacacatacacatgccacggagaggggaacctaacacctagccgctgcactatgcgttgcctatatcaacacccgatctacagcagcaccacaaagcggagtcttaaaaaacgatacatccacggaggttgcaacgccaaggacactattgccgcccgtccaagaaaatggacatgattttcacctagatattctcgcctagagagggaggaaagagttatcttgacaatgtccccgggtgggttgacgtgctcgaaagcgtagccgctatcagcctagtgaattgttatgctaggctttgtcctggaacccttgcaacccagttgccgcgatccgttgcccatcatcttaggtaccacaccaacaaaacattggtagtgcatggcctaccacaccggaccaacacctcttcgtcagcagacttccagttctgtgtacgactagactaccatttgcaccccgggcactgtctcaagcctcctctgcctcaccgcccacgaggctacttgatggatctgaccaaggagagcctggaattgggtgatatcatctcggcagcccaagccttcccttaataattgattgttgccttcactataccaatggagctccctatagaaagaggggcagagctcctcaaagggagagggtgctaagccgatgggaagtctgatgctcgttggtcttccaacaggctgctttggatagcggagtaggaagagggatggagaaacgacggtggtagaggttagggagctgggtgccacccatgctgcccctatctctcatccatttcgcgtgttttttctatggtctaatcaaacgtgtttttcctgtgttctataatcttctgctttgtacttgcattcctatcaaaatcctacattttttatatttctctatttttttcattcctgcaattcaaaatggcccttaaattttctaataccataacttgtgtaacgtgcgtaggccacacagctcccgattcataatattttgatgaatcattttgttcttattttagataaatatgaaactaatgtttaggtgcttcaataccataacctgtgtgtacatgcgtgaatctcggatgcaaagtgctgcgggacttatgtggtgtttgcatctatggactaaattttagtccatatcacatcggatgtttgtacactaattagaagcactaaacgtagactaataataaaacttattgcataaatgagagctagttcacgagacatattttttaagcctaattaatccataattagcacatatttattgtagcatcacataggctaatcatggattaattaggctcaattgatttgtcttacgaattagttcagagttatggaatgggtttattattagtctatgtttaatacttctaataactaattagtgtccaaatattcgatgtccagggattaaaatttagtccctgaatcccaacaccaccttactaatctttgcttcttcttttttcagaacttactaattagtcctgctatgacgacatttctgcgaggctgcatatgtatgtttcagctgggtgtagtggacctatggttggtagtgtggaagatgcatatcgcttatatacaaacctgccgagatttgcggctcctggagatttttgagctggcgtggccacctgcgcgtgccgacgcgtcagcgaggcgctggatggcgggtggttttcgtgagctctcgcacgtccgtgtcgtcgttggtgattttgcaaaaacacccttcatttacttgataatttgttatagatccctggtccttagttctaacgttgtgcgctcttacttagaggacctcttaagaaaacaatattctatatgaagaagcgaaaaaacggaaaattgaaccgcgctctgaaaactagaagtttaggggttgtttttgcaaccctcacccctttccccaaaccctagccgccaccattcctctgcctcctctcctctcgctccgctctctctcctgcccaagcgacggccgccgccgcgtgccgtcccctcatcctcttcttcccgcagttggcgacctcccccgcgcactccctactgcgagctgttgctgtcgccgcgccgtcgtcctgccatcaccatcctctcgctcccgcgccgcatccgccaacgaggaggccgggactgtcggatccggtgactccggcctcctcgccggcagatccggcagccctaaagcgaggggaagctaggagccgccttctactcttctacctctatgcccggcactgcccctctctccctctccctctccctctccatcctgttcatttccggatcagcggatgcctgcgattaggcggccacggacgtgcgtgtgggacgtcgaggagacggggaatcactggatccaggaggtcggtgaaccgatttggagagggagctgcatgatctgtggcattggtgtcccgtttcggacagcggcggtctccagtacggcgggtgctgctggatctgccgcatggagggctcctcgtcagctccatcctacctcttcttctgcctttttggaaggaggtgaggagaggaaagtttcctctggaatttcatactgcatgttatatctttgtcaagttggtggtcttagtgtgatactgtgattaatttggaccgatgaagatatgtgtattgaatttttctttgcaagtttaaatcagtgtaacactatgaatgtgagcgtgtgaatgcagcttgtagtgaagctttgttgagcttacgcaaagcagagaagggcatcggcgcggggttcctagaggatgctgccacctccatccccttgcgtcacggccgtgctgccctactggtcctctggcacagcatctaaggtcatctgccaccacaaccaggttgcatctccaccgaatatgaccccactttgatggcggcgagctttgctttggtagtgttgctgtcaatttggctgtgcatttctttaaggggttcatctacgatccattgtagcatgctgatgactttaaattacaaatgagttaatgcataagattctttgtttccaagtataagaaattgatatatcttttgttgaagtatgagtatgctgatttgttccagcaaaatatagcaatgtacaatattttttgtggataataatttgataatgctccatccaaatgtagtcatgcatcttcatcaaaatagattgtggctttgcatttttagtttgttcattactaattatgccccttgaaggtagtgacttctataaaattaatttataacgagcatgtttgtaacttgacattagatgatcttttacatgcagaatctgagactaaacgtatacactaatcacactaatcactactactgctgctatatattactgttgtaccaaaaatatacaagtgcatttgataaaggttatataggtctggatcagaactgtatattactgttgcaccaaaaataaattaatgaactgtaattttctctgtattatttttggatgtgattactaaagctcgctatgtgtctgctctttttgcactatagatgttatgtggggcattcagtatcagcgccggaaccgacgccaacagccagagcaggcgccgtgatgttggatcaagttgttaggattagtttcagtgattaagtttgttaggaagattaagttgttagttcctggttagtagctgtttggttttccattgtaagcctatataggccattcggtttaagtgattaatcaagaaagaagttaatcccagttcctgttagtttccaccacggctccggggaggtgaggcgtgcgtcctcgccctcccgtcgagcacagctacgcgctatgccacttagggccggcgcctaacaatagaaaatcaatttatctcaatttgttgcacaatccatctatagcttcaattctattctaagctatctaatcttcccaacgccaatcagctgctgcattacaatggattacattattgctttgcgaataatattagaagaaccaaagaaaacatgatggattggtgcaagatcaaaggactggcatagctgtccacttctcttattcttgtaggctttagctggtgcaatggtttcagtagtaaaactaggctatgataggctgatgcctgccttaacacgccaagactccaggtgcacacaacatagtagatcagaacaaaggatgcctgcattggtgccatcctccacgaggagaaatggcaccactggcaaccagtttggctgatcgttgttcgttgcctaccttgagttcaccgtttaaattatatttgacatgttctttacggaagtgaaaatttagttgattatctgtttaccaaataggcatatattagttctataatttggttgtttgtgaacaagaattctgttgcaagttatagctgaagattggtaactctataaaaaaaattaattattatgacataatagacattaactctgaacatattaaattatcatgacatccccacgatgtgcaacagaatttaacttgatataaaaaaaatgatgttacattgttttctaatttgcattcagtaatgcctatgatattttacaaatgtaactgacttgtccttcagatgcttctcatgttctacattggatgcatccagtttttattgcagctcactttgaatcttctacctaatgcttctaatatttatgcccttttttatttaatatgtgatgattaggtaatgcttagactagcatataaaagattggcttgattagggttctaaaattgaagttttctttgaaacgactaatgttattatttgctcttgccatagaagtggtttttcaggactcttgataatataactattggtttaggatgataaagcttcagtttaggacgatgagcgctgccctgtaggttaaaatcccattttaactaagttatgtattatttgactaacttgcactttcaccctcttcctttaaacatactgatagtatctgctcataaaattattgtgcttgctatgatttaggtattaaaatcacataccttttataatctatgtaaaagatgtacaaccagaaaccaataggttaacttgacatattgacctttacaatcctacaataccgtccattccaactttctttgctgaataaatatgctgctgtgtgcattatttggttcacatacctgattattagaaaattactgaaaacagtttggattgtttacctgtttgtttttttagtatggataaatcattactttgcttttggttggtacctttttgtgccccccctgctatttgagatgtttaattaatttcctcacattgggctaaatttgtacctgctggtggtccttcagttaattcattcacagattacttgacatcggcaattgcttctttgattcttacaatctgaatatataccaaaaaacaactatgttaacttgcttttttcacattcagaaaaagaacattactaggaaacaaggatgcttaattgttctaatattgttgagtagttcaatgccataagattattgactgccagtattgataaaaaaaattgtatttttgcatcacttctcaggcagctatgtacacgggggaagcaattcatcatagcaaaaaatattgcacttccatttgcacatcaacaaaagggcccctgtgtgaattcggtgaaggcatccaaaccatattagtagaatttagccatgtgtaatatagttttatagtcctatactcctatgtgctcatctagcagaactgtttcaatgctaccactataaaactactatgtactgtctatcctgccatcaaacatgtgacacattttgctatttaggactgtccacaatctgcatatatgttgtgattagcttttagcctctataacaactatcaatataaatgctcacgtcacaaaacttcattttttgcactacactaaacctaaatctcacaccatgtcgttagcctatacttgaccttcacagaccttgcaaatagcatttgtttcagttacctaccagaaccaacaaacagatgtaatcaatgatttccctctcctggcaccactggtgcaacgcgcgaccacaccggcagctccaaatgccggcggggacgacacgcggaaagcaccgcactgaccagaccacccgccgccgccgccgtggacagctggcgccgtggcggttccggatccaccggcgccggcatccgcttcttcgtctcggatgaatttaattggatgctgacgtaggcgtacgttaattcctacatttcgtatatatactccagctgtgtggtggccgctgcgttgtcgcatacgtacactagtcgtacaactttcttcaatatataatactaacaaagtgcaggtcgtagaggtaggcccagtgtacacgcatgtacattgtggacgatttgtatatctatactgccgaatttagtgggtgcgtctttaattaagtttcgaactttccgtgcaacacgatcgatcaactgtatacatatatttgcttctttttttttcttttggcttagctataggttttttatgttttatgagcacctccaaaatactgtaccggtatattttaagattgataaagtcatcataaacggatacttcggtagcaacagatatgtcacttaactaccacttaaaaaaataattagttgtaaacgtgtgtgtgcgaccacccgtgttaagtttataactttatttcggataggatggttttatcacaaggaatctaaccaattgatcctgtgtgtctggatagtatagattttattttctttcttgaactaaatatgcatgcgtacatgtttatatctgcatgtaaaggaagtggagttttatactccctccgtcccacaatataagagattttgagtatttgcttgcaacgtttgaccactcgtcttatttaaatttttttactcgtcttattcaaattttttttgcaaatataaaaaatgaaaatttgtgcttaaagtactgtagataataaaataataaataataatttcaaaattttttaataagacgagtggttaaatgttacaagtaaaaactcaaaatcccttatattaacggagggagtatatgtgtagcatctgtcgctgttagaagtagtggaggagtttttgcttgccatagtaattaatatataggagatcaaaaaatatatatagatatatggatagatagatcgatagatcccaaaagataatgataatgctgcaatttgacagcctactcccccagcgtgtgtagctaaagtgagcgttgaattttcagctgcggttttgttttagcttttatatatacatctttcaggataggcttacataccatcactacctacggctggctgcatattaagtactatatatactaaccttttcattttaaaataaacaaatttattatgaaagtgacacattatagtattatgaatatagacagagaatatatcatattttatttattttagaactgatagagtacttcatataatttcgttgtttctgttagggatcaaatgcgtacgaagcacactacaagataattgagctattgccaccaaattattgcaacaaaaaaataattcgtagcaatatattatactattgcaatgataatttttctgtggcaaataattattttttattgcaacgatctataatcgttgttttatttcgtacttttgttgcaatagaaaataagatatcgccacaaaaaatcgtactgttgcaaaaaaaacatgttctatcgccacaattttaatttttgtggcaatttatatagtacatggtacttttcactattttttgttgccacgatcaacaaattcgttgcaataaaaagattgtcgtctcataatttaacttaattttttcatatggacacggattgagacaaattttatatggaaattatagctctcgacgagatctacaattttataggtgataactttttcatttgaaatcttttagatattcaaatctatgattcaaatctcatttagctaggctcaaatggaacgatatgcattttccaacaaaattgatacgtagatgagttggtaaaggagagcacgcgtgaaggataggtttgggtttgaatcttagccaagacacaaaatcaaaaaaataagtatacaaatagataggatgatagattaatatttaaacttttaatttggtacgtaaaactaatgccacatatggagtggtggcaataatttttattacaacgctgtgaagtgttgcaatatgactttttgccacatccattccgtggcaacatctaaatttattaccacaaaataaaaatcgttgcaataacctattaccacgttgtttattaccacggctagcaacgattttacaattgtggcaacatgtatctattaccacaattttagt

SEQ ID NO: 56189 - DNA, 10454 bp, Oryza sativa
gttaagatatgctcgctccatcctaaaataaaacatgtattgaaacgatgtgtggacgtgagtataaaatagatcgaaaatatgaataattatggcacatatatgtggttaagatggtcagaaataaaaaggtgttggaaaaacaggtgtggtggtggagttgtgggtgtatgactctatccaccattacgtacgcacatgcaagtgagctagcttttaacaggattttagtgagattggggatataatatgtcgctagtgatctgtttcttagagtatgtgttagaggcgcattggcgaatgtatgtaaagtgtagtgctacgtgtgtagcgatgtgtgtatgtgtctacagtacaatataaagaaaatgaaaagtggctttgttcataaaactcactcgtgcagtgaagcaaccaaattcagggaggctgatttatacatagattgtataagcccatgcctggaactggaaggcccaatttaaaagaagagcgaattaaggaataagtccattttgcctccctcatctcttgcgcttgtgtgaataacatccctcaaccggaaaaccgtgtataacgcctccttcatctctgaaaaccagagcaaatcacctccctcggtggttttgctggcggtttcgtccgacgtggcattgttgacctggctgacaagctgactcagcgtggtgggactcacatgtcagtgtgtagcgcgctctctctcccttatctctctcttccccggcctttctcttcacacagtgcggctcgtcgacgtgggtcaggcgcaaggtggccgggcggcgcgttgcgacggagagaggtagccgtgcggcggcagtgatgcgggagagcgcacggcggtggcacgacgcggttggccggcggggctcggccgtgcggcggcgaggcgtggtcgatggtggcctggcacagccatttcgcggacgcgacgcaggtcacggaggcctttgcggcgtggtgcgcggcggccgccggcaaggccaacggccggcgatgcgggcgcggcgtggacggcgatgtggctagggaggtgtgacggctggccggatcttcccccttttctttttttcacttcttctcttctttgtttcttgttgctcctgttgcatgctgagtcttgtatatgtagatgcatgtgtgctgctgcagtttgtcgccggcgctgcttgtcacacaggccccttctttggcaacgtatcatgaggtcgacgcgccgaggatgtcgtgtggtggcggacgaagatggtatcatgaggtcatgtggcagcggcgggcgggcggccggccgtggctccggccgtccatcggcagggcccaggcgaaggcggcttggagaagctgcgtgtattcgtcaccggcgagtgcgcatggttccgccgcaatgatggcttccaatgtggtggctgtcatcacgagcagcatgtaggtggcttggtagaattgcgtggcgacggtttaatgcttggattctggcgaggtggtttccggcgtcgtggccggagaagatggagaggacgcggacgccatcgtggatggccgcgtcgagcgcagcgaggatatacgatatcggcgtgaaagcggtcgctgccgctgacgcggcattcgtcgctggcgcctctccccgccggccgccacccccttcccgtctccccgccgccaatgcccagctcctctccgccagtctacttccccgtttgtcgctagcgagcgccgctgccgccaacgagggccaccgccgggcgttgcccacctctggttctatcctgtggaaagtttctgggagaaacagcagcacgagtgctgtgcgctggatgcgtgttgatcagatgggaatagcccccatcgtggcttttacatatatcgcttcaaggaaacagatccctcaaagctaggaaacaaccatggccggctgaggttaaggttgtatttgaacctgtccagtaacctttctgacaacggttctgtaaaaccatctgcaacttgatcaccagaggaaacaaaatcaatctctaaaagtttatgacttaccctttctctgacgaagtgatagtctacttcaatatgtttagttctagcatgaaacaccggatttgctgataaatattttgctccaagattatcgcaccagatcattgctgcttgaggacttttaatccccaattctgcaagaagagtttgtacccacataatttctgctgttgcatttgcaattgccttgtactcagattttgtgctggatctagataccgtggcttgttttctagcactccaagatactagatttgaccccagaaacacagcaaacccacctgtggatctcctgtcatccaaactaccagcccaatccgcatcagagaaaccactaactagagtagaacctgacttatggatcttaagtcctaaacatgtacattgtttgagatacctaagtatccttttaactgctacccaatgtacagttgtaggtgcatgcaataattgacagactttgttaacagaaaaggctatgtcaggtctagtaagggttaaatattgaagagcaccaacgatactcctatactgggtagcatcactatctcccaaaagagatccttcatgcagagagagtttatcacttactgtcataggagtgtttgaatgtttgcaatctgacataccaacccttttcaatagatcattggcatatttgtcttgtgtcaagacaataccattctcaaccttgctcacttctataccaagaaaataatgcaactcacctagatcttttagggcaaactcccctttcaggtcttgaagcagagctgcagttgccctctctgaagaactggctacaataatgtcatcaacatatactagaacaaatatagtgacaccacctctattcagaaagaacaacaaggtatcagccttggaaccactaaaaccaagatcagtcaactttttacttaaccttgcaaaccatgctcgaggagcctgttttagtccatatagggccttgtcaagtttatagacaaactgtggtttagttggatcctcaaatccaggtggttgttgcatatacacttcttcttcaagataaccatgaaggaaagcattttgtacatctagctgtctaagactccatcctctagacacagctaaagacaaaataattctaatggtagcagctttaacaactagactaaaggtatcctcatagtcaatgccatatctttgcttaaaaccttttgctactagtctagctttatatctgtctagagtaccatcagctttcctcttaattttataaacccacttacaacctatgacattcttccctctctgaggtggaactaggtgtcaggttttattctttactagagcttcatattcagcatccattgctagtttccaatttttatcctttaatgcttctatatcagtagtaggttcaccagactcagtaaaccaggagtttttgtatttaatagtgccatcagtgtataccttttctttgcgaaccccactttgcaacctgatgcgaggtctaacgtggtcctgaggcacatcgtctgcagatgtcacatcgacatcatcagcgacatcattagcccctcctgtcggctgttgttgctctgcaccccctgtcggctgatgatgggagccgatcggatgctgccgcgcgtgctccattgtccgggagtgcctgccagcgtcggggctggagccacccgtgttgccaccggattggccggtgtcgccatcaggttggccactggccaacgtgtcgcccgacgatttgtcgccaggaatcatgtcgccaaagctactgctgagatctgtgggcgctgaaattgatggcgaatcaagctggaggtgagcgccgtcagccccggtgggatcttctacatcctgccactctgcatcgcttccctgggactcattctcatcagaaaaatcattagggtgtggattagtcacatggtttggtggttgttcattccccctagagtataccgcccaaataaatctgatggtaggagttctatctcagacctaagacgagcgccggcattggcatgaagctcagaaaaaggaaatattgtttcatcaaaaacaacatcacgagaaatatagacacggccagtggacacctctaagcacttgaaccctttgtgcatattactaaacccaaggaagacacaccgcttagatcgaaattggagtttatggttattgtagggacggagatttggccagcaggcacaaccaagcactctcaaggaggtgtaatcaggtttctgatgatgcaatttttcaagaggactcatattttggataactctgctaggaactctgttgatgagataggtggcagcctgcacagcttcatcccaaaattttaaaggcatagtcgcatgagacaaaagagagagagctacttcaactatatgacggtgtttgcgttcagcagacccgttctgttgatgtgtatgaggacatgatacatgatgaactatcccgattttagtaaagaaagaattgagagactgatattcacctccccagtcagtttgcatagccaagatttttctatcaaatgtacgttctaccatggcctgaaattcttgaaacttttcaagcacttgagatttgtactgtaaaagatagatccaagtaaatttactgaagtcatcaataaaactaacataatatttctttctcccaacagattctggagcagggccccatacataaaaaaaacaagttctaaaggatgctgagagacacttgttgacacaggaaaaggtaattgatgactctttgcttgttgacaagcattacaaactgactcatttgaagcatctaaacaaggaaggctaaatttattgacgacttgtttaacaatagggatagatggatgacccaaacgactatgccaccgctctagtgagggtttcacgacattgtaggcttccttcaaggatgattgcggcaagggatagagtcggcgccaagacctcccactaagaagcgttctcctggtgattcgatccttaagaaagaaataatcacgatgtaattcaaggaaagctgagttatcatctactaagcggtgtacagaaatgagacttttcttggtttgtggaacatataaaatattctttagatgaatatttctactaggggaatgaacaacagtatgaccaatgtggcttatatccatacctgctccgcttgcggtgtgaatttgttctcctccgttgtatttttccttgacagtaagcttgtccagctccccagtaatatgatcagtggcacccatgtcgatgtaccaatttgtgtctacaccataggagctggtagccgctgctgcaacatgcttattgttagggacaaaatcttcatcatacctacaccagcagtcggtagttgtgtgtcctcgtttgaagcacaattgacagatgggcctcttgtcaacgcctcctccagacgtgcgaccgcgacctcgtcctcctcctgggttgccgcgaccacgaccacctcccggattgccgcggccacggctgctgttgtcgctgtgcccaccttggctgaagttgccgcggttcgcaagattgacctcttgcgttccactataaatggcttgtcgtgcttcgaagttgagaacctatgaatacagatcacttacagagatgggctctacccttgcgcagatagctgagatgacctcactgtagccttctccgagtccagtgatgatatactggatcaattcttcctcatcgatggggcggcctccagcaattgccatctcatctcctagagatttcattttagcgaaatactcaggagttgtcatgttacctttcttcgtgttggtgagagcgaagcgcgtgttgatgcacctggcgcgagtatgagtggaatacatcccctcaatggcgctccaagcctcggctgcagtttcacaggttgaaacctgcatgagcacatccctcgtcaaggacgagagaaggaagcccagaacttgttgatcagtggcttcccagtcgtcgtacaccgggttcgccgtcttgtttgtggcgccatctaccgtgacgctgatcttcgccggtggcttcttcgtcgcaccagtcagatggccttgaagccgtgctcctctgacggcagcactgatttgtaccttccagagggcatgatttgccttcccgagcttctctgtgatcaggtggccttgaagtggattggagttcgtcgagctagacgacaacgccattggagactgatcgcaaggaacggatcagagctctgataccatgtggaaagtttctgggagaaacagcagcactcatgctgtgcgctggatgcgtgttgatcagatgggaatagcccccatcgtggcttttacatatatcgcttcaaggaaacagatccctcaaatctaggaaacaaactgcatgtgataacaatcaaaacaaatcttatctattctaactaccggatcaatatcacatgtggcgcaaggcctatcttcagctgaatcaaccgaacccttatcatgtcatttaacatcttcgcccgtcgccggctgcacccctcccccgccgcccgttgctgagccccgccggccaaccgcgtcgtgccgccgtcatcaggccgtgccaggtcgccacgtgccgtgcccggcctcgccatctgctgccatctgccttacccgtgccaggtcgccgcgtgccccgccgcccgtagccgaccagcacaccgtacgcgccgctcgccgccgtgcgctctcccgcatcaccgccgccacacggctacctctctgcgtcgcaacacaccgcccggccgccttgcgcccgactcacgtcgacgagccgcaccggggtgaagagaaaggccaggggagagagagatagctacacactgacatgtgggtcccaccacgctgagtcagcttgtcagccgggtcaacaacgccacgtcagacgaaaccaccagcaaaacaaccgagggaggtgatttgttctggttttcggagatggaggaggcgttatacccggttttccggttgagagatgttattcacacaagcgcaagagatgagggaggtaaaatggacttatttcacaaaataaaggcgcattcgagaatatatcagcccagtccaacaggttaattacccgtttctcaataattcacctcgccggatgggcttaaatcctttttggcccagcgcgatcgatgaaaatgctgattttttttcattttaaaatttgtattttttaatatttacagaaatattatatcatccaaaatatttacagaaatggcccctgccacccaagtggagggtgacaaggtatgcgtattttgcattgaggtcctttgctgccctctgcaaaggttgcaagtgggcaaatgcaatttttaccctgccaaaaaatgtatttttctagtttttattttcatcttgtccgttcctcgcgtcaccctaccgccctcaggtagggcggcaggatctacttctgtacaacttttcgccggtataatatttctgtaaatattaaaaaataaaaatttaaaaatgaaaaaaaattccaaaaaagctcagatttacgtgtcaacgtgatccatgcatgcagatgaggaacatgagttttggacgaagttcaattattttgtcttcaaaaactatcgatcggcttttatctgagtgcagagcctcccaaccacaaaaccggatagagagtatcccccatctattaaaccagagtaaatcggatctctcagtggtttcgtccaatatgatatgttgacttaggctctatgcacctacttcctccgtccaaaaaaaaaaagacaaaccctagctaggtttccgtgtccaacgtttgattgtccatcttatatgaaatttttgtataattagtattttcattgttgttagatgataaaacatgattaatactttatgcgtgacttgtctttttaattttttttaaataagacgaacggtcaaacgttagatacggaaacccagggtttgttttttttggacggagggagtacgtgacaacatatcactataaaaaaaaacatctctaccctgttttctccccgtatctctctcctgatccttaaccgatgtaatcccagagtgcagaagcagcaacgacatcggaggatgcgtggtgatggcattggaggagctggtcgttcccaacgaccttcaccgacgtgcgtatggcaacggggacgaaggagaaggcagttgttgtgtcggtcacggagaggcatgcagaccgtcggcggcggcgcaccccccaggatgagcatgcaggacgtccgtcacggcagccttccctctcggcgaaatttcggactgaaattgatggcatggcatggcgacggacgggcgcgcgtacgtcttccctaatcccgatagaacagaagatcgcccctgccaaacctgcacagcggcgtcgccatggtcctagacgactcgacggcatcgcacgtacgtacgcacggatcgagcggccggcgtgctcctctccgcgctgctgcgtccgtcactggcttcaactcgcctagcttccagctgctctcaccgacaacttgctgctggggctcgacgtccgtccaccatcgccaccgccaccgccggccgggtgagctctagatcgagctcgtcgcacgccggtgtgaagaaattaggaaaaggtggtgaggatgctgacacctgggtcccacatatctcttcaggttcaggggagctgccatgtgacatgtgagcgctctacgtcaatacagatcgatggacctagtcaacgtacccatatactagtaattaaaagttggggaccttttatatccggttttaatttctgtttgacggacgcaattaaactcgaccaattgttgagggatttcaagtggacttttctgtgcaataatttcctttcgtgtgtgagagtggcccaaaaaatggcccatgtagcccaagttttagagcattgcagtacgtgtctatggtcacaaataagatggcgcgtaggattaaatccgtatgacaatgcgaagtgagggtagcttaatttgttacttaggttccttgggttaaaaccagtccaatcagatttaagtcatagaattgatgtttgtatttacgactaattacgctttcggtgataggtgatatatccatcgatagggagatactcgtggtgactttgtcaatcacaagcagggtttgaaattttgtttcgaaattttcgaatttttggtaatttcgtccccttcggcaagctcatatctcgtccgaaatttttgggtttttacagttttttgtcaatttgatcaaattttattcaaattcattcaaaatttcaaagttttcgaaattttggtccgccccccctcctgcggcaaaaaaaacaaatttcaaaattaaaaaccctgatcacaagatatactgatctaatcttccagaggtgttcatatgggtaaggtgtacatgtgtggattcgtagaagtgagtgtgcgcgtctttatgaacatttgtatcttttttctaaaaaagaatgtatggcaccgtagaaaaaaagaatgtacggtaatatactccctccgtactcgtaaaaaaagtcgtttaggataatatttaagtcaatccttgagaatataaatcatgaataactttcaagttgttgagtttgaaaatgtaaaaattatatgaatagatttctcttgaaaaatactttcataagtatacatatatcatttttaaatatttatttatagaaacaagaagtcaaagttatgttttggagaccatatcgctgtccaaaacgacttcctttacgagtacggagggagtagttaatacggtgagccttaaaaaaatgtttgactccaatccctaataaatttgagtcgcggagattaaagacaacgttttgacataaaacaaacaattgttatagcatggtaaatctcagtcatctgggctgcagaacattatataatactccctccgtcccagaatgtttgacgccgttaacttttttaaacatgtttgaccgttcgtcttattcaaaattttttatgaaatatataaaactatatatatacataaaagtatatttaacaatgaatcaaatgataggaaaagaattaaaaaatacttaaattttttgaataagacgaatggtcaaacatgattaaaaaagtcaacggcgtcaaatattttaggatggagggagtagtatatattaaacataccatatgctgccatgggccgggcatcactgagccaccaagcaaagtgaggaaaagcgagagcaaccatcaggccctaaaagaaaaggcaaatcaggaagaaaacggcacaattgccagccacaataacggaggcatcgtttggggagtactattccccccccccc

SEQ ID NO: 56190 - DNA, 12411 bp, Oryza sativa
cgccccacctccgacgacgacgacgccgcgtcggtcgtcagcgggtcgtcgatggccaccacggcgccgaagaaggtggaggagccgttcgtcgacgccgcctgcgccaccctgatcgccgtcggcttcgtcccgcccaccacgtcgtggaagtacaccttgaacttggtcatccccgccgcgccgtcgtccgccgcccgcgccaccgccgccgccgcgcacagaagcacggcaagaacgaggaaagccggtgacgccgccatggccggagctgagcaagatgaggaggagggaggaggtagctagagctagtgagagatcgagtacttatgaagcaagaaatggagattggagagtggttggtgtaggagatgatgaaattcagtgagatagagtggatgtggcagagcaagcatatgcaggttgccttttctaatggggtcggtaggtgaggtgagaagtggtggccaagcagtacttaattatagtactcacttcattgctaaatatttatcaccgttgactttttaaaatatatttatcgttcgtcttattccaaaatttttgtgaaatatgtaaaactatatatatgcataaaagtatatttaacaataaatcaaataataggaaaaataattaataattacttaaattttttttaataagatgaacggtcaaacatgtttaaaaaggttaacggcgtcaaacatttagtacggagggagtataaatttggcaattaagttttctgcttaattaatttattaataattaactaatatacctaattaatgtccagactaatgaggtgattagtcctagtatattagtactgggagttccgtatagtgaaggccagctactaccaccaagaagtgaccttttgtagcgtgggctgtcatgaggttagttaatgagctcatgcgtgcccaactcgtcagctaactaattaacctactttcttgtactatactaattgtagtagtataagctactttgtacagggaagcagatgtgtagtttgtacctgcagattgggagctgttgctcttgaggcaacttagattaactgtctatgaattagacgggcaacgatatgtgtactacttctttcattttagattataagactttcaaatattgcccacatttatataggtgttaatgaatctagatattttcagattataagactttctagtattgcccacatttatatatgcattaattaatctagacatgaatatggacaatgctagaaagtcttataatctaaaatggaggtagtacacttttgaactttttacagacattgaggtatcacattacggttaaatcttgattattattttttacaattttcagttgactaaatcaaatggttaagattttttgttagaaagaagtttgtatgggatttttgttactaagaaatttgtaagaaatttttagtatgtgcagccaccatcgttgtcactatcgacaccatcctcgagccctagggatgccagatccggcgtccccaggtggggggacgccagatctgatcggccccaacctcgtggtgggtcgattcggcgttggttgagttttctctccactcacgagcatcgccaccacctccaccttgagcttcggccgcccccaagcgccggcggcaacctctccacctacaagctcggtttgccaccgccaccaccacctccttcatcgagccacaggggtgccatatccagcctcctcgaggtcaggaggtcggggggacactggatttgaccgcccccaacaccgtagtggctggatccggtattggtcatgtcatctctcccacccacgagcacccccgtccctccgcctctacctcaagctctggctgccacgatcatcgtctcctttgcccccaagagccagtggacgcctctccatcctcgagctctggctaccgcctcttccaccccaagctccacctgccccctccaagcttgttgttcaacttgcaaaagaccacgacggatggtggtagcggtggaggaggaggtcctggcggctagttgcaatccttgtcggcaagctgccagatctagccatgcgagcccctatcggccatcctaggtcttgtctaccttatgagccccttccgaagagtattgtttccacagaaatttcttatggttcctcatgtgagatgtgagattatgtgattgtgatgatcgagatcttccatgtttttttccgcaagagattttattgcatttagtttgcagtgagagatccaaatgattgattcctttctgtttgtagttttttgacactgtgttgatacgacaacgatgaacaaggattaactttttattttttgcttttccacattagtgcatataagtgacgggtgctaacatgtgaactgatttttttccctattaagcagctcattgatgggtgataatatgtagtccgttagagaacaatatcacctgtgacgggtgaaattttacgatctgtcacatgtgatgagtgaaattttacgacccgtcacatatgatagtcatcactaaaggatgcctccacccgttagaggcgagaggagacaacactgaccactcatctctgacaaaggttaaatccgtcagaggtgatgttttgggcctgtcactgttgatctggactactgtagtggctggacctcttttcctcttaaagcttccgattaagctgtctcctatgtgatcctttggggctttcttggtcagtgaagtcaactgtttaggttaagatccgtcgtagcaagtcggagctgcttatcttattgtaagcttgataaacaatcgataaatcaagcatgttacaacaacaaacgatgtttaacaaacataaatgtgcttatgtatgtcgctcatcatcttctagctacgccttgacgaagagggtgtactcgacgatggtctcgccggacttgaagccggagtcgacggtgcgggcctcggcgtaccccctcgccatgcggaacttgccggagccgccgacgacgctcatctccctcaccggcgacatcacctcgttccgccccatgatcgccaggctgctgccgttgtggtcgccggcggtgaacacgaagttcatgtccatcaggaggccgatcaccctctggtcggcgaacgtgtacgtcccctgcgcgcgccccaccacctcccccgccgccgccgccgccggcgagctcgtcagcgggtcgtcgatggccaccaccgcgccgaagtaggtcgacgacgcgttcgtcgacgccgcctgcgccacccggatcgccgtcgggttcggccccgccaccacgtcgtgccagtacaccttgatctttgtcatcccggcgccgccgccgccgccgtcgtccatcgcccacgccaccgccgccacgcacagtaacagaagcagctggagagccgccttcgccatggctgcagctggagcttgagctgatcgagcaagctgaaggaggagctagtgagaggatgagtgctgctaatatataattaatgtagctactactgctgtactccttccgtcctaaaaaaaacttaacttagaaggagatgtggcacatcttagttatccaaatttgttatattaaaagagatcatattttttcttaggttgagttttcgtgggacagatgaagtatttaagatgaaagggaagcaatggatataatgcgatgggagtggttggtgtaggagatgaagtgatgaagcagcatgcacgtggtagagctttttcccttttctaatggggttggtatgtgaagtagccatctccttgatttaacctatatttagcatctccttaattagcctatagttagcatttctctgtttaattattctgtctttttttctattatatatactcccttcgtttttaatgagacattgtcaacacctaacaattcatcattcatcttatttaaaataaaataagtacaaatatatagaaaatataagtcatatatacttgagccgtgtatttcattcgtcctaaaatagtaacgtttagtcttcaaagtttatttaaaaatataacaacatctttatccatgttctcttcccaactaattacaacactccacaaatcaatttcctcacttatcttcacttgcatccaatcacaatcttccctatttaattctatctgttttgttaataattgtgttcaaccctaaaaatcctaatattttgggatggatgtggtataaaacaagtcgcaacaaaagaaataatgcttatatagttcttttagcaagataaatagtaaaattctatgttcagaaatcgataattaacgtcacacattagaaaacggagaatgtgtatagactaatgaggtgattagtccttaatagtacactagtagtgtcagtagtacaattcatgccactaccaccaagaagttacccttttttagcgtggactcgtcaggttagtaaattgcattacgcgtgcacatctcattagctaattaagcaagctatactttatagtgctgtaatatttatttagtaagcaactattaattattgttagtgacaggctgatagtagcagggaagaatgttaagcatgtgaattgtttgtacctgaaaactgggagtagtcggtgttaaggcagactgactgcgactagctaagattcttcagacattgggggtggttggatggtggtgacactgaagagaacattattcatgcaggatttcagaaaaggagttaacaatatgcagtggtgattggcctgcttaattacattttgatcaactggtttcattattatagatatattgaattaatcatccaagttatagatatgccacctgaagattttaataattgagaaattaaaattaaggtcgtggtgtcaacgtgtcatcactgcattgcagatctgtagtcactgtttgtcgatatgcatcttggttcttctagtgtgttcctatattttatcatcttcaggtttggtgggtataacaacagtaatatgataaggagagaaataattgatctgccttttgcagataaccaacttcaccaacacagattcgttcttcctaattttgtttttttttataatgagagtttttattgaaccagttaattatatcaattttttttctctccttactatttcagagatttgttattacgaaagctcccagatttaagcaaaacgtaaataaattagtccaattactcatgcacggtcctgtacctactcatgcacggtcagagagtgcacatgatggactcttgcttgcagctaaatttacactcgcagaattaaggagttgtaattaacacagtacggagtttttcatattattaatctctgcttgcgtatacattaacacagtactagtaagttagttgcgtcagaattatcaacttcacccgtaggaattaattcctctcttcttacacattggaagaatcagaatgcaattataaggactagtccaaatacaacaggtcagataaagtcactccaaacaagttatatttagagctgtctcagaggacagatgtgtttgtttgtcattggcacattagtgtgtgtgtatgtgtgagagggatgcatatatacttgaattattagtttcctgtgtcaaggaagagaagctaagaacaagacagggagagagagagagattcagaattttcagacatgagagtgactcagtggcacggtgaaagttccctgacagaagtttccaccgattatgctgagttctttagagctcattgagaaaaaaaaagccgagaaagctattagcatataattaattaagtgttttaaaaaaatatctatttaattctttaaagaaacttgtaaacaatttcttttaaaaatattgtttatcagttaaaaaagcatgctagtagaaaacaaagcactggtcagcccaaaaagctcaaaagaactaatcttaacagtgactcgtttgccaaggtgaaagccataggaaagaagttgcctgcagccatgaaaacatgattgacctgtatgactaccaaccaaggctttcagtgctgatctgtctgtcaagctatgtactctacaattgatgatcttgggagtagtttttctggccatgatcatctgtagaggttcggtggtgtgcgtaaaagataatactcccctgactggccgaccctacctaattttgcaggtaaccagcgcgtacctttgtcccaccatgttgccatcgttgtaaagcttttgttctcgatcgattttcaggttccaaatccgatcgaatttaagcaaacagatcgaacaaattcctctgtgataaagagcataacttttctctacccatttctccatctcgttttgttcagcaaagagtttatttgtgatgttcagtggtggtacagaggttgtgatgatgttccagttgagatcagagtttttggagattcttagttggtataattgcgcagtggcacatatactccctccgtttcaaaatgtttgacaccgttgactttttaagtacgtgtttgaccaattgtcttattcaaaaaatttaaataattatttattcttttcatatcatttgatttattattaaatatactttcatgtacacatatagtttacatattttacaaaaaattttgaataagacgaacggtcaaacatgtgctaaaaagtcaacggtgtcaaatattttaaaacggagggagtaagaaacatgcgcaatacgtacgaattttgtttggtttgaaatggcgaaagattagcacaaattaataagctttgcgcagctgtggtgccactgagcctctgaagactgaaggagaaagagagggtcggagaattaaactccgtacgcactgcgtagtgggccgcagcttcacaattcggcaaattgcaccgcgttgggcccgacccacttcacagatgggccttcagattatggctgcttctttactttggaggcctgaagggcgatggtccaaactgcatgcggcccagtcattttgacaagtgctagatagatgaaatactccaatacattaatctttttttttaaaaaaaaatgaacgcaagcatgtccagactccagaaaccagaatgacatgtgcgtatgaacaaagttattggccggtcgattttcatggagcaggagatatggaaaataactgcgtacggatgcttataatttggagcgagattaattcttctacctgatggcgtacgtttatgtgttaattaatttggatctaatttggagttgatcgttcatgttcgaaagggggtaatttttaaaaaaatggattatttgaatttgaccctgaaagacgtggaatgcattgaccagctgccgcatgccgcgtttctacttacccatcacgtggccatgcttacgttttttcacactatactacatccgccatggaagcttcctcttccgggtgcactgctgctgacctttctactacctcatttcaaaacataaacatttttaaagataggctgtgtttgaggaagagaggattgagaagattgggaagatacgtaaaacgaggtgagccattagcatatgattaattaagtattaactattttaaacttcaaaaatagattaatatgattttttaaagcaacttttctatagaagatttttgcaaaaaaaaatgcaccgtttagtagttttaaaagcgtgcgcatggaaaaggagtcgcaatctcccctgtctcctgtgaacgaacgcagcctaagggtgtgtttgagaagaaggggattgaggagattgggaagatacgcaaaacgaggtgagccattagcgtatgattagttgagtattaactattttaaattttaaaaatggattaatatgattttttaaagcaactttcctatagaaattttttgccaaaaacacaccgtttagtagtttgggaagcgtgtgcgtggactatgatgtattttctcaccctaacttatcagaacgaacgctccctaaggatagaaacggatagaattggtagcatctgttcgaaaaatattatcgattaatctggaattgaccaactatttagtgtcaacaagaagatcgaataaattagaaaaaactaaaatttatatattgttagagtcggaaacggcaacacttgtgtggatacgacgctcggttagtggggaaaattttccatgattattttgagtatatgttatcttgacgggatggtcagtgttaggtgaaccaaggcgtgcacaaaaatcttggaggaatattaccatccatcaaaataaaaaattgtaacaaaggtaagctaatgaagctctcattattctaaaacacattaagaacttataaacaataatcatcctcaagaatacacccctaccaacaacaacaacaacaaaaatcatagctagcgtttttttacagggaaaaaaaaagcatatgacaccacacccagcttatatattctagtaatcaactggtcaacacacagcaaaaaccggcagtaaaatgaactgatcaacacgatcatcatcttcaatatcatcgtctcaagtaatgagaatgaatgaatgaattaatcgaggcggagatggatgttgtactcgacggtggcgtcgccggtggtggcgttgaaccaccacgtcgtcgcctggcagtagccgcgcgcgaaccggaacacgccggtgccgcccaccaccggcatctcccgcacggcgcgctccgccgggttggcgccgaggatcgcgaggctgctgccgttgtacgggccgtcgccggcgaacacgaagttcatcgccatcatcagcgacagcgcgtccttgccggcggcgacgtacatcccctgcgcgcggccgaccagccgcgaggccgtcaggttgggcccgtcggtgagcgggtcgtcgatcaccaccaccgcgccgaaccccgtcgccgaggcgttcgtcgtcggcgcctccgccacctgcgccaccgtggagttgggcccgccgctcaccacgtcgtgccagaacacccgcagcttcgtctccctctgcgcctgcgccgccgtcgccgccgccaggacgaggagcgccgccgcgaacacgaaggaggaggaggaggcagccattgcttggttcggattaagctagctttagctgtgtgatgtgatttgcgacgacgtgtgcatgggtgaatttaaagggggaggtcggggacgtggttggtgtgtgctggattcgaaggttcttcgatcgtcgtctacacggcgaggaaggcgactgcaaaaatggtcggatatatgcaaacagtcaggttagaaatataatggaggataaattagttaacactagtggagaaaggggttttactccctcttcggaacccctgtactcccggttttacaacaggaaggacgaatccaggactaaagataggtatctttagtctcgggtgaaataaccgggcttaaaaatccatctttaaagatggataggggccacatcccaactgttttttttcttttatttattgtttctttttgctgcttgtatctattcccccagccaaatccacacaaatcatcaatcatgcacaataaaaatttccacaaatcaagcacaacaaaaatcatccacaatacatacacatccacaatctacaaatcttgtgagatcatccccaaatcaacaaaaaaaatatccaataaaatatacaaaccattcatcattcactacaaaaattcacaaaataaaaaaaatccagtcgctgttgtcgccgcccggccgtgggctgctggcctccttgcgcccggccaccgcacgggccaccgccaccggccgccgccaaacaatacgtctccaatccagcgagtagatgaaagagcgagccattccttgccatggcggtatgcactactacagaaataatttttctagacaagatcctctttagattgcagacagaccgtaactagtccagtatgtaaaaaatcgtactccattttcgcatacagctccttaataggaccgcacgcaaaaatcgattttcacaagtggtcctcttaaggattcgcacgctaaaataagcttatttttacaggcgaacctctcaaagagacgcccgtttcgcaggcgggcctcttaaatatatttttgtggcgggcgacgcggctgacaacgagcagcgggctgtgtggttgacggcaagcggcgagcggatccgcctccgccggcctcgtaatgggcggcggatggcgtggctgacagcgggcagtgggtggtagcaacggaccacggtggcgggctcccccgcacgttgaaggaggcaacgacagcttccttgcacggaacagtcgggcggcgagcggccgcgatggagcacggcggcaggctccgtcacacgtcgaatgtggcgaaagcggctcccacgcggatccagcgggcggcgggcaccgcccggatctgctggcagagggaggagcccggcggcggtggctagaatttttttgcgatttttaattttttcagatttttatttttaagtgcggacgatataagcacccgcatgcaaaagttgaattttcgtatgcgggtgctccactagcatagaaaaagagagattttttcataactttcctggtagacgggccagagttccgcatgcaaaaatgatcacttttggcccatcttgagatatctaaattatttacacataaaaattttggtatcatggaatatctagtagttgaagatataccaaattttacataaaaaatacgatatctcataataccttctctaaaagatgaaaaaatatattatcttctgacaccttcttaaggttagctctagctgatcgtgtgttcaatttagactttgattaatttacattgcattcttcaataattcttgcatgcttggattaactacatgtagaaattcttatggcattcttgcgtgcatgcatgcaagttggatatgttaatttattttaaattcttttggcgtgtgagagggtaggaatggactgggtcggtgatcggacttttgaagaagctggcaacagatgcagtaggtgaagtgctgactgtgaattggtacgtatgaactactcgcatcgatctctggggttttcttcttcttttcttttttaaggtgaaattagcacgcgtagccgcgtatataggtatttggtgagatgaaggcatgcttggtttaattaatttccaagcttcttcggtatatatgttctagaaatctattgatgtaattaaatatgctccgatcatcacctttggtctttggaacgtctgtacgtgtctatccaaattgtgataacagaattatagcaaagttatgttgcttctgtatgttcaaaaatcaacagatttttttttgaacgcttagaagttcttgctgacaaggcctctagtttaacttcgtttgtgctaggcttattccgggtcaagtcgggtcaacagaaaaacaaatcagtttatagttcagtccaaaaatattttgtctatagtccaagtattggcaattaaatcgtacagaaattgtaactgtacaatacttatttacagctcgttaaagccaatgtctacaacagacaacactctaaagagaaaggcactcctacagaaagctttttctcaaacgatcatatatattcagctttttcaaacagacgccaaacatgtataaaaatactgattgttatgggctggcaccgtaaccacatgcaaaatcttattttcgtaagcggacatgtgaagatgttctcctgcaaaagaattttagccataaaatctccaagataatttatacccctagccaccgtcaaatcgggtaagcttgaaggctagcgtcgtagctgcccaaagcgaggtatgagaagaggcgatgaagctgtcatcattgtcccccacgtcgagctccaccagatccaacgagcctgaagcgtgctgccactacccaaagctcaaccgtgggaagcgagggacggggagaggcgatggaggtcaccattcctgtgccgccgacggtggatccgtcactcctgaggccattggaggtggatcgactgctctcgaggccagcgacattgtccagtcagctcgcggcagcggctcttccctgtcaaagagccgtagccataaacgttattgccgtcacagtcctcacacaagtgcaatggctcgccgccgccacccgtcgccggccacaaagccattgccggcgacctgctcgccgtaaccatattggtggctcggacccggctggtctggataatattagactacaccgccgctgccatagttgttgtcgccgccgacgttgtattgttgtggttggcagtggcgctgtcaccggcgccggcggcggtgtggtctgggttagggccagagcgctc

SEQ ID NO: 56191 - DNA, 9688 bp, Oryza sativa
gtagagcgcgcgcgggaggaggtaggaggcgacgatgtcggcgtcggtggggtcgaacttgaacgcgggaaaccaggagaatctcgagaacccgaacctccacgcctccatgcccgccaccgcaacccgctcctcgtcctctcgcaccgccgccggcgcctctgccgccgatgaggtctgctcatcttcttgcaggctacgcgccgaacgtttcctcgacgtggaagccatcgaattcgttcggagatcgatcgctcgatgggtcggttgcaaatttaccttgcaaattaaatacagagaggtttacttcgattcctactcggattgtgtaagtgtaatcgagcgatgcgttgctccccacgtcggccggcaatcgagtcggcgagcgcgaggatcgccgcccggaaggagattcttcctcgccgcggtgacgagaagcagccggaacgccggcgagcgcgggatctcgatcgtcgccgcggccatggcggtttcgctagccgccgcgcgcaccataggtccacaggtcaagtgtgatgcaggcgatgattccgagacaacgcgaaccgttcagattagatctaacggctggctgtggtcaactttgagtctttgaccatgacggctacttgatgggcctaattggcccacataaaacgtgagacaccatgggctgccttcgttggtgaaaacgggcggtcgttagcacgtaattaattaagcactactagctattttttaaaataaatgaataagtatgattttttaatcaattttcgtatagaattttttttaaaaaagaacgtaatgttttatagtttgaaaaacatacgtgtggaaaatgagagggggagtcagggactgctaaagctgttgacgaaaaaatcgaacacatcggcctgggagatctgcttaactccagtgcaggtccaaagattggtgagatgcgagcgtgccagtcagtttgatcctgcaactgacaagatatgcaaatagtagattaaaacagccgatcggccgacaagccgatggagtagttccagccgatgccgataatagccgatgccgataccagccgatagcgatagggtttaagcaatcgactatatgtccaatgtagataatgatataaaggcaatcggctgacgatgatgtaataaaataacaatgtaatcaagtataaaccaatcagcaaataatgatatgataaataagcatcgatccgaaggtcaaagcacacatcggctggaggtccgatgtcatgaaatccacaagattagcttaaacaatgaagcctttgttgtcatcggctaaatccaacttatatgtatatgcaatccttatgagccgatgcaacgtccagataactcaccggctgaaaccccgatgaaacacttattggcaatcaagaagcaggctagagattatagttctaagcacgacttagtagatcaaacttaactgatgcagcactaagtatgaaaagaaatataatatctagacaatcaagccgttgactgagttttcagggtggtagatgtctaagctaatctaatctagcaacgcgatttagccgataccggcagaaaccctaaaatgagaagcagccgatagaactaaattgatatgctaagactagattaacagagatatatgataaatagataggcaagtatatcatccaaaccagagcaatccaagaggtcgaatgtactgatgcagccttcaacgacgccgacgtaaacgatacaattgcctgggccgatggaatattggacttatcccttcaccggagatcgaagacgatgcagccccgcgtcgggtgccaagttccgccgaaacgtaaaaacaaaagtagaaataaaaagggtggcgatgctccgaattgtattgatcgtggagatagattacatagaccccgggtgtacatatttatacccaggggttgatacaagtccttgtcggacaagaaagaaactaacctaaagataagaaagaaactaacctaaatataaaaggaaaatataaagtccttatcggacactaaacacactttcctaaagataaaaggaaactaacaaactattcctaattaatagataaactgccatgccgtatcctctttaaactcggtcacttagggataagctccctttaatagattgatttccttaaccgaatatagcaggaatccgactattggcgacttgataactcccatcggctgattccgagatgctgcagccgataatgattctaagcggatggcgtctttaccgattatcaaatttcactgttaacagccgcccatatcgcttgacgtatcttatttgaggccagagttttaatcacgatactcaacggtaaagtcaactataatatattttctcattaaataaaatgtcaaaataatatcaagctcgaagtatgactgacgtgacgtctatgttaataaggagtactcattacaacgtaacatattatcttaatttgttttgttaaaatgttgatggttgttttgggttccatgcccgcatgcaacatgtagctaggatacggattttcattcctcgacggaacatccttcgttatttatataccatctaaatatttataaaattttttaaaaaaatttataatatagattaatacaaaatatatcactccacaaacatgcaagaccaaattcaacttctacaagttgtaacaaaaataacaaattaaactaaaaatagttatcgtatattcgcaactatatttgttatttttgttataacttgtagaagttaaattttaacttgcttatgtttgtggagtgatatattttatattaatctatgttgctaattttcttttcatattttttatgactattaggtggtatgcacgaaactagggatatccctcgagagataaaatcattttccccatgtacctaatactattctcatcctaaaataatttcatttttcatccatctcatgtataccaatataaaaccaagaaagctaaattactcttaatttatcaaatcgcaatgtaactatttttcaccttattttaaaataataatttttattataataaattctaatttaataattactctaaaaataaatttattttatgctaaatagaaggtgctaattaaaatgaactttattacgggatggagaggtagtacatgatacagtagtaattgacacacaacgtatcgctacctggctaactaattactccctccgttttaaaatataaacttctatgatcggattagatatttcatacgtcctatccgatattaattaggttcttatattttgacacaaaggaataataatgaatcagttaatcgtggcggatatggatatcgtacgggacggtggcgtcgccggcggcgttgtaccagtacgtggtggcgcggcagtagccgcgggcgaagcggaacgcgccggtgccgccgaccacggggatctcactcaccggcctcgccgggttgggcccgaagatggcaacgctgctgccgttgtacggctcatcggcggcgaacacgaagctcatcgccatcagcagcgacatcgtctccttcccggcgctcacgtacatcccctgcgcatggccgaccagcctcgacggcgccgtcaggctgggcccgtcggtgagcgggtcgtcgatgacgtacacagtgccgaacaccgtcgcggaggccctcgacgtcggcgcctccgccaccttcgccaccgtcgagttcggcccggtcaccacatcgtgccagtacacacgcatccgcatctccttctgctgccccgccgcctccgccgccgccgtcacggcctggaggagtagcgccgccgccgcgagcacgaaggacgacgaggctgccattgcttaattagctagattaatgtcgaaacaagatttcggcaataataaaaggggtggctatcaagctaggaaagtggatgagtttggagacaaggaattttatataggttcaggccttcttattcaacaagtaatatcctactcctgtccggagatgattccgccgagtacgttattgattgtataaattggaaaaaagaatcgcgccccgagaggcacacggaccctccttatataggggaaggagtccgctttacaaaatacagcccatatcctaacggaatatgggattatagataaaatacaatcgtaaccgactaagatctcgggtatttccttgacatacaagtaaaaaactaacccgagtcttcataaagatattctatctatatttggtaccgtatatccgactaaattataactgtcatgtagaaatgggatatccatattctccacagtagcccccgagaccttcgcagttgacaaaacaaccttctcgaaacaaaaaacagcaatccgagtgcttcaattcaacttgctccagtttgccgagtgctaaaatcaaagactgcgaagggcgaaaataaaacatggtgcatcgagtagatgcacctaattaggtatagcccccgactatgtaattagttgaaaaactaaacacgtagtcaagaaccgagtggttttatcaacactccttgaacatatcaaggataaaaaaatatgaaagggccgagtgataaacactcaaaaggtccaaaaatagacatatttgataggaatccgagtaagaaactcttaaaatgattcaccaaacatgataaaaaatcacggtaattaatgagtctaatagcctaggctgtgacccttacaataaccaaaataagcatataacatgctaaaagaataactattagtaaaccagtcatctcaaatcaacccaaacagcttttgcagcctaataaagcttacaaaaatggtataacacctttctgtcgggcaccttttgtttgcatcgtgttaattccaaagaattatcaaaccgcattaaaaagggttttaacagcattggaccacatcattgtgagcacaaattgccaaagcaaaaagtgcctaagtccctaaggatcacaatgggccacgctggaaataaaattgggctgaagtactgtgccggcccaggcctgctagcgctcccgatactctaatatcaccgaagtgaaaaatgtctcttcgtcttccccgccgagactctcaccattttccccatttcctgctacagtacaaactgcgccggccaagctagggttcagcaatccgctccaatccatcctcaaacactccacaaaatttctacccgcatccaccgctccaattccccatccctttccagccgtatctcggaccaaatcaaaccatccagtccacattcatggcggaagagagagaaagcttcgagagccagtgggcgtcctccgatgtgacggaagataatctaaaggagatggtggcgcacggcgttcttccagcaaaggagatcatcggatggcgaccagcattcggcgaagcattcccgacccccgatacacacgaaatcgtggtatttgctcatttcttctatggcggattttctcttccaacctcaaggttcttccggggaattatgaacttctacaggattagcttgcatcatctgaatccaaactctatagtgcatatcgccaattttattcatgcctgcgaagcttttctgggcattaggcctcatttcgccttgttctgccgcatcttcttcctcaagccccagccaaacaaaagcaaaccatgtgttgttgggggtgctggtttccaactccggggaacgctaagccaaaaatacttctccatgcccttcaagacctcaaacaaaggctggcatgcaaattggttttatgttcaaaaccctgagcctgctctccccgagtactcctgtcttcctccagtttatcgggatacttggaactcactgccaatgggagacgaagctgcacaagcagtggaactgatggagcgcatgataaagctgaaagaacaaggccttcagggagaacagatcacacggcactttatcaagtgtcggttagctccaatcaaagagagatctcgcacagccttcgaatttgacggcaagcacgacccaaatcgtgaagatccagattctcttgacttcaaggtcatgaaggaaaggatgtataagatcttctctaatgctatcgttgtcagctattcacacttgctgccagtcgtgccattcaatgcctttaatcctcctccaccggtatgtaaccgaacacttcaacttttcacagaatacggtcttatctgtttgttgaatcagttaacaataaaggatgtcacgcccaggaatttgctctgatgaaatcggatccgccaatcgctcaacgccaatcacctcaccgccaaactggtcagggaagcggaggaccaagaatccggtctgaaactcaaccaagtgctcctgatccagtcggccagccaaattctcgcaagaggaagctggttctaagtgacgacgaaggcgacactgctagaaagcttggagaccgagaggcaaccaataaactgccgaagcaggctactccaaggaagaaaacatccagtcgtcttgtgccaaagatcaggaagtcttctaggtgcaactcatattacgatcttcattgcattgatgcgtacccattgcgataatagtactgacaatcaaacttgcaggaaaccatctgatatagacccatctggaaaagactctgacccgaccaacatggaggcgagttcctcaaaagaaaccgggccgactgcaaaagatctcccgagtgataatctgtaggccagcaacaatgtagaacccagcgacgaacccccgactggaaaccagtcggccgaagccgaagccggagttaatcaggagcccccgactggaaaccagtcggacgcagggccaagccaagagattctagaagttgaaacccaagcagacaaccctcgcggacaagacgccagcaatgactggagatctggatctcctttaagggcatccgaatccactcgtcctcgtccagaaatcattacgggtaaacactttgtctgaaaccatgttgacccaaataactctgatcaattgtctaacctttgtcagtggatacattaggaccaatgattggtgatgaagaagaaattcaccgtggtcaagtggatacactttgccgaagattcgtgctctcccattctggtcaagtggtgggatgacaacttgcaacctcaaggaattgtaataaaccggcaaaaagaagatgaagaagtctgcctactgaagaaggcactcaaccaagcgacttgcattgtaaatgtaagttccttgacacctgacctcagccatcatgtttgccgtctggctcgagcgctgattaaactgctctgcagaggattcatcttagaaacgaggcgaaaaccgcaacccttgagaaactagttcctcatcttggaacccttgaaaccaccaggagtcaactgcacgaggccagagaacttgccagaaagaatgaacacgatctgagggatcggattgctaagctccaggaatccaattttgaactgagtggctcatccaaaggttcgcgcaaactctgcccaactgatttgtgctgttatctctgtaatcttgattaaccgaagttaatgtagtgcaagctgccaagatatctcaactagagaagcagatccaaactctggaaaatgacaaggcagagctggcaagacagtgggattcggctttaaaggaggttgaaggtaccaataatcaatacctcaaaagccattatcttctatatgctgattcattaatgtgaatctgttgatgcagaccgcaagatcaagtctcaagcacagtttgatgtcttagttgacaagatcaacaagcttgaaggagccagggataaagtcgctaatgccgctactccactcatccaggcaatgttcttcaataacgccggttcgagtacacttgatactgccgaaatcttcgacaagctgagagtcgctccagatacttatttcaagaatatcaaagaagctggaagtatgggagcaagtctggcattggcgatgaccaaatccctttatccaagggttgatatggatgccattgatggctttgcagacgggacgagcgaagaagctgctcttgacctcattaacgatgcacagaaagccgctgacaagattgctgctgatgtggttgaaagattccaagaagtcgaccttcggccgactggatctgataagtctgatgatgaaaaaactgatactgattgatataacaatgattttgataattaatgatgatggaggctcaatttgtacaatactgatgaatttatgctatgcttggtgttccatacttagcttttgatttcttaaaagcctttatctagccttattgagcctaaaacccgcaaaagctattaaaaaccttcagtcctcattgactaagtcgaaagaccaaacagggcaatgataaatcaagtaagcaaattgaattgataaaaatcacactcaattattatcatagtagccccccgactgaaaacttcaaggaaaaacttgaggttagcagtcaaagaggaaagatacaaacgtaatgcctaagcataaaattgatgaaggtgttcaatattctaagaattgttgatgggagtaccatcttcgcgcttgagtcgataagaacctggctgtcacgcccggaaattcactagtaatttccgaacttatttgtgcattaaaccctcgtccaggaatcagccgaggtacacaaactgacaatttaatatatagatttatcacattaactaaaacgataaatacttacttaagaggcacttagtcctcaccatgaagaaaactgcagcggaaaaataaaatctagcgaagctccggctccactcccacaggcagctcaactggggtataagccaaacgtcttctccttctggatcctttatcttcaactgaggttgattgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagagtaattaattaaaaattttaatcaacactgaacagcacacccatgctgcacaggcccaaccatcctgaacaaccatacccggctgtacagatctaactccaaaccaggagctaagcaaattattaccagttatagcatccataattatcgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccatgctggcttgtggttggcacggtaaatgtttcacaacagtagctcgcgaaccggtccttaattgtcatgagcacaaccatcaaaaccatatgc

SEQ ID NO: 56192 - DNA, 1636 bp, Oryza sativa
aaaaagaaaaacgatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacgacgaacgacgacggccggcgactcggcttgcacggtggcgacggctctacgggtcacgggagaggacgggagagggggcaaacgaaagaggaggactagggggtcctatttatagccttggattgaagagatcggactcctcccgcaagaaatcgatccgggaaaatcaaaactcggttttggagataaactcgaaaacgagtttgattcggataaaatacccaacgatttgctccgattcttgggggaaaagatagaggaggatgagaggatcaaaacccctcaaaaatccggaagaaacggggtcggattggagcggatttggaggcggaaggcggcgcaaggtggcggctcgggctcggcctggctgcagccggctgaaggttagggacgacactgtagcagggaggcaaagtagacttttgacgggcttcattttcctcggcccgattgaaggagggaggcaaaacagactttgacagagagagagaggagggggcgggcggcggcagctgggccgattgggccgattcggccgcgcggagagagaaagagttgggccgaaatcggcccaacgacttagggaaggatttaaaaactttttccaattaaaataatcacttaaatgatctttcaattgttaaaaatacttccaatgctcaaataatttcaagaaaaattctgaaaatacttggacactcaaagtacttaaaaaaattataattagaccatttaatgattaatttaatatgtgggtaattactgaaatgctctttgtatgattaaaattaagaattgagctccgaagaatccgagaaaattccagagagtataattaaccatggagaatttaataaaaattaaatccaaccatgctttatatttaggaaattttatttcccacatttaacttcacttgtaaattaatgaacatttaatataaattctattattaatttattaaataatttataaatcctgaaacgaaaatcaggatgtgacactggccgagtaacttcagcaattataaacggtccttcccataagggagataatttatgccgatcctgtgtggtttgaattttcctcagaaccaggtcgccgactaaaaaggctcgcgatcgaacattccgattatgataacggcgcaacccttgcaaataccgagtcgactgaattaaagctgcttcacgggcttcttctaatcgattgatgtcgtctactcggccctcttcataacgctcctcgttgaagttccaaaatcgtagtgattcaaattccacttcacttggcaacattgcttctgcaccataaaccaaaaagaacggcgactggccggtagcccgactgggagtagtgcgtaaagaccaaagtacggacgacagctgattgacccacttgccagcatagggacgtagtcggtcgaaaactcgtgcttttatcccttgaagtatcatgccattagcacgctcgacttg

SEQ ID NO: 56193 - DNA, 7919 bp, Oryza sativa
ctttttgggagcttggcggtttcatgttaaggatggcgttgattttctccgggttggcctgtatgcctctttgagatatcataaattcgagcaacttccctgacggtactctgaagatgcacttttcagggtttagtttcatcctgaaagcatgaatgcttgtaaaagtttcctctaaatctgtgatcaggtcatccttctgcttggtcttgacgactacatcatcaacataagcttcaacattgcggccgatctgagtcgagaaatatctctgaatcatgcgttgataggttgctcctgcgttcttcaatccaaagggcatggtgatgtagcagtaggccccgaagggtgtaataaacgaggacttcaagcagtcggattctttcagtcgaatctgatgatatcccgagtagcagtccaagaaactgagtaactcgcagcctgccgttgagtcaaccacctagtcaatgcgaggtaacccaaaagggtctttggggcaagacttgttgaggtcggtgtaatcaacacacatgcgccattgccccgtctttttccgaaccaggactgggttagccagccagtctggatgaaggacttccttgatgaagcccgctgctaacagcttggttaattcctccttgatcgcatccttcctgtcctgtgcaaaatggcggagtcgttgcttgatgggtttggcgtcttccttaacatgtaaagagtgctcaatcacctctctaggaataccaggcatatcggatggtttccatgcaaagatatctttattattttgaagaaaggtgatgagcgcgcattcctatttacaatctaactcagcgcctattacagcagtcttatcaggattagagggatctaagggaatctttttcgtcttagcattgctttctccgcttttgagcatcttggttgcgggcacttctccttcgcttgccatggtcgtagccagtcggatctcttctcggtcgagtgtaatctcgcgggtctgggccatctcgcaacgttctttgtcacatgtgacggcttgcttgatgtcgcttcgtagtgatatgactcctcgaggaccaggcatcttcatcatcatgtaggtgtagtgtgggacggccatgagtttggctagggccggtcatccaagtatagcatggtacgctgtctcgaaatcagcgacttcgaaacaaacattttctatgcgaaaattctcccgagtgccgaaagtgaccggaagagtgatctggccgagtggtgtagctgataatcctgggataacaccgtggaaggatgcattactcggctttaattccgtgcgaggaatctgcatatcgtccagggtcttagcgaaaaggatgttgagtgcactgccaccatcgatgagagttcttcggagcttgacattgcgaaccactgggtctagtaccagggggtaccgccccgggtggaccactcggtcgggatgatccgagcggtcaaacttgattgctatttctgaccaccgaaggtattggggcatgttgggctgaatcacattgatctcccgttctgttagcttctgctttctcttagattcataagccagaggtccaccgaagatgtgattgagttctttgcgatgatcttgaaaaccagtcggggcatcgtcttcatcgtctttcttctttgatgtgccttgctctccgtttgaaggcttaagtgcattcttgacgtattgctccgcaaattgtttgtagacgaagcagtctttggccacgtggttggagttaggatgatgcggacattgggagttcattatcttgtcgaatgtgttgacgcggggacgttgtcgggaagatggagaggttgttgccacaagttcttcgggcttacacttgcgatccttgcggttgttacttccactccctcctgcggtcggcgtgtccttctttggcttccaagtggtgcctgactgcttggacgccgtaatagcatcttcggctttggcatactcgttggctttttcaaacatctgcttgaccgtcttgggaggtttgcgtccgaacttgccgactaggtcctcgtggcgaatgcctttagtaaaggcggcaatgatgacgtcgtcggtgatgtcggagatcttgttgcgttgctcggagaagcgccggatgtaatctcgaagggattctccagacttctgaacgacgttgtagagatcaaactgtgtgccggggcgttcaaaggtgccctggaagttggcgatgaagtgatcacgaagttctgcccatgatccgatcatgccacggggtagtccgtggagctaggatcgggcgaatccgctagagccacaggcagatagtttgccatggccttgctatctcctcctgctgcgtggattgcgagaccatagacggtgagccaagactcagggttggtggtgccgtcatatttctcgatttcagtcggcttaaagccggctggccaatccactcgacgcagatcgcttgtgaaggcagcaacgccgtccacatcatcgtcataacgatctggtgaatggtggcctcttgctgcgcggcgctggttgatggtgtcgcgaagatcgatggggcgccttcgatgtggggagtgtggtcgttcaactcgacgctccctatatcgttcgggaggcgaacgaacagaccgttcatcatgtcctctgctcctgcgactagatccggcgccggcaatgctgaggcttggctggtgatagtcttgagatcgaagatgagggacttggctactagtcggggtgcgggtgcttgcagagttggctggaaccgaggcagcgatcatggtcttcgtctggttcaagatgttgacaacatgatcagcttagttgagtgcgtcttccttgaggagggtgtcgaggagagtgattgctgcaaccgcgttctgctgggggatgcgaaagaccgctgttccgtcgacgtcttgttgcccaatgagctatctcgctcgccgcccggattccaaggcgcgttgccgtcgatcttcagcctcctttgcaatcctttcgtgatcttgttgctcacgctgtagtcgttctcgctcctgtcgctgtcgctcttcctccagtcggcgacgttcagcttcttgccgtgcgcgatcttggtccgcttctcgggctcggcgctgttcctccgtttcgttggcagccatgaatacgccgaagaagaggggcgtgtagttatcctcatagctgtcgtcgaagttgtcgaggtcgccgtggtcatagtggtagccgaagtcgtcgtagtcgaggatcttggttggtcaagaactgacgccgggggagctgaggtagccatccatctcttccgtcgagactgtcccaagaggttggagtataacgccaacctccctggatctagactagatcggggccgatgccggagctcgcctagatctccgagtgggagatgttttggctgtgaagacggcagccaagtcatcaggaagtttcatcaagattgaaggataggacccgtcgtcttgatctggtcgcggaggagtagattggatctcgtccgagtggtttgaagccgactcggaagatatgatcttggagtaggcctcggccgagttcggaataccaaacggcacggggacctggtctctccccgactggttcgaatccgagtcaaggagagagatcttgccgaagtcgttggtgatgaagttgaggctgccgaaccagaacgcctgcccgggagggaaggcgaagttgtcgatgccagaaacggaacccatcgcacttagtcggcaaaaacttgacgctgcccctacctggcgcgccaactgtcgaaacaagatttcggcaataataaaagggggtggctatcaagctaggaaagttgatggttttggagacaatgaattttatacaggttcaggccttcatattcatgaagtaataccctactcatgtccggggatgattccgccgagtacgttattgattgtataaattggaaaaaagaatcgcgccccgagagacacacggaccatccttatataggggaaggagtccgctttacaaaatacaactcttatcgtaacggaatatgggattatagataaaatacaattgtaaccgactaagatctcgggtatttccttgacatacaagtaaaaaactaacccgagtcttcataaagatattctatctatatttggtaccgtatatccgattaaattataactgtcatgtagatatggaatatccatattctccacagttaatttatcgatataattaaagctaggtagctatagggtgatctacataaaaaggcaagggggtggtggtggttgtgtttagttcgatgatttcgtcgtcgtcatcgtcgtctctactccctagacaaatctctagacaaagacgaagacgaagacgaagacaactagctctgcaagctagcacatctgcacatgcggcatgcaatacatctagctagcaatggaggattagttaattgattttagctgatcttgtgtgttcatcagtttagtattcactttacattacaattcttttaagggaaaacagcacgagattgtgcctttacattacatgattacactgatcttgcatatgatgggtaatgggttaatttgtaatgaagtaatccatagtccatactagatacttttacggcatacacgctgcaagttgggatatatatggactctgaggaagctgacagaagtagtagatgcagtaggtgaagatcagctggcttggtttagatttcttcaatcttgtttaacacttattttctccatcccaaaatataaaaaggactatgatattcgatgagacacattctgctactatgggtctgtttggggagcttttagcagctgtagcttctcctagaatctccagtacttaccacttgccagaagctcaccaaaacagtccagctttttatccaaattctaagaatttgtggttgtagaatctggaaaatgaactagaagacagaagctgggtttcccagcttctccagattctcactagctagtttctcagttgctgcttctcaaaattttaagctcccccaaacaagccttatgaatctggacaactctctattcatattcatggtattaggatatgttttattcaccaaaatcttctgccttatattttaggatggatggagatacttggtggaaatgcatgctttagttatttaaattttgatgcctcttctacacgtgcctccattgatcggcaggggtataccgctatatatgatatatctgtgggcttgattataacaactcaccttctcatgcatcgtacgtgctgtcgttacttctttttttttgtttttttaaaaagatcaagattttgtttggtttaaaattaagctgccgttgtaatgcttgccaaatagagattattatgtggtgtgtctattccagccaacaactcttgtctcgatcacagatcttcctgtaacagtaatattaagctaggtaaaaaattatctaaattttataaaaccccacttatcatgagccaatttacataaaaccatagattttagcatgtgacacataattatggtccaaaagttttctaaaaccacactattagtgttaactgttaaggataagacatacctcttatatttgggtttgtgctatatgaaagtaccacatacctaataatatacaggaatatatagtcaattaaggtaatacggtgatccgaaaggaaattgttttctagggatagaagatgtcaaagtcatattcagagaaaataaggtcttcttggaccatatctaattcaggttctctgatttctactttgagaaaaagatgatcatccctataaatacagggtcccaataaggggaggatattgaattacaagccataacaagagcaatatcgagatacaattcggaggaagccaaagccctagtcgttgattgtaatctactttttccctgatatacatataaatggaagtagggttattagtcatcttaaggccccgaaccaatataaacacttgtcccttgtctgctagctagatatgatctcaacgtttttcatactctacaaatatcgtaggtgggcaccatagtccatcaacacatggcgttaaccaaatcgacatactcctatatcaaaattcaaaattgtatgtttacatgtatgtaacacttatataaggaataaatagcttataattcaaaatgatcaatagtgtggttttgtaaaacttcatggccataataatcaaggttatgtgttacgtgtcaaaacccacgtggttctgtacaatttagaccataatagtacatggggttagttgaaatttactctaaattaatttgagtcttaattcatgggtaaggtaaagatcaaatataaaacgtacttcctccgtttcacaatgtaagtcattctagcattttttacattcgtattgatgttaatgaatctaaacatatatatatatctatttagattcattaacatcaatatgaatgtaggaaatgctaaaatgacttacattgtgaaacagagagagtaccgatgaaacggcccatatctcgatgggcctatttacggcctcttctgcaccgacgagcaagacagaccgtgcggaagagggccatgctagtgtcggtggctgtggcgctggcggccgccggagatgggggcatgaatacaagaaaaaaaaatccaagcaagcaaacactttaaaatttgtttgcatcttatgatgaactgttttcttgtgagattttcttttgtcgcttcacagtttcttggagacggtcacccgggccaggtggtttccaactgaattaagctcgatagatccatgtgatgtgccgcagtcactgcaaccagctgcaatagatgcttaaattcgtaagtgaactcacaataattcttttcttgagcgaacctttcaaactatatcatgttgccattggattttaattaagttgtaatgttaaggtactgcctccgtttcacagtataagagattttgattttttttaatcatcttttatatgtgcaagttaatttatgtccatcctgctaattttttccccggttagatgtgcaagttaatttatctttctcaagaaaacgagataaattagaacaaacttttgttaagccacttcatcaaagcctcgttgtagaaacgggtacaaaatgcatatgtaaacaattatgaaacctgaatgtgaacaaactgttttttttagaacgataatgccaaccatgccatattacagaagtttttgtgattgtctcgagtagtctgaaaacacaagtttttttttttctacagaggcaacaagtttgttaagggccttatacagcaatttcatggatgtttgttgccaaatgttaactatttcctctgcatactactacacgcaagtataattatattgcttgatttttatagaagaattatctccgtcccataataattgtatttctaccattcaaattttatcttaaaaaattgtatttctggtaagatgggacacaacaacaaatggaatgtgtacccccaaccttcattttaattaagtttacatatcgaatgtgttgctcaactttccttttaatcaagtatagacatatagaatatgcgcatgcagtgtagttattaaatatatatggttattgtgataaattgtgtttgatgttaatctatctctaatttctagaaatgtaattattatgggatggaggtaatactatgtgagaagtgtaacgtagtacattccacataaataatatcttcacaattgtcaatgtttccatttttttacagcatgttttttttgtgcttaatttctttaccattgcttcctgttcatttatactacattgttggcgct

SEQ ID NO: 56194 - DNA, 6326 bp, Oryza sativa
tgatgagtgtactcttatttgtgttggccactactactaaggctgacatggaaggcaggtctaggcccaacgccttaggcaacagtttagtgccgacacacctacacttctacttccatgacaaggtgaccagtccgtcaccgtcagcggtgagggtagtaaacccgccaaacaacacatcgttgaccttcttggggatggtggttgtcatggatgacccattgaccgaacggcccgatcccgcatcaaagctcgtgggccatgcccagggcatgtatgtctcgtctgaccaagcccggataggcttcttgcaggccatgaatatcgtgctcaccgctgggtcgtataatggaagcgtggtcatagtgcttggcagcaaccacatatccgacattatccatgagatgccgattttgggcggaaccggccactttcgcttcgctcgtggctatgcccaagcccgcacctactttctcgacccaaacggacttgatgccattgtcgagtacaacgtttatgtcttccattgatcttcatgctaggttggcttaattgttgatgctattattccctccgttccctcttacttgatataagatactattcatgtataaacttggaccactcatctttatgaaaaaaaaaggtataaatattctattatcaaagtaccagtcccgacattccatatggcttaacagtttaacatgcactgtgttgactagtgcaagccatatggaatgtcgggagtactaaatttctaccacatatgtgccccgtgtaataaggaagacttaattcatgcaaggtttgctttaattactaatcttcaaagtttgaagattggtctacgacaacgttgtccatttcgggccaacgcactgtgacaccgcccatctcgcgtcccacgagaccgtggcgctcttcgtcgactcgtcacgccatcgttatattcgtgcaaagatttagcgatatcaatggtatatttgtgccaaaaaaaattacatcctaatatatttccaaatttaatcatccttctagagcgtatagattaatttggaacaagaattgtacactatagaaaagggaccaaattaatgctagccccgcgacaccgccgcttgtcgtcgcgcgcactgcgataccgcggcgacgaactcaggtgggtttccatcaattaactactctaattgatatctgttctgaaaaaaaaattgatatcattagtaattaattcatttatattagttaccgatgacatcacgccgcacatatggcgtggctagcgccgaccagctcaacacctcttgtttggcgtcgagaacgacccgtgcggcctcgccatagacgcagagctcgggcaccgcccatgcgccttggctcctcgcctcccttcaccaccgtggagcgggtgattgagctccttggctcctcacttccgatgacatcgcaccacgcacatggtgtcaccggtgccaacaggctcaacacctcttgcttggcgtcgaggacccacacggcctcgccgtaggcgctaagctcggctgccacccatgcatgtacaatatcgtcccctgcctccaagaagaccaagaagagaagaggagggaggagagagagaaaaatagaaagaagaggaggatgcactgacatatgggtctcacactgaatcagccggtcaaactaagtcaatgagctacattagcaaaaaaaccgctctcaaaaccatcaagggggtcattttgcatcgattttaataattagaggagcgattgagagataagaattagattaaaactatatatatttgaggaagccaatgtgaacttatgccaaagtggaatatatttgattgggccgcatgcgtagcccaaaatgtgtggcatctgatgtgggttagccatgccggccccaagctgcagcaattgtagtagggagtacctatgcatctttcgaaagatttttataatcatatcacacagatttttaatccttggattaaaatccaatagacacagtaaaatgcaaaaaacaactaagaaacaccataatggacactatatttccatatcttcagaaaaaaaagaccaaatccaatataaatttcaaaacttatatgcgaagattcaaaaattacactgtaaattacaaaagttacagtgtaaatttcataaattacattgtaacttacaagaaaacacactgtaaatttgagtgagaaaatcgagtgagagataagaaaaaatctttcgagtgagagataagaaaaaatctttcgagtgagatatagcaaaatcgattgtagtaagcaagcgaagcaactgtggcatctcttcttatattcttagagcaaggctaatagtatagccaaatactagcttcaaattatctatagccaatttatacaattgttgcttactatactattaatacttagtctcacctgtcatacacacattatgtcttggagtccgcgctgcagctggctacaaatctgtagtccgctgctcttctttcttcgcttttatatctctttaaaatatgtttgtaactggcttatagcctgctattgtacatgttcttaagttagctcacagtaaattgtttccaaggaaacccattaaactacaatatttgatcttgatttcttaagttataattttatatattttttctaaataaggaacatgtgcaatatacttagaaaaagggatttataagattatttggcgaaacttattttctttatggtgctctctatcgatagtaaaacttcatccaaaccgttaatttattttctatatgaaaaggttagatacttttattatactaacacctccattaagtcgttaacggtagcagaaattatcaacggaaaaatcgttttaacaaataacggcatggaggggtaaaatcttttgtcgctctcgttcacaatcacaactcctggggcagctctccgccactcagcaaatcggaggggactcgactgctgtattctctctcttcagccatcggaaaaatatttttcccaacaatagtctatactaggaattttgaaatattggaagctataaggtatttatatgtggctgtgaaaaatgatttttctctaaatatattacaaagttatataaaccttccaaacgaattgaatttttttccaacaatttttttacagcataaatatttttcctacaattgttttatacaacttctgaaaattaaaagataaatcacattttcattggttctcttatagtaacttttagctacacaggggcatatattggtttttgtggacaatatgatggtcaactgacattgaccaccagaatggcaaaagaggatggggcactaatggagtagtggtaaaagagagaaatgcaaaattttgatggcgggacgaaaaatacggtttcaataagtggtagaagaaaaaaattcccaactttaatcgacatgcaagatcttgaggcaaagggactgactatgtaacattcacaagaaaatgcttcctcatttcagtcacttttggatgccctggattgctttaagattcgtactattacagttcttctactttatcatcttctctgtcgttctcctttacacaatgcttcaaatcgcgcctaatctcgacgataatgttgcctccctcgccgattgcgccttccccggccttgccctcatcagaaggcgccaatggtgccagtgaggccatgtcagccatcatgcaccccatctccccctctctccctctccttcccatcatgcggtggtaaggtgccccaccccattgttttccacacctcctaactggtcaggaacccacacccccgctaccaatgttggccaaccacctgctaacgatcccgtggctttagctccacccacatgttctgccacccacggccgtctcgctaagccctgtgaacttcccccgtccccggtccccccccccccccgtccccttccaccccaacttcgaaccctaaacctaatcggttgggctgtcgctaatttcttgagtaagaggagaagaccccggcatgaatcttgtggcgaatgggacagcagagaatctgcaaagattcctctaaaaaatctatcgaattaagtctaacaaatattttttaaaagggttaattggatccatgtgattacgagtttgccgtattaaatagggttaattgatatgcttaactatcgtgtaggagtatttcttagctcagcttcagctccaatatttgaaatattcacgagcatccagtattcactattcagatcgtatcgtgtgttttgtgaaatcggatgattggcgttcgttataccatatccccatcgattctccaaaagaaaacattaatagagcattcagaattctttaaaaaaacagagcattcacaagcaaaggatccccttaattaattctttcagatataaaaacaaccagcaacattcattgggtcatcagagtagaggagggtttggttttttttcaagttctagatttgaatgatagacgatgacagcgatgcgtctacgacgacttcatcaacctcaagatataccagtcaaatctctcagaggtccttcaagggatagagtgtgtatgtgcctttataaggctaagtgtgtgtatgtgagcgcctaatgtgtttttagaaaacaattatttgaagagggaattgatacaatttgtttcagtgtcttcgaaaattgatgccatccttcctctttcaccgaatcatcttttatatatttggttcccttccttcgtgtgcaacttaattatttgttttcctgtttagaggtgcaagttagttagtccatctttctcatgaaaacaagatgaattagaacaaattggttgagttgctgaaagatatccactccaagctggctgagctgcttcagaaatgctggcaaagagatcgattgagaggcattggagatccttcaagactcctcaaatgtgccatttcttttttcttttaacacaatatatatgtaggtgcttataacacgcacatactctcatttcaataaatgcacatgcacatattctatctctgtaagcacatttaaagactgggttagtatatcttaaaatcgataaagtcatatgacatatgtctcactgtcgatggtatgttttaatgcatgtgtatcttaatttgttattactccctctagtcatttttacttcatgttgggagagttaagcttagctttccccgcatcaaattaaagtgataggagggagtatctaattatggcaaatatcatcaagattgtcaagagcttcattttttttacagtatgatatttttgcgcttagctccttacctttgcttgctcttgagtatattatgctccagaaatcagaaatgtacattctgttctagcgtccgatgctggcgcttaaaagcttaattcatcacgcaattcgaaatttttttctaggacttcgtttactctctccgggttgataatattagtcgttttggacaagaataaagtcaaactttaaaatctttgactacaaataatttctaaaatatttatcttaaaaatataaaaaccatatgtgtagattagtcttaaaaagtacttcaataaaaccatatatttatattataatagaaaatagttgtcaaagttactttttagagaccgtgtccttgttcaaaacgacaagtattatcaaatcggagggagtaatttagttttctctaggagcacattgttgtgcacaagtgatattgcaccgtggactttgggcgtggttgggcccttgctttcagcaaactacaaggcatcgtccttcggtttggagaactaaaaattaattaaccaactagtttggagattcggggtactttactgaaagtaacacatatatttcttatatgtgcctcaatgttaaccacacttaatcatacacaatctaaatgcaaattaagtaagcattacaatcttttattctagtctttcggttcagtcgatctacaaggacatgtcaactaaaatgtacttccaattggtcatgagcaacaattaatagatagccataattcctccaatcgctgctcgccacgtgtccctcctccaactcatatatagagccctagagctcccatgcctctataaataggatgcgagtgttattcactcaacacaaactctaagatcaaaaaatggcaaaggaaatagtagtgatgagtgtgctcctttttgtgctggccgccactactaaggccgacacgcaaagcgggtatgggcatgggtgtagctccttatgcaatagttcagcgccgaca

SEQ ID NO: 56195 - DNA, 1234 bp, Oryza sativa
tttgggtgtggttaacagctcattagcaacttgcttagaggctttccatgtccatgtaatatttgacgaggaaaacaaatactccctgttttcaatgtttgacgtcgcttattttttaacttacttttgactacctaatcgtcttatttaaaaaattttgtacaaatataaaaatataaaagtataagtcatacctaaagtacaataacaataaaataaaccgtaacaaaataagattaattatatttttttaataggtcgagtctccaaatatatgtataaaagtcaatagtgttaactattaaaagccagacggcatactattactcctatacttaagtaaccaaaccaagtgtatcggagtattttacctatagtcaacactgtatggatcgatgtgcctcaatactgtccacatgtatatacaatctaattgtaggtttatatttaaatatcactcgatcgatctacaatagttacaagtcaactagaaaacttccatctatcatcgtccaaccctctagctcttagagctccccatgcctctataaatagctcatggtcgagttatatcactcagcacaaccactctaagatcaaaaatggcaaagagattagcactaatgcttatgatcttccttgtgctgggagccagttgtaagggccacacacatggtgggcctgggcctagcccctcaggccatggctccgagccgacacacctacacttctacttctacgagaaggtcagctgcccttccccatcggcggtcacgatggtgaacccgccggacaacacgtcaaataccttgttcgggatggttgtggtcctcgacgacctactaactgtggggcccaattcgagatccaagcccgtgggccgagcccagggcatgtacgtctcgtcagaccaaacctggatcgggctcctgatggcaacgaacatcatgctcaccacctgtcacaccccgaagttctcctcccaagccaaaaatttaatttataagcgaccctaagaaaataccagtgcaaagtaagagtaaacccttttaaatcaatgcaaataataatcggaattggcatgtggaatttttcttgagttctacatgtcgaaattcactaacaggatttttagtggaattttcagagccctagaaataattttaaccaattaaaattgagcaagcaatattttaattccaggaaatccttttctcctttttctttttatttt

SEQ ID NO: 56196 - DNA, 1090 bp, Oryza sativa
ctatcatttgtacgaagtgagcgtagctcaactagtttgcatggttttccttgtggtgcaactagcaccaagactcaagttctatatttaacacgggtgctcgtatttaaggttaactatatttcagtggtagacaacatactcgtcaacagcgagacgcctatgatgatttcgtcaatctcaagatataccggcatagtcttctcgagatgctcacagagataggatgtgcgtgtgtgatgacttcgtcaattttaaaatatgccggcacagttttgtggaggtgctcataggggcaaggtgtgcgtgtgtatttatagggacgagcgtacgcatattatgaatgtctgcgtttgtattgtgtttttaaaataacctatcattgttactataatcagaataaataaatatttgcactaatatataggacagagctaatggtttggaactggtatgattaaatcctggatgcatcaattaacgttatctgcaatgatagaacagaatgaattggaacatttctggtggtattaaagacattttacagtttttaagaggtaagacatctgatacctgaggtactgatgatagatatcatttttttaaaaaaaaagtacctccttctaaagaagtatacaatcacgtgctggtggatacttcctccattccaaaatatccaaaatataaagcataaccacttctaacccaaagactaagaaaataattaatatcatcttgtagtttggatcatcctaacagatacaatgcatgcatccaatagaattagagaacatgagaatggaggatttaaaaagtaataatttaatggataagaggtaatagttaatggcctacatgcatgcataccttatattatgaaacatgtaaaaaagtggttgtgtcttatattacagaatggagagagtaatttcttactatggatgaagttctcgtcatcgtgtgtgtgtgtgtaaaatgaagcatcgcccaccgtttcaccgataatcatatatgtatatatatggtcactgagagcacaaatgaacataacttaatttaatttgctactttccttgtgatatcttttttt

SEQ ID NO: 56197 - DNA, 1732 bp, Oryza sativa
cttttaagcctaattgctctatgatttgacaatgtggtgctacagtaaacatttactagtgacagattaattaggcttaataaattcgtctcgcggtttactgacggattctataattagttttttattagtgcccgaacacccatgcgacaccctatataataccttatgtgacacgccaaaactttacgcccctggagctaaacaccccctaatatgtgttgcatgtgtgttaatttctagttgtctttagtacatcatcattgatggtggtgtgtttaattagtttctagtaagaagcttccatctttggggaataaagtggcatatatatgaaagctaagaaggcattgatcttcaaaaaaagaggctaagatagagaaagacaccgtccgattgttctactccatgcatatataggagatcatataagttctattcctctagggttctgaagaatcaactaggttagcttaattatacgtacatatgccctggtccctctgtttgctaagcatatacattaaaaaggcacatctgactttggtctcctccattgaacatttgtactggccattaatataatttgaaggtatctaggtgtagttgggttttttttcttattggtattggatacacaatttgatccattagatccaaaatccaaataatctgaccaatcatcccctcaacacatataaagctccctggaaattaccttaatttcaattactaaatatatcttactaataagaaatcaatactatgtatttcagtgtctactaagcaaatggttcttcaaactgattactgaacaggttgtttggcaagagaagaaaatatttgaaaaaacactcaattactcaagtagggtcaaaacaaggagattctcattttttttgtcgggtcttgtgaaagctaaagataaatccttacttctggaaattgggtagtaaataggggcgaataagtaagatcttgggggatgtttgggttgggaatttccaactctatatatcatttttcgtaagagaaatgtctcgatcgcaactgttatgaattttgttccgcttaatgtttcttttaggagaacgttggttggtcagaactgaattaactggtataatttaattgtcttgattttgtatactagtttgaatggatctaatgattctttcaaatggaatcttcatcagaatagaattttctgttagatcaatatatttatctttgattaataatggttttattgagaggaacaagtttatatggaaattaaaggttccaattaagattaataacttttgtggtttttgttcaaaaagttgtgatctaaccaaggataatttagcgagaagaaattggaatgggagtcaaagatatttttgtttgtataatgagactattcaacattttttttaatgtcatattgcaaaaatttctttggagaatagtttatatttcctttggactgaaaccccctgatagtatatctaatatggttggaaattggcttagtggtgttgagtcaaaaactaagaatctcatatttgttggagcttctgctttatgttgggctctatggttaagtagaaattaatgatgtttttgataaatctccaactaaatcttatatgcaagtgttctgcagggcaactttctggctccggttctaggcacaacttcaaaagtgtgaagagaacaaggagctcctattttctacatgtcgaaa

SEQ ID NO: 56198 - DNA, 4279 bp, Oryza sativa
  unsure (1)..(4279): unsure at all n locations
ttatggtgtatcaaagacaagacaataaattaaaaagctcacatggtggttggatgcattattgttttttttatattggaaatggtaactggatgcgttattgttaatagacattcatgcttttctgatagaacatgcctactcacagtatcccaacaactaatcaaggcacttaatcccaagccatacaagctaacgtctactcctccgtcccaaaataatctaatctagtacttgctaggtcaattttttttagaacggagaaagtatatatcgtctcacaaatttcaatctctgaaagcatttaaagcatccattagaaccatttggcatctctgagctagcgttcatagaacttggcttggttagactaagtacatatcgtatcatgtgagatatgcatgcatcgatcggtgggcttatttatatacatgtcattaatatttatgagagttcttgcaactaacattttgggtgaatttactatcatattaattactctctcagtttctaaatacatgagagtttgtcctaaacgtcacatataaaaacgaagagactaatttgatgttagggtttgtaatttacaaaacataaagttccacgcatggcaatcatagaagaattcgatgtgtcaacgatttcgcgctctataaaatagggagaaaatcaggaagaaaataaaggtggcatggtgactcccgaacgatcatgattgtgcacgtcatatttaatttcctcctccaatttgttggatgtagagtttttaattactgtattttcatgcaaccagattaatttgcactctctcctgtcctgaatatttgactttaagaaaaacattttatcaacattttaaaacattaaaatcaatagcttctgaaatgcttcgttaaaataaaaggaaaaatcgtatacatggatttgccttgaaaagtagtactatgtattaaacttattagatttattctaatgtagaattgatggtcagagttcgaatggtttgatggaatcatgtttgcaactgtcaaatagtattaattatcagagggactataacacccccactatatattttatatatccatccaaacatatgcttttgttggtgtgtacttaagttattacaccctaaaaggtagagattccaaagaaatcaaatgcttgcatgtcattggcaccggccacttggtcaatgttttcatgttctcttatggttcactcaaaaaatcagcactaatagttccggacaaccttctctacttgtcattaaaagctgccagaaagttctgggcctcttgccaagaagttccgggctctatatttaactgctaaaattttaagtaattttcagaaacatatattcaacccttaggtgatatctccgggtttcagaaacaaggggacatcatatccccttgagagaaaaaaaaacatctacccacactggggtggatctatccgggtctagggtagttagagttcaagccataggcctagaacccaaactctatgcaaattccatttaaatatcagaaaatcttaggaatttgtagagagtttggataagatcaatagaactgagcctatgtacccacatgcctgcatgtatgtaagcaaggacttatttttttttctttttgtcttcagtcgttggctacctaattaaacttattggaggatcacatcgcaaaacctaatcgatcagctgtttataacgaatttgttcgtcaatattccacacttccacaggatagctagctaggacgaaaaaccaggagctattaggcatcaaaccagaatttgttgtacatgctttcttccctcctggacgtattcttgagatcctaattaaagacatatattctaagctacattattgtggatgaatcggcaacgtgcagtttatatttttgaccagatggtattcatgtccattgtacatctccaactttagaaagatcacgctgactgaagtagctgaaccaatatgcaaatattgtaggaaagcgatagagagtgtaaaaaaatcgtataataaatctggtcgtcggctacattattcaaacatgcatacaaattaatgtatgcatgtcaactccagccaatagtttgtcagccatatatatatataccgttaaagaaaacggcttgctcatcatcatcatcaatcgtagactttgtcatatactctctccatccctaaatatttgacaccattaactttttttaaatatgattgaccgttcgtcttattgaaaaaatttaagtaattattaattattttcctatcatttgattcattttaaatatacttttatgtatacatatagttttacatatttcataaaagtttttaaataagacgaacggtcaaacatgtttaaaaaaatcaatggcgtcaaatattttacatatagttttacatatttcataaaagtttttaaataagacgaacggtcaaacatgtttaaaaaaatcaatggcgtcaaatatttagggacggagggagtatatgttgcaagtagtattcgtttaatatatataataatccccctttaggtcacacaaaaaacattatagatttaagatcagagaatgctggccaccgttaattaattgatatatatctgcatatgccgttctacatttcatatttaatttgaatatagttatatatgctctcaagttgatctggacccatgcggcatatatacaatgttccaacacactctcagtcatcaacatgtactaaaagaatattcaagacttaccctaatcacatgcatgcatgtctctctctaatttgatactaatctgatcaccttttgcgctatctaacacgctacacattcttaacatatagctaaacaggtgcatgcacacatgaaattcaactatataagtatatatctttggccacttgaattggaagaattggaagcattgtcaccttgtggctgtacgtttatatatacacgtgttcgatcatatattccatacacggatacactgtacatgtgtgctgcacccacattcatatatataggtagatattacatatgcattgatcacacaacacacatgtatctcttgtagctttcattttcgtactaggtgcaaatcctcatctgtaaagaaaggtagcatttttaaaaagggatcgaattaaattaaaaaggttggagatcgatggagatggaatttcgtcccatgaggggatgtcgtccctcgcttcttcaagtcatggcatgttctccaaatagtaccaaatagagttcaatgtgttgtttgtgttacaactcatataaatcggatttgaacttgtattcatataaatcggatttgaacttgtatcgttcttgagtgatatattacatataaaccgatttacatacctgattaactttttaaaattaaattataaccgtttagattatatgcaagaaactatatatatgacatctcttaaggagcaaaattattttcccatcgatggatatgaaagcactcagtttgtcggtataaatagctatcagcgtcaaactatccgttaggaaagacatttgccgacacgcagtctaccaccagcatctacgagggatctacagcagtcgggaaaagtttttaccggcagaatgatccaaatatatatcactgatctgcatcatatcgtacctgatactgttcgaaaaggccggcatctatctatctatctaactgcagctgaatgatccgatgcagctgcagctggtatatatcgagcacctaaacccacttcgatctgcaacttgcagggaggcaccatattcgattataaatttcgttttattcgatcgatcgatcaagagagagcattagcacatgcaggcacgcgtaaacgtttcagatggcgacgatcgaagacgacgacgacgacgatgatgatcgatcagttgctctgctgctaatgctgatcagttgatcgatcgatctttcctatcactttcgcatgcagagaattaataaagtttagttgagatcgatcgaatcgttttatgttgttgttgttttcttcggtttggaattgattaaagtagtatcagtactaatcgatcgcctgatgtattgctggagatttttgttgttttgtcgttcatcctctgtgggagaaatttataaaggactgatcgatcacaaaagtgaaagtcggtcgtcaattaattaattaattaatccttgttgatctcacatgcagtttgagattnnnnnnnnnnnnnnnnnnnnnnnnnnnnnnnnn

SEQ ID NO: 56199 - DNA, 808 bp, Oryza sativa
aacatataatcaccacaagaatcaaaaactttacttccagttttcttaaagtgaacctgaaaagtttcatcaacattttgtgaaactgaaagcaaattatactttaagtactcaaccaaagctacattcttcaattcaaatttctcatttaccttaaccatacctgtagcgagaacggcactcgtagcagcatcaccaaaaataatcgattcagtcttagatgccttctttagggaggagaaccaatttttatcaccggtcatgtgccgcgaacaaccagaatccacgatccacacgttctccttccttgccaccaaagcctacacacaagcagaagtcgaagcctcagtactgggattagatgacaataaaattttagaaatccagtactgagacacacgaccagaagatccaataggcatatatccacatgcaaaatcaattttagaattttcagaaaaattcctccgaggccggtctgaccgagggtgtgcagccggtctgactgaggcttcaccgccggtctgaccggtggttggtctaaccgaggctattcagccggtctgaccggtcgtcggtctgaccgcgggacccactacggtctgaccagtttcctcgagggaaaaccagatttttgccactttgattttgcaaaagcaatctctctctcctttttctgtttatgagctaatctgaaacaaaaaccaacaatatgtccatctttgccacaaaaagaacaagtatatttttcatgatgattagacacattggtagaattagaagatttagcaacacaagcaacaacatg

SEQ ID NO: 56200 - DNA, 4329 bp, Oryza sativa
atcacacggtatagtttttgagttctttgtgatcagatcatgaagatgagtcgtttctgctctgtggttggcatcgtttgcggctccccgtcgtcttcaggcgatgaagcttttgcttcccatggcgagcagcagcaggcgacgacgacgacgacggcgcagtcttctgggaagagctcgagctcgaggaggaagacggcgccggaggcctccggcgagcacaaggcgggcggtgaagcgccgccaccggcatccaagaagacagcattgctcgacaagggcaaagagaaggtatgatatctataggttactactcatgttcgtcttcatcttcttgtttgaagagcagatgctactctttcttgatgcttgctaattttgtggttaaaaactggatttgatgcagtggttttatgcattgatttgatttctttgggatgaaagtttcagaaatggtggtgttccagggagaagaatatgctagggcatcatcatgcatatgctgggttgagataaaaagaaacatcataaatgtgggatttaggatctacgttttaaacatattcacattttttttttgcggggaagacacattcacagttttttaatttgtggggaagacatattcagctttgtgtgtgtgtgtgtgtgtggaagacatattaatagattttttttttatttgtggggaagacatattcacagtttggttatgtttttgcggatcattcatgaaaatgcaccatttccttttaaaaggaacctatctatttcaatatttgtgatgtggctaatcaagaacaatacatcgtgcatcaattagactaaatctttctttgatcatttaggtatcagaaatggacacttctgtcaggagaaccagcaaaggaatatcaggcaatccatcagaggattccaacgaaccagtggctaaatctccgacactgaagaccgtgatcggcagcataaggaactatattgctaccaaaaagggtagaaaaataaagatcctggcctttgaggtagccaacacaattgccatgggttccaacctgatgaacttcctctccgaggaaaacataaggtacctgaaacgtgttgtgcttcagaaccaaggcgtccaaagtctgatctcagatgatcagagccagttgcttgctcttgttggggatgaaattaggtaattaatgactttttctataaatttcaatgcttttactatttatataaattattacttatatgtgtttttcaagatttcttacattcattgggcttggtttatgcagacaacagttcaaagattttgcggcatctgttgctaggcttgggaacatgtgcagggatcccaaatggcacaatcttgaagggcatttctctgggtaaaattttagctgccaccacattactgttcttgtataattcatggctcaatcatattttattctatctgagtgttcatttgtgtgcctcttgtcactgcgcagattggagtatggtcccataactcaggagtattcccatgaaaaagcagcatccaagatggaggatctgatggaacttgtgactaagacaaaggtgtgttagtcacatattttctaatgtcattaccactgttggttcaacacattttctttttaggaaccactgaaatgatgttgctgttctattttcttctgtgcagatactgtttgaagcattgcgccgattgggagtctccgagaagatgtacagggaagccaagcagacaggtgcttcccaaaaccatttgtgtgatcagcacaactaatcagaaatatgtctatttatgttcttcacatcagttcttaacatttttttatatgtgcaggtatgccacttgagactttccaaaatgcggtgaacattgaaaaagaaatcgtgcaaagcgcaaagaagaaagcactttgggtcaagaagattgaaaaagtacgtaaaaactgtgtgatatgatgattaatgtttatcacatttttcaataacgaatttatgttaaatacacaaatgctgtttctgttgcagattgtggaggaacttgtgtacattgtgcattacttgccttctgagatcaattgtgtcttctacaaggaacatgaagaggatagatctgtgaaggctaatgggagccctcagcaaactttagggtctgctgatctccagctgaattacgcaaggatcgttatcgccatacaagttttggtaagattctttgacagtcattaggccattgttctaggatcttggtcattgatcaagtgtagtcgtgcatgatataaacatatttccggttttcagttgatttggcacactaactgaaatgtcgaaactgattttatttgttcataaagtttcaatcgcaggtatccgtcgcatcatcggttccgcaatgtgctgtagattcattgttccatgcactgccttatagaatcagatcagttttgctacctaggatgagacacggcgattttgacgaccaggtgaccactcttttctgtcaattccgattacctgacaaaaatgtgtatcctgtatatactgttcatcttcatttctttctgaactttgcatcttcttattgcagaggacagaaacgcagatcgccgatgagatgaccaggagacttgaatggctctatccaatggcagaatttacaataaggtactgtaatctcttgccatatacaccaggttcattcaatgaataataacctgatgctcaccttgtacatatctgaacatcaggctgtctcagcaccctggaatgatcagagaatgcctggtatcagggtatataactatgactgtcgtgtctattttgtcatgaacaatatgcaaaagcacaattgctgatttcactaataattcctcatgaaattcttgtaggagcctcagtgaccgtgatcaacgtaagatgctcaaggttcagacactgtaccatgctgataagatgaagactgatggctgcatcattgacatggtgatggaccttcatcttctcataaaagccgcgagactgagggctgatgcgccgcaccatagcggtcctcttgatcaaccagtgagtaccagtggatcatcaaccagctcggctagcacaggcatcagtggatcgaccagcttcggtaacattagcaccacttggtcagatattgatgaagatttcatcgccgtgatcgattagattcaaggtgtagattccctgcaaattctgatgtagggagagggatgcctgaaaatagagagggttttagctgagaactgagataatgcagaaatttagtttatagctctttagatactagacaaggttggtttaatgttcgcgcaatatttgagttcatgaatctgtatttgaggagctcacatgtacattttgtgcaaatggttggaagagagaagaaaatgtgctgaacatttttcctccaaataatcagaatttcttctccaatatcatatatactagtgtgatcaataattaaagatcatgcttaagcagggaagcagggatgcttttttgggccacttcaccttaagatcatagtggggatggcagaaaggagcagtcatgcttaaagcaatagctagtgctcttttttttttctaaaaaatgtcaaataaccttgataagatttctgaacttttgtcatggatgttgcacgcgtgcagactatacgattacttgtttgcaggtaccatcattggcaaattatttttgagggtaacaccattggcaaatcgatgagtattttttcctcaaaattgacacttgcatcttgcaggggcttaaattagcatgaacactttctcaattgaatggtgatgaacaacataatgtgtctacaacacatgtgctgatgctttcttgtttactcttctactcaatgagatactagtatatgatttcaccattgtttagcaatgagctgactaaccaaaactgcatcaatgcagtctctgcagactgaacttagtttgtgaagtaaaaatgtgcatcacacattttcaggtaaggaaataaataaatgcattatgcatcacaaacaaagctcccactggtttaagaaatcaggattatatgacagaagtttgttaagcctgcaactaaaagttgtctgtgttcttcggtatagtgtgttactgcaaccaagaaagttattactgaaagactaaaccaagaagaaccaccttttatagagattctagaactccattttttttgtatcaagatcaacactgcagcaactaaactcccctgtgttcttgagtgaatcactttcaacaagggccattattttcagaggagaaggcaaaa

SEQ ID NO: 56201 - DNA, 1168 bp, Oryza sativa
ttcttctgggcgggccgccctcgcaaccgccgcaagtgtgaccacaagggtgatcaccaccactcccttggcctccattgttgagctcaatgtgagcaaccaagctagcttcttgctatcgtgtgagtgagtgtcactacttgatgtgttgttcaggtgaagctcatgagctacttatatagcagtgccaccatggtcttggtgtgatgagctctatggcgtgcaagggaaggcgacacgtggcgggcggcgattggtctcaaaggctggtgattccaggtgaccttgtagtactggaagcaagagaaaagatcacaagtggtagggttgatgagcacagatgcaatgttggctttacctttggaatggcacaaacggaggcatcgattggttgcctgtggttgtggagcaaacactggaaaaagttttgtggttggtcggcttctagattgtgtcaaagaaactgatcaccaagctaagatcattgtggatcatatggattattttactagtagaatttctttgccactaattgcagagggaccagatgatctgggttgaagctactggtgtacgaaatcaaatcaaatcagatagtttgcccttcttgttgacggagacatcttggacatgatgacttggatgttggtttcagatgttggtagaagtagtcgttgaagcttgaaagcagctaagctatactacctccgtaaaaaataaaaaatccaaactgtatgggatgaaatatttttctagtacaacgaacaatcttatgctagaaaatatcccatccaatattagttgttgtttttttttgacggagggaatagactatagggtgatctactactactgctctcctatctctgtcagacgctcttcatgcgctctgaggcgcatactagatcgatcactagatgaatttgttttcacaaaatagatgaaacaaaattgtactccggaccatcttggtttgaagccaagtcataccaaattgttgacccttttaatagtactttgttagtatttgttttgctatcaaaatgtgccaagaacacacattttgataaaaaaaatggtgttggagcaaatccaactagtgtattctagccttttctgttgcgttcctcctcttcaatttggggattatgtacacatttatagtctg

SEQ ID NO: 56202 - DNA, 1530 bp, Oryza sativa
ttttaccgacctcacataccacatagactaagaaccatattagctatatactccacaatgcatgttacttatagtgggtcttacctatctctctcctcacttttatctctccccctctctctcctctcacttttcccaccagtctctctctctctcgggcggaggaagcgaagcggcacctgtggcgagcagggctccacacctccacctctcctcgtcagggccggaggcagcgatgtcatcgtccgagcccaaacctctccactgcctccttcgccgtgggtcaaagctgccggagccggagccattgctcaacctcccgctcctccgtgagtccatctccatccctgccgacgagccggacaccaccaagcacaagcgagcatcggggcactgcccccgcagctctagaagcccaaacaacatcggcagtggccgccgccacggccacaacgatggcagtgtagaggagaggtggtggcatggcccaagcggtgacgacgccgggcggggctccacgtcgggcaggcaaaagatgcggacgacggcgccgccgagttacggatctcgggaggctcttctccctctccgtcgcctcccttgtcggctccgaatcgacctcggcggcgcggcctctctctcttcgtcgactccttcttccaccttctatcttcctcattgctgctgccacgcagtggcagcctcctcgagctcacgctgtggcggcggcgacctccccgagcccacacgtcggatctggccgaagaggcggtctaggcggtggcgtccccaagccctcgcggtggttgcagaaaagttggaggagaggagcggcaacttcggatccattgtacccgcttcccaaggctcatctcccttgctttttttgacaatgttagctgaaaaataagtgcccttatttggacgcgtgggcttcaggtgggtagcgccagagatggatgtggtaccaaatctccaacgtgtcacacataggctgaatgcaaacaagaagctcggtgaatggcctaactactcccgccatcctataatataataaccttatatacattttttttatcaagagcctgacgggtcccatttcttttattagaaataaaacatcgagctacagtagtcttcaaaaagaaacaggaaataaaaacggaaccttccacagagaaatgggggttaagaattcaaaagctagccctattacaaggggttcctgactcttttcagaagttttgcctgaacagatatctaacagcaaaaaagaaggagagggaattacaaaacatcatcacttatatctatctcatccctcaatccttttattgttgattctccatccgaactgcgagttgtagacttcatttgccgccctatcttatgagtctggatcccagtagcagtcttcttcgacttgcctcctccttttgcagtagtgcccaggaatcaactcaatggcaagccaaaaagatcacatcagtggggtcttttggataaactttttcaaaacaagctttattt

SEQ ID NO: 56203 - DNA, 2313 bp, Oryza sativa
ttagttaaattccatcgtagtttgttattgcagttatcttttaattgcacatcaccccaactagtacaaattttgtgccaatctctcaatctccctccactcaggtctctcgtaaacttgatgcaatttatccctttttgtttcagttttgccacagttatatgttttgtcaaagtgatgttgtaaaggttggggaattgttcatttaaaggtttgccccctatccagctgtcctcccagaaaagtgtcttttcaccattgcctatcaccttggagcagaatttcagaaagatgtttttgatctccatgagcccatgccagaaatgggagtctccatttttaaatttcaataaagatatgggtttgcaacccatgtatttactggtcaaaaagctttaccaccaaccttcctcattttccaatctccagatccatttccttaacaaagctttgttcattgtttccaaatctaggatccccaggcccctttgatctttgggtgaacataccaccggccattgtaccagatgataaccttgtatatatgatatgacacattttagtgctatgaatctgggcatgactcgattggtatattttacaaacgaggtagtaaaagcagtaccacatgaaggcaagaaacagcgatgactgttcagatgggcctctcaagctcattcattcaaatccattttctctatgggtttccggaccagtatatttcttccaattgggctcgcagggaaaccactactctcataagagaaaaaaagaaaaaaaagaaggccacagcccacagcaacacatcgtattccttcccccgttacacttacacaggaagaaaattttctgttaggagtaaattgcatcgccggtacacgaacttgttaggtggggcaatctagtgcacgaatttgtaaaacacttgttttggtgcatgaacttatctggtgcgtgcggaggaaggcaaaaaggacattacatggctaatcttattgatttaggggatgattaggatactatgtaaacatatatctgagaaggttactattagatatacacctcttcaataaaaaaaatagaataggatatagtgatagtagaaaaattttaaaaaagcaagcaataatataaatgttagaaatatatgaaattcatcatttccataatgagggataaagtagataccaaatttataaatatggcatgtcttatgcatgcttactacacgtatacacgtcacatcctaatcaacatcaacttcgtaaaattaacatttataagttattttggtccttgtccgcatgaagtagacaagttcatgtaatgaaacgagcgttttacaagtttatgtactaaattgtacccacctaacaagtttgtgtatcaccaatacaatttactctttctgttagtatataaaattaatataagccctccaagtcacaaaagctagcttaatggatacgattttttttcttttctttttgcgaaacatggcaggttatattaaaaagcaaataccttttgttttactaccaggaatgccattgttgagtaagccatattcaattacccgccagcaaaggagagggattgctgaagcgtacagtatcagccaatgaaccaattgggtagtagtatatcaatccatagatacagtagaatatcaaaataagacataggcactgtactcaacaatggcatccctggtgttgaagtccacaaaataggttgtaaaatcaaaggtgtttttgattattattctgtgatgaacaattgggcattggagattattggttttgttatttagaatttattcacgaagtggttttggagatgattggatttcacaggtgaatctataggatactgctgttatttcatgttaccgatcagaccgggcagtgtgtgccggtcagaccggtggtgatcgagcggtcggaccggccagcccgcggtctgaccggccgatgctgtgtcggtttcggtttctggttgtttatttggatatccgtgattatttcatgattatgacttctagatggatactatacgtatgtaatactgttgtttgctactaatgagtcaagttggagatagcttggtctcggaatatggtttctttgtttatttcatgtgtaggtgacttgatgtctcgggagagtatttgcggtgatggaccgggagtcggcttggggataagacgacatccgtggtggtcagagatcatgcgggatacttaggctagagttgatgcacgtggttgatagagattccatatggcataccatggaggtattgtgtgcgtat

SEQ ID NO: 56204 - DNA, 715 bp, Oryza sativa
ggttcaattgatcatctttgttcgcattgtcctaagcttgggagaggcaaaaagaagacaaagatggtgagaagaccaacaacaacaacaagccgaagggttcataccaagggaggaagatggagaatcttaggaaggcttttcaacaagtttgcgccgcgttcgagccactaagtgatgtagatggtgagagtggagatgatgataagggaaagaacatctccgatgtttgcttcatggcgcgtggtgaatctgacacagagtatgaagataatgaggtaagtgcttttgaggaagctattaatattttgagtgaaaaaaaataagaagtgtgagaagatgtatagaaaataggaatttatcattgaatctcttaaatctgaaattgctagattaaaatctcttattcctaatgatgatgattgctcaaattgtgaggttttaatgaatgagatttcaaaaattagagatattaatgctgcacatgatttgaaaaatagatattctcttgcttgtagttttgcgttacacacacgcactttggatgagttgtttttaaccaaaaagttgttgcaaaaatatcgaattgcttttcatgctagtttgatgtttaacatgatttctgctaagaagttaaaacaacctcatgatgttttggattgctcaacatgtaatttgaataagttgaaatcgaaagatgctttaggtcgtgtgg

SEQ ID NO: 56205 - DNA, 3398 bp, Oryza sativa
ttttttagggaagtcatcaggagcacataaatgttttatcaagaaagccattttgcatagtataaaaagttcgaaattaactgttaacatatattgtagtaaacgaatgttagcatttggtagtaactgtcattaaaattaaattaatagaattttcactgattttttttctgttttctggatttccttttctagcaaaacttatccttgtgaattctagatctgtagattttttttttggcatttatctcaaatttaatctatgtgaaaggttttattttagatttttgttgctgttcaaatgacttattctaatggatttttacgagatgaacttttattatattagtagtgagctataaaccaactataaacttatgtgtaagagaaaaacaaagaaaatgcatgagtgttggctcttatacaagagaaagagaaaagcttcacattaaattcatagtaagaaaaagattcagacaaaaaatagagcaaactttatagttaatttattatacatattagctctaacatggactaatagctaattgttagctctattattaaacttgctcccatgaaacaccatagaggtttcaagaatttctcttcctcggtgcctctaatattgactgttgccccattcagtagaagagcctacggagttattgcagctgcagctacaactaggcaacaccattctagaccctcttcattactgcacatgcaggactgctcactaacatgtgggaccgatggtcagtggacaatgggacacatattattgttggcttgtaattgtagtaaatgggtagccgaataggccctgtatagaatgatagaataatttttgggagtagattacatgcacgtgaaaatttattaaacttcagtataactatcgttttgttattatatatgggtttagtttaattttgatttaagtttgaatgctttttccacgtaattttgtatatttatgaactgtaagtttatttcatgtttagggtataataatctactgctcaacattttatgaagaaaaaaaaaggttctcttttaaatgagtaagtaatggagtaacggaaaccattgaatcctcatctactccctccgtcccaaagaaaaacaaaccctagtttccatgcccaacatttgaccgtccgtcttatttgaaaaaattatgaaaaaaattaaaaaaacaagtcacgtataaaacattaatcatgttttatcatctaacaacaatgaaaatatgaattataaaaaaattttatataagacggacaatcaaagttggacacggaaaaccagggtttgccttttttttttgggacggagggagtagatgagaacttttaaaaatttcaagcacctgaaatctgatactgccataattctttatttgcgccgtgggccctctcatttatttttttatataatatgtggaaagaatattctatccttatttttttcgctcacaggttttctcttaattaccttttttttctctttttttcgatggtgcatgaaaatactagtactatcttatactgtcgcttttcctctttctacgagtgtcagatatggtggagttcgagttcccaatgcttcagttggcccgccaaagccatccaatttgccgagacggacaccccgcgcgcgacgccacgccaccgcgcgcgaatttacgcggttgcccctcggtggagtccccttcgccgtaattagcccctacaaggaggggcagtctcggcgcgaaacgttgactcccctgcactcccccaatcccctccacgtcaacacggccctgccacgtcactggcgaactcttcccctgctccccggcgtgagcggagcaggtgcggacaaaacggcccctccaccatactaccagcaccacctgacaatttgcgttctcaccccaagttaaactcgtaattacgtgtagccccctcctaggctcaccatttataggagattttttttttcaatccggtacttgagaagggttggaattaggatttggggttcttccttggtgcctggtaatggctaaaataatccggcctagcgcacggtgcactcacgaacgaacgactgcctcggccagtgggggcgtactggtaagaaaagcccactcgttactcgttagtgctgcctccgcatcatctgcttgctacgctttcctttctcctaagagcattcccaatagaaaccacggtagcagtggtcttatatgaaccatatagcctaagagcatgtacaacagcgggctaaaagtcagctgtaaatatattttaaagagataaatgagaagaaagaagggcagtgggctatagatttgtagccagctgtagcatggatttcaagacatagtgtgtgtatgacaggtgggactagatattaatagtgtagtatgtaactattgtatgaatgagctattagattggctatagataaattggagctagtagttggctatactattgaacttgctctaaaatcatgctatataagagtaggacacactacttctattgaaggttacttcttaatccccccgtttcataatataagcatttttagagttggacacggttattaagaaagttggtaggattaaatgtgtgagtatagtattggaggataagtagagataggtggaaaattaaatagtgtagggttataattggttgaaaagagaatattagtggagaagttatattttatgataaattttaaaagctataagttgttatattttaggacggagtaagtaaatattacgaaatctgaggatactttgcgaagataagcccatcccagcccacaaacacaagcgctgttttcctctcctacccttttctttattttattcggcccactccccctcctttttctcgtctcctccgccccagcgcccggcgcctccccttctcttcaccgccggtcgtcggcgctgccgactgcgccccacgcgccacgacgactcagccccaccgcgccgcctccgactccaccccatcgcgccaccgccgactccgcaccaccgcgccgccgactccgccccaccacccgtcgcctccgctcttcgccgcgccagatccggtgggccgcgccgtcgactcctccccacggcgccgccgacgactccgcccctctccctccgcccttcgccgcctctctctccctccgcacggcgagaggtgcgcgcgagccgagccggagggggaggggagggggggagggagcggcggatgccatgggcagcggcgcgtcacggctgctgaccgcgtgcacgtgctcgcggccggcgccggcgtccgtggacgcggagccgtgcctggacgacgctctcggccactccttctgctacgccggcgccggcacgggcaccg

SEQ ID NO: 56206 - DNA, 9581 bp, Oryza sativa
ccggcccgctcgaccccgccgtgcccttctttggcccgctccccgcaaagcctcccaagcccgcgtcctcctcatcgagggggttctcgaggaggttccggaagccgtccttcggcagcctgcggcggagcgtgtcggagaagaaccgcccgtgcgccgtgccgctccgccgcgacgacggcgtgcagtgggcgcacggccgcgccggggaggaccgcgtccacgtggtggtctccgaggatcagcggtggctcttcgtcggcatctacgacggcttcaacggccccgaggcccccgacttcctcgtcaccaacctctaccgcttcctcctccgcgagctccgcgggatcttctacaaggaggccgacgcggacaacaagaagctctggcagtttctcgtggacggcgacgacgacgacagcgagctcgacttctcgggctctggccggttcgcgctgtcactcgacaggctcaaggagagtcggtttcacatgtgggcgcacgccgcggccgacgagagcggcagggaatggggttccaggaggttggcaccggcgcctgcggtgagggaccatgcggcggtgctagccgctctcacccgggccctggcctcgacggaagcggcgtacttggacatgaccgaccagtcaatgggaacccatccggagttggcggtcaccggggcgtgcctgctcgtggccctcgtgagggacgacaacgtgtacgtgatgaaccttggggacagccgtgccattgtggcgcagcgtccggacgatggcgacgatggctgtgtgtttggaaccatgcggcggatggaggacgtcggggtgggcttggagatcgagacaaggcccggcggatgcgccattattgggcttaagccactgcagctgtcgactgatcacagcaccagcatcgaagaggtacattctcgttgacataggggaacaaatgcttacacgtgtttacatgcaattgcctttcttgtatccattggttggcacaatggcacgggcgtatggggatgctcatgtcgttgtttgggaacaatgtgctgacttatctgaatgcgtctgcaatatgactactatcctcttgcacttcaaaagccagaccattgccctttttcacttttgctttttatatttcagtacttcatataactagttatggtaagcattgttagtcgcttcctttttttatcattatttttatggctatgcattaatatcctttgtgttggtctgcaggaagttcacaggatcaaacgtgaacatcctgatgatgatcagtgtattgtaaatgatagagtgaagggtcgcctaaaagttacccgggcttttggtgcaggctatctcaaacaggtaattgtgatactgtttgagtgggtcagccattcttttaatttgattcttatacttacgatgtttgttttgtgtggtatacatatccatcttcagagcaagtgcatttgttgtcagtactttgtacttttaactagaaactatatctgtcatgtgttctgattaatccaatgccctgattgaattaatatagacactagataattcttgatcatagaacttcgtgtatttgtgcaggcaaaattgaacaatggattgttagagatgttccgcaatgattacattggtgatacaccgtatatatcatgcacaccatcgctttgccatcacaagctcactgcaagggatcagtttttggttctttcttccgatggcttatatcagtacctgagcaacgaggaggtagttttgcatgttgagaatttcatggagaggtttccagaaggtgatcctgcacaaagtttaattgaggagcttctctctcgtgcagcaaagaaggctggtaggctctcttctataccatacctcttgcttatttcaattcctgattgattctcgggtggttttttttgtcattgtatataacatcatgcgtatagaattggatgattatgtgcaaacattgatttgcctgcacatgtttgtctcggttgtcaaaacttcctatatcagtccatggcatgtgaggaacttctttatacttttaccaatcattcttgacataaagttctgtttgatgaaatagtcagatactcatgcaactccctcaagtttgtgatttgataaaattctaccagtgtatccttggcttattgcattgcccacctgtatatgagaccaagatacactttacacttttactacatcacaaactccactatggcttagagtgttagagatgattgacattgtcctagcttaacaattatggtttctcgaaactgtttgggccagtgagctaatcagcctgcatgctcgcacacttggagcatctgtccctcttgccaagaaatgaactacagctggattttgcaaactgggtatactgtttttcagcactatgtgtcctaaggtgcaagctggttaagcaaaacaaattttgcattgttggtgtaaagaacaccatggttcagttggtaattttggctctactgtaggatatttttgtattgattgttatgaacaacttgcagtcatcatcattggtacacgtttgtgttgaatatttgaatttcaatagatgaatgtcttgtcgaaacggtttccagttgtctttaatgtcaaatacatgtacctttttttttctcctttctccctcagtaataccatgatttaacttttacttttgtttctttaggtatggatttttatgagttactagatatacctcaaggggaccgaagaaaataccatgatgatgtcactgtcatggttatttctctggaagggagaatctggaagtcgtccggaacatatgtgtgatgatcagttggaacaatgtcgatgtcaatatttatggtgacgcatcaagtgatctcagctggtcagagcctctgagcaactgcatttatgctcatcaggggagaaacacccacagatggctgacagatgatgcactccatacatttgtcaaagcgattggagttggagccagcgttggtctagatcttagcttcagcacaaaacacagtccatgaatgtgctagagagttaattctcggttggaccaagattgcagagagagatgacacatatgaggaatccctttgcaaagcagagttaagaacactttcttttgtgacccgcttagttgattggttacatactcacctgtgacaattccctcacccccctcccccctagctggctagctatgctgcatagagattgacacttctttcatttttggagaaagaacgtctttggaaggcgccgttttcatgttcatgtcaggaatgggaaggaaatgtaatatgattggatattcatggtgaagaaattgaaaatgtgtccctcatgtggtgctcaacatcgttttcgtaaagtcctgaactcctgatagtccattggtattttgcgtgctcgaataattaggacagcagttgttatttgttcggttggtcctatatctactgttgttcgcagttgcctggaatgggccgtggtttttgctggctggatcgatctctcttggtatgggtcgacgccagcttgttttcaaacaaattgcaagtgctatccatttgatgattcagtcaacgattcagcaccgtcgaccagaagatttctaacatttgattctgatttcggtatcggctaagcaagaagtaaaaggcaaacttaacgctccatttggaatgatggcaatttgcatgaatttcatatctgaaacgttttcacttcctgtgtttggcgtaaagctaggtatatttataagtgacactctgagattacaaatgtgtgcactcaattctgaaactgcatgcttgttccaaccggatttcccagctcaattcaactttcaaccgtttgatctgaaatggatagttgcaaccgaactccataagattgacctgcagtcatctatgtaatccattcatccccagtttcaaagtcattgcaaagatcaggtaaaccttgtaacggaggaatcccaagatgaagatatcaaatctttgagatactctagcctatggttggatctttaggtaacaagaaatttacaggagaaatcacttgtacgactagcacgatctcttggcagattagtacgaagcatctgatgatatattataatggctttacgatcggtgataattcttaggatgcattttatatgtgcattagtcaacgtctggaatgattcttagcgatcatgagctgcgtttaaatagtcctttgataaattttttttcaaggatttgaaagccatctgcttgtgacgtacctactggctactgagatacgaatcgcattacagggtcaatgcgaacatgatctgagaggtatagtgcgttccatgtatacttatgcatcctcagatcagagagtttttctattggtgtattgcacgttagctcagcgtacacaattgtgcaaacaaaacataatcacctttctaattattttcgtctgcatcactgcaaagacgtttgagattttcagtacggaatccgttcttgaaaggaaatggtatcttgttcttgacttgtaaatgttaagaactttcggcgtttgacttgagcaagtggtggtatcttacttgtttactccgaggagcttagagcgcgcgcgtctcacttctaggacaggaaacatcgtcgtgcgaagcgctcaaccgcctgcaactaaaatcatatgaactgtaagcaaaagagttcaacaatatacagccttgcaagagaaaagcatgaaaatccttaaaaatcaacaccaataatcggaagatatctgccgtccacacccaaagtgtctgccgtctccatttaacaattcatgatatgcatatcacatttgtcattttcttatgttttttgttttaaattaataccatgcatattgcatagtctcctcctaactactccagtaaaatttaattagtggagatattaggattgcacttggtcatcatttgtcaagtatggccacaaacatttccaatttccatcagatttatggatgtggcatggcatacatatctcgaaaaatactacataatactatatactatgttttagaaaatggaaatgttttgcacgtcacttgaaaaagtccaatttacaggtcacatcaagcttccatgagaccatgaccttctcaccactaattgcaagcatctcttacctttgactattgacttgcacacttgccagcccatatgcccctacaagtatatataatgagcccaccgtgtcattacttgctcagcttcagctctgtgactgcgacgcgaacccatggccgccatggacgagcctcctcagctattcctctgcccgatctccatggagctcatggaggatccggtgacggtgtccaccggcgtgacgtacgaccgccggagcatcgaggagtggctcttcgtctacggccggaccacctgcccggccaccatgcagcctctctccaacttcgacctcactcccaaccacactctcaagcgcgtcatctcgtcgtggctcgatcgcggctcgtcgtcgtcgtcgtcttcgtcgccgtcgacgtcgacgctgtcgagcccgatccacgagctggcgacgccgctgtcgcgcgcgctggagcaggagcggttgctggctgcgctggccgagctggaggagacgccgttcaaggtgaccaagctgaagagcatgagggcccgcatggcgggcgacgtggcaatgcagggggagttcgtcgcctcgggcggggtgcgcgtggtggggcgcgtgatggcgcaggcgctggcggagagcggcggcgacttctcggcgttcgccgcgtgcgaggaggctgccgcggtgctcgccgcgctcccgctctcggacgaggcgtcggtgcgggtcgtccttgcgccggagtgcatcaggcccgtcatggcgctgctccagcgcggcggcgccgaggcgaggctgcacgccatggacatcctcaccaagatctccagctccggatcaggcggcgactggaccgccggcgtcgacatcgacgacgtgatcaagtccctcctcgagctcctctccgacgaggcctccacgaggctcagctcgcgcgcgctcgacgtgctcctcgacgtcgtggagcgggcgcggggcgcccgcgccaaggccgtcgaggtcggcgccgtgcacgtcctcgtcgagctcctcgccgacgccgacgaccgccgcgtcaccgagcgggtactgctgctgctgaagcggctgtgcaagtgccccgaggggcggctcgccttcgcggagcacgacctgtcggtggcggccgtggcgaggacgatgctgcgcgtgtcggagctgtccacgcagctcgccgtcaaggtgctgtggctcgtgtccgtggtggcgccgtcggagaaggtcctcgaggacatgatgctgaccggcgccgtcgcgaagctcctggggctgctccacgtcgagagctcgccgtcgacgaagcagaagacggtgaggatggttaggatccacggggtagtctggaggcagtacgcgtgcttccctaccgacttcagggactacctcaggctgctcgattgattctttctcccctctctttctgattaccgtggctaagctgtaacaacaaagcagatggaaattgtgtttttttttctggtccctcgaaaaaaagaatgtgtattttttacagaaaaaaatcggaaatgtgttttctcatcacgtacaaaaaaaaagggaacgtaatgcatttcaagtattcaaggatatcatcgagattttcaggcgacatttcccctggttttttcgaacaaaccaatcaagtttgattcggatattatcccccctgatccaaattctagctgttggcaccaccaatctataaattgcggcatcggtattgatgaatagagcttttttacaggccacatcttctagcgataatacgtgacacttcgttcgtttcacaatataagaatttcttacctgtatttatatagatattaataaatctagacacatatataaaacatatacattcatcaatgaataaatgtaagtaacaccaaaaggtcttacaatataaaacggaaagagtacttcttaactccaacacttcgatggtaagttagtgttgcataacaaaatgttcctatgcgtgagcccgttgtctacattcagtctggcttttgtcacatgtctcatacaaccttcatcctaaaatataattatttctaactatgtactctacctagaagtatgtaaaagtatatagctaaaagttgctatattttgagataatggtagtataatattgatgacaaacttagaagttacggttgagtttgctaggagcttgtttagggagcaggaggagtaaattctagagggatcttagatggtcttattgttgaggctgcatttgaaaagaggcattaattagataataattcacgaccttttagatcaggcacataatgcggtaatgcccatgaaaatagagtagagtaggctagacatcctcgtaaattatggtatagtctagtccatgtaagttaattttatgggcttccaccacgaacaataggttgttgggaaccctcagtgagggaaaggagaggctgagagggtgtattgacaatatcaaacaagttataagtgtttaaaaccttatattataactatcgaatctttttaaaaccttatattataactatcgaatcttactttggtctaacaaatataatcatatcgggccatggaaatcaagaaaagtggcaattgatcacttacatgttcgaatggatgaatttatgtgcaaaagaatgtccatatatttccttttaaatcaaaacattctcttaagggtaaatagacgataccacaacaaaagtataccaagcatcttaccctatgtcaagactttatttaattggcaacaacacatgctactcatggtgtaaatctcaacaaaaggaatatcatgttatgagctaaataacttgaatacgaccctacgttaatcattaaaaaaagagtgaatttcgtataaccacatgttctatggtcaaaattgcagaaaactgcatgcattatgacttttgacttgtgacacatagtcacatatttttatggtctaaatgtttcataaaaccccaccttgattcaaatttcaatttgatttatcatatatgaaacaatatttttcaaagtagtaaaaaattaagctaacaaccttaatcaaataggagtagacctacttaaaagcaaatgttttgggacgatggtttttccatgtcttaataggtattgaagtctttcttacttccagtaaaactatgcaactctgtttgccttctgatttttattactagtagcttaattaagaatgaacataattttacataaatttcaataaataacttgaaaaatttagaaaaatacttccttccaataaagtctaattacgtatgcatgactaattgacatatccattatattggtctatctttcatcccaaaagagagaaaaaattgtcttgtttgttaaccaactccacaagactacattggttctgttcttgagaattattttcaggtctacaattattgcattctggatttgggactagtaaaatttcttcaggattattgctgctactactgtttcagatgcgatgaaatttgaaacttctcgtgggggccatcagtccaacaccaaccgagcttacctacaataggcgaccacggaaatatgctctcttgcgaggtccatctcgaaaaagtacacgaaaaagctccccggaagggaagacgacctggggctggttgctcgtgctgcccccgagatctaaccaaaacccgcgtcccatctcacctcgcctcacctcaccatccgacgagcccccggatcaccggctccgacctgtcgccggcggagagcgccgcgggatccaggcgttgaggttggggagcggggtgtgtgtgccaggcgctcgggcgggggcgagcgggcggcgacgatgccggtggcggcgtcggccatctacttcctcaacctccgaggggacgtcctcatcaaccgcctctaccgcgacgatgtcgggtgcgtagtaccgttcgcaatcatccccccctcgcctcgcctcgtcgtctcgccgcgcctcctgcgcccgcgccgctcgtggtttggagtggtagatctgaggccgttgggatcgattagctccgtttcctagctcgccgttgcgcggatcgcgcgaggtctagtggatagctcgtgaaattccgctcggaaaggcttcgattagcgaacgggatgcggggattgactcgttgcgtgctgaaatttggcccctaccctcaggttgtcgcaataccatgtggttgaatttcggaatggtatctcgttctttagcttgtgattgtggaagctacatgttttgcagcatgaaggaagatgccactgactgaaatactgaataggagaattagttcgctttcaccttggatggctgtgctgtggcggtcgattatctgaaacaattgactttatactatttccc

SEQ ID NO: 56207 - DNA, 6232 bp, Oryza sativa
  unsure (1)..(6232): unsure at all n locations
taggtcttgggctggcagagcataaacataaacctaccaatttttgttggttacggtgtacaaagctgtatccgatgctatattggctcaattttcttactcttgaagagctactccttgccaattttgccacaaatttattagcatgccttttgcactcataagtcttgacacacttctgcaattataggatcaggaagtttcctggacaaactgaggcaaccatgagtgccgaagttgagctgatttctacaatgggggaaaagaaatcatggaacaggccgccaattcagatggaattccaggttaattttacctccttttgaacaaccctcttatcattagcaaaatctgtcagccagttcattttatttttgagcttacagaaaatgcaatgttagagatatcataacagttatgaattaaacttgagcatgcacaagaaaaaaaaatggtattccatcattcgttggcctttgagtatgtttattatccgaggtgttatcttgaagtgttcttacaaaaaaaaacatcttctgcttcattgttatgctgataaaatgtgccttcgagtttggttatcttgtttaaccatgctttctgatttgttgtttctgtaggttcctatgtttactgcttctgggttacgagttcggttccttaaggtacgtgcagggaatgctaatatagaacctttttaacacataccagacagttcagaactcatgttgagatgcatattccaggtgtgggagaagagcggttacaacaccgttgagtgggttcgctacatcacaagggctggatcatatgagataaggtgttagcgataagaaaaaagtcccaggtatttggcacggttatttcaaggattcgcggagctttctttctagtacggcgtcatgaatgatcataaagcatgtatattacatatgacaccactttttctttaagctattactttggcaaagggtagagcagagcagacaaattttcctgggttcttgtaatcgttttgacacgggatatctagtatcccctgagtcttgtttgtgtggtagggcatattttcatttgtatatgagaagatggcggtagcgtttgttcttgttgatcaatatacatatactcattggcagtttgtattgctttcttattaaattgatgggtgaattcacttgcagaagcaatgtgtataaacatgtgactcgacggtgctcgagacatcgactcctgaagtatacagtgtcttaacattttttgaggttttttttgcccttttgcgaatgactatttgtgattgccaccggagtccatgcgttttatagggcttacattggtatcgaatcaattttcgtaggaatctgaaatatttcctgcgtttcatcatagtagtggatgggttgagatagagatagagaaaaactgagggagtcagctgatttttatgatagctatttattaagatacaaacgaataaattaattcctacagagttgaaatcaaaaggtattctaaaaaaatattactacacctagtacaaaggtgaaaacttattttagaaaaatattttaagaatagggtagtagcgcatgagcatccgattcgatatggcacgcatctccgtggcgtcgttgacactaacaatgtcgcgtgattcgtacgggagtcgggacagcctcctcttgatctcgtaaaaatattagaacttcataaaataacagaaaacctatacaacgatatcccattagattaggatacccttttatgagatagtatctgattcttttgtgatactagctgtatggtacccgatacctgtaataccatgttacatggtacctataataccgaggacatgaaacctgtgatactcgcaagagaatagttaatatgtctatcccgttgtagtgggatcccgttttatagcagccctcgataataaagttagatagattttttgaactttctttttttctctaatttgcaaatctatttttcgatctcgttttcatgtccaactttaattgtccattttatttaattttttttaaaatctaaaaatataagtcatgcataaaatactattaatactttataatatactaatagcaacaaaaatattaatcataaaatttttttaaataagatgaataattaaagtactattcatgttttattctaatatactaatagcaataaaattattaatcataaaagaattttaaataaaacgaacaattaaaattaaacacgaaaacttatagctacgcttattttggatagagggacttgattggctgagtttgagagtaaaggaaataagaagattaagaagagacgcaaaataaggtgagctattagcgcatgatgaatataactattttaaaattttaaaataaattaatatgattttttaaagtaacttttcaatagagttttttttaaagaaaaacacatcggctagtactcctccgtcctataatataaaggattattgtttgaccactcatcttatcttaaaaaaatttgtacaaatataaaaaacaaagttatgtataaagtaatttgaataataaaataagttaaaaaataaataataattttaaattttttttaataagacgagtggttaatctttatattttatattagggtcaattgcatatttgccatcggtttgaaccggtacggtgaatttgccattataaaaaattttattgcatatttgccaccaaacacagatagaacccaacaaccttgccattagactcacagatcagactaacactgttagaaggttggttttgatgaaaattaggacaatgttaccttgccaaggaaattgaagcaacagagtctttcctctcctttttcttctgccgccatggtgctgctacaacatgttgctgttactgcagtccgaagcagcaagccgctgcagctgcccaagatgcagccgtgctcgccgatgttgtttgccgcagcttcacaagcctctgccgtgctcgccgctgctgcttccgtagcgtcacaaactgccgccgcgccgtcacgccgtggccgcccgccttgctgccccgcaaaatccatccccgccttgctgccttaccatatcctactttattgcaaccaatttttgtttgatttgctcttgatttggaagaagagatgagaggatttggggatgtagtagggttcgaggatagggaagggaatcggccaatcgggacctgcctttctgggagatgggggcttctgcgtgcgagaggggtagggaggggggcaaaacggtcttgttgtgcagctttgtttttcacattagttttatgaattatttttgtcttcttatttgcactagctcaaacggtaatggtaaacggaaggtacacatatcagttttaatggcaaatttgcagtttgcgtttttttaatggctatttcgaattagagggtaagagtagtggtatatttgcaattctccctttatattatgagatggacggagaagtagtttgggaaggtgttttctctcactcaatctcccagcaacgaatagcaacctaggttcccatcgcaactgaccgatccccagccgccgccgccgccgccgccgccgctcaaggaagcgcatcagatggcatcgccgtcgctcagggacgccgtgggcggcctcgaccgcgaccccttcgtctccctcctcgggaagctcatcggcgagtcccgccgcctgcagaacgacccgccggccctcgtcccgcaggaggacctcgtggcgcagcacgtggtcgacgcgctcctcccggtgtccatggagaccgggggcggcccgctcgtcgtgcggaaggtgagctacgccgagggccggagcaacgtcatcgtcgagtaccccggcaccgtccccggccgcgccatctccttcgtcggcatgcacatggacgtcgtccccgccaaccccgacgaatgggtaggttgctatggagattgttctcctgacgctgtcaaaaattgcttctcaagtttatgcttctttatgaattaatgatttgagtggttgcttgatttggtgtgtttctgccggatattttgattttgtgatcttatctaatttcgttgatggttgcctaaattgcatcattctcatatttacgggtggattatcctggtgagtagtgaccttgtttatgtgagctggtgatttctccatagtaataaccgctttgttgtgtggttgttgtaagaaaataataagttgcatgctagcgttgcataagcatattgatagatatgatgggatatagtaatgtgaaaaatggcatattgtttacttccactgtgttgtatactgcaaaaatctttgctcaatttcatgatgtttatttttgctcgtgctagctttgttgcgtcaaattactaaaaggtttacctcaagtaaatttctccttggttctaattggtggcccaaacgtctctacttgtccaggatttcgatcccttctcactaacgtttgacagtgaagacaaggacaaacttaggggccgtgggacaaccgactgccttggccatgtggcgctggttgctcagctcatgaggagacttggtgaggtcaagccggtgctgaaacattcggtcattgcggtgttcattgccaatgaggaaaactcacttatcactggcattggtgtcgatggccttgtgaaggatgggttgctggataagctcaagaatggacccttgtgagtattgtgctgtttgatgcatggagggaatgtccgactaaactaatgtgttgttcgtgaggaatatgtgctgatttggttgtcattgttgtgtggcattgtgaaggttttggatagatacggccgataagcagccttgcatcggcaccggtggagtgattacatggcatctgaaggcaattgggaagctattccacagtggcctcgcacataaggtacctgatttgaacttgtcagaactcagaatagtgtacttgttgtgttatatagctccagtaggttccagcaatacactgcttcgtggaaagaatgcataaagcatatggttcattttctatgacctgtgttcttttaaattgtatagctgcataaattaagcttgcatccttgtagttagtgcaaaagcaacaatttatattgatcaatgccaaattgaaatgacacaaaaaggataaggaaagtgactgcttaaacatgagttatgttgcaacttacagcgtgatcactctgcttttgaaatgttatctgttgcaacattaccccttggattttttttggggggtaaaaagtgcagaacgtgtcttcatcatgctagggaagattcattcgaatattcaattggcttagagggacaaaacaatttcaaacatacaagttgggagacaacaaatattgtatttgtatatgaattacttttcttttgtgtgtgtcaggccataaatgccatggagttaaatatggaagcactgaaagaaatacagactatgttttacaacgatttccctccacatgagaaagagaagctctataagtttgctaccccatctacgatcaaaccaacaaaatggagctgtatgttcaagttttacttgtgttttctaatgttacaactttttagttgtgtttcctaatgttaaagaaaaccactgtgtacaatccatgcaattaacaaatggtgatttgcagatcctggtgggggtctgaatcaaattcctggagaatgtacaatttcaggggatataaggtccaactattgctatatggttcttgaatgcactttaattgtactcaaaagaaaaatggtccaagcttttgttttattatgttcatacattgttataggcatggggacatgcggttggtgaggctttgttcctcccaggggccctaccataaatttgcttggtcatttaggcggtgttcttttctactaaagatgaagttagggcacataaaataagaaagccaatagtgcatgattaattgagttttaattattaaaaacttgaaaaatggatttacatgatattttaaaacaatttcatatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56208 - DNA, 1081 bp, Oryza sativa
aaagccgacacaggtttaccatatgccgacgagaggggtcccagaccaacaacaggttaggtcccagaccatactgtgctaggaagcccaggggtcctccccgacaccaccccggcgaatccacatgtctctcggcatcaaggctcccctgataagctagttactcagccaggggtgtcccattcgacccatgtggtcatacttgtcttatgtttggatgaaattccaaggaatcggtccttaagtgcgagagcgggaaaccgtacacccggtacgtttcccggtccgcggttctggaaatcatttagttcgcaagcgccgacccaggtgtcgggtttccaagtcttttgtaaaacccaagttttacccaagttgtttttcaaattttaagtttgaaggcgaccgtcgatactcgcacagagtgcacgaatatcgaggcgcaactagatggttacaagggaacatggtataacaattaacaaaggaaggatcaaatgcaacaaactaggtaggtctgccaatctgccttgcagacgggacaaacagattaagtgcgatcctatcaatgcataatatttttcaagcaacataattaagttcaaaggtggcttgccttgctcgagatcttgggcttgatcctcgaaatcctcgcactgcgggtcttcgggctccgaaactacactcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaagagggggagggaaattagacttttcctcgggcggctagggcgtggcccgagagaaaaggggcggctcagccgagctaaatgggccggccggcccaaagcggcccaagcacgcccgcgcgggaagggaggagagagagagccggtggaccgggctcacctcgcgtggtcccgggtgggacccgcttgt

SEQ ID NO: 56209 - DNA, 730 bp, Oryza sativa
tcctgcgccccagtaaccattttagaaacaaactattgaaaataaggaaaccaaaagaagccttagcttttcgcaagtagttttgaacttagtatccttagggtcgtcctaaacgtcgggtttcgccctagggccaagcctgtgctctgataccatctcttgtcacgccccgaactataccgaccggaactagcccgcgacgctccaaattaacctgttagttgataccagtcccaagaaacagtgctggtatcacaggaagacagattatcacagcaacagaggtctctttattatagagtagaggtacagtcatgttgggctgcggacagatcccgagctcacaactgcattacaaaagggaagcggaagccaggacttggaccaaacaacacaggcgcgacttgggaactaggccgaaaccctaaaactcatcgtagccggcttgctcctggaagaactcctcatcagcaggatccacttcatcttcttcagcaactgggggggattatttatatagagcaagggtgagtacaggagtactcagcaagccatgggaaataagtgtttaatgcaggctacaaagaaagggctgctgtttttgcaattgattttatttgaactcttttctgaaaacaacttagtgagtgcttctcaaacgacacggatgagacagtgcgtctcgtccggtcggagtatgtgcaatgtatcagtctttagaattggccaa

SEQ ID NO: 56210 - DNA, 13238 bp, Oryza sativa
  unsure (1)..(13238): unsure at all n locations
ttttgttctaagttaaacatttctaattttgactatcaatttataaaaaatcaataatagtttagcaacatatgaactatatattctgaaaacatttctcatggtgaatctggaaacatagtattatgttgttaaactatataaatttttaaaaattgctagtcaaagttagtaatttttgacaaagagagaatagtaaaaggctcacgaccaagagataaggaagtttacctcctttatcccgagagcagctctggtggcattgtcgtttgcccagaagtaagacaggtagtatcggtatgcctaaaagcaaaatttggcaatcgtttgtaaagaaaactcaatggaaatgtaggtgctttctcctcattcgaattacatttgcaagaaattaaaaatccaaaacacaataaatagtgacttacagcaaaacaactgaaaggaggttcaacaggtgggtcacctaaccaatagtgctcctcggttagagacttcctattggaagcatctcttcctggcattggccatggccagtcaaagggacatgctggttccaatacttctgacatgagctgtggagaaggtatatatatagatgacaaagctagctagacggtaagttcagacaataagggcatatatatatatatatatatatatatatatatatatatatattatatatatatatatatagatgtcaaagcttacattgttaatggtctgcattacgtcagtgcatggtttgttcgttgggttttcataatcccctttacaatttgccagggcagccttttgataaatagaaggggaaaagaataagtatcttcactgacattacatcgttaggattttagtgggctacacttcagtaaaaaaatataagattacctcatacaattggtcagatatcactccaaatgaatgagagtatggaaccctagagttcacatcaatcttatctcctgcactaggattgccgactagataaccctgaataaaagcaacaagagttaacaagctagatacatatataatttctattttgtcatctaagtgattatctgcacactagaaaatacaacctttaaattaatgattggatgacgcatttcttcaattcctgaagcacaatacaattgtcattaatgaatcacatacaaaactataattaagagctcaagaacataaatctttatgctcttataaaataataattaagccgtgattgtaagccctgcaactatcttttaacttacatatcaatttgtcaacgtaactcactacaaatggtttttttaaaccacgtaaatggtcaaaattactcattctctattgatatatgtattttctctaatttcatctgatagtctagtcaatcgtgctcctagccactcaccttcagaaagtcacttatccacacttacttcggtgacaggcactctcatcttctcattctaaccgttagcctccttaattaaccgcctccatcctaaacttgtaaaccctccccgaccagtctatgtggacatcctctgcatggcctccaacacggtttctagggcaacccatgggccatggcatgaaactatttccaccggatagaaaaagttcaaaaaacattaaaatttatttatttttgggaacttagcaaatttattcaaatttggaatttgatcaaatgttgaatcattccattccgaaattcctgatccccccgatagaaatttacgaaccaaaatagtaaaccctacttagtgttagctgtgaaagatccagggggtnctctattgcatccctatctatgtacatgtaggttcccgactgttggactataaaatccaatatgcagggcaagggctcccgcctccattggaaggagcccaagcttgaataccgggtagaagaggagttgaggagaggatagatggtagtgagaaaatgcatggaacgggggagagagcaacgacaagttacgttattgcccttggttcgttatatgtaagtgacatttcctcaagggtattttagtcatctaaattacattagttaagataacaacctaataataggattattccccaacaccgactagcccaccccaatgagaggtttccctgtaaacagcatggccctgatccactacatcttcgactcttcatcccatgtcatctcatgtgtactcctagcaaagggggccatgtggtgagacacggatctgcggcgctgtctcacggaaggtcagaagttgaagacgtataaatcctttttgcatttatgaatgatttaagattttgatgtttgtctatgtgcattctggcatcatatatatttgagaatggagatactaattttaaaatatgtcgcttgctagcatcacgaagagaaaacacatggatttaccttcagagagatactgcgtgataagaggaaccacctttccggcgtatgaatcccctccaatatagaacggattggaaaggtactttggatgatcatccagccactgcataaagagacaaaatctcaacattttttattaatggaagtttatagtagacgctagcttgctttgtctcaacctttcgtagaaatttcacaatttgcatagaagatgatatgtctccaacatcataacctttgggatcgtgcgcatatgaaaaaccggaaccaacgggcgagtccacgaagagaatgcttgccaactagaaatgtccaatcaaccacaaaccaaatggagcagcatcaaagacagttaaataaatttctcataaacataattatgtatatgtagctctcccacatatatattcagcagaaaaattgatgactgagtgtaagtgggttaatatatgaacccatctatagacttaattgggtaaaataaaatgtattgatatacacagacctacttatagactaattcgcttctatatcagtgctgatatacaaatattttgctctcaccttcgtccaggaatacggattatactccaaccgcggaaccgtgccgccgctgtaacgttccgcgacaaacattacagggcctgagaaaaaaaaaaacatggcactgctcatcatgaaccccattatcccagtcgcctctcccaattgcaacctgcgaatacatcgatgatgtccgagttgcgaatgcacgggctacgaacctatttcgtacacgaagccgctgaagaccgagcaccgcggccctcccgacagccacagcagcacgacgtcgctgcgagggctccgctccgactccacgaagtagtagaagagctccgtcccggtctcctcctccacgcccacgtacctgcagtttcatgtgatctcttgaatcgatcagagattcaggctcagagtacgcctctgcaaagaagcagagcaatgagcattctttggtgtgtgagggtgttcagttcacttacccggtctccaggtagaagggtagaggaccatcgaatcccggcaggtgggtgaccaccgtcgccgcttgggcaggcggcggcggcggcagcagcagcacaagggcgaggcaagcgacgaggcgcagcagcagagagaggtggcactggcagtgtccgtcggcatgcagccagagaagcttcaaggccatgcttccctggtccgttgatgattcagtctgttctaaaataaatatgcactagtactgtactactttttctttccctcgagtttgttaggtaggatgtgtggtgaggaaccgaggatcgtccatccgtatcgttagttgggttgtcatgtttttctccccttcatatggtccgtgcctgtggagcccgaggtctttgcattggagcaagttctataatatagtgggtcctgaactcctgatatagtgggtcctgattacggttaagacagttataactcatttcatgacgatttcacctgacttatgggtccttccatccgtgtactcgcgcctaattggtcggaggtgtgtttcctcacatgatgggtgtgttttctccttaaaatacccacatacacatatttcattaacactagtgaaattgattagtaataatctctaccactaagttggatactgtcagggttacggatgagacatacatcctatcctatgattaaccaagtatactggattggtataccccatatcttatgatttgtttccgtatgcgataaggaaatatataaaatattacggaaaatacccttacaggctagtaactatcagaatcctactcggaaaagatagggataattctatatcgtggagggtttgttgtctccgggttctacttgaagactaaggcaattcacagtataaaaggcataccccttgaggagttcatgatcatcgaatcatagcgccagcacacccaccatagtctatgaagccagaggacgccagccaaagccgtcgggagatctcgttgaatcatctcgacaaggatctcgccggtattgtcggatccatctgttctctttgtattctatggttttccatatcaatcccatataaactggattagggctattacttcacgagggggctaaaccagtataatccttatcttttatacgttatgatgtcgtatcgtgtagaaccttgtaccaacgtactccaataccctatttatccggtctacagatatcccccgtcgacagataccatattttatttcattatatgcagatattggcggttagatattatgatttaaggactgtcaacaccagattcagtactcaccattgcagccacaaacagcaagaggcatgggaaaagcaagagggtagaagattgcaattgctctgttcatcccccttcatctctttctttcatcctcacatctatggccaaaaaagctccaggtcagggattgcaattcctctctgtctcaaattgcaacggaggaagagcacgtgaagatgacaacgattgtgccattgccgcggattggtgaaaggaggcgaagagggatcatcagcgcacggtgcgggatgaggaatctcgcgaatcgtgactgccgctgccacaggagagaggggagcgatcgggaaagtagccactggatcaaccactgttgttgaccatgaaccctaggccgcctaatcgccggcgtccaccgatccggaaatgaagaggatggagaggagagggagagaggggcggtaccgggcgtagagggcggctgtcggcttcccctcgccttagagtggccagatctgccagcgaagaggccgaagtcaccggatccggcggtcccggcctcctcgttggcggatgcggcggcggaagcgagaggatggtgacggcaatggcccgcgtgctgggcggcggcaggcacggcagcagagagtgcgcgggggaggtcatcacttgcgggaagaagagaatgagggaggcggcacgcggtggcggccattgcttgggcaggagatagagcggagcgagagaaggagaggaggcaaatgaatggtggcggctagggttcgaggaagggggttagggttgtttttgttttgcaaaaacactcttaatcttctagttttcagagcacggttcgattttccaatttttcgcttcttcgtatataatattgttttctacagaggacctgtaagtaagcacgcaaaagttagaactaaggacctataacaaattatcaggtaaatcaaggacgtttttgcaaaatcgccaagtgagtacacggacgcaggagagctcacgaaaactacccgccatctagcgcctcactgacgcgtcgacacgcgctggtggccacgccagcgccaaacacagaggaagcgttaatcctagctagtttgaagtattccaatgtgcaagttcatcgcgcgcgtatcacgtggttaaactattggagcagcgactattagttggtactaatagctgtcgacgtgtgacgggtcccaaaactaatgattcggtaaccgacatatttagactatatcaagccctgaatcagtagattgatacaggttcaacaatctggatcttcattgcatacgtttgatcaagactccagaggagatgttattacaaaatatatgagtatttacaaacttgtggctaactaatacagcagaagctatatgatgactcaactctgtcgttttgctatagaattaaaccatctaacaatactagacttcaagactaggtttaaagggaactaacttctgtgattgaactcccggcttcgataagaactccaaatggactctgaaaaaggtggggcttgaagcaagggtgagtacaacgtactcagcaagctattatattcaatatgaatgtatgaattagtagtatttgagtagggctatgattacttgcagaaagcagagaatataggaggagaaatcctgcaatgcgtttgatgcaacagtatttaataaaatctggaattaagtttctaaccaaataccatatgagtctcggtactcaattccatgagcacggctattcgaatagtttcatgaatattctactgcagtagatgtacgctttacccatagtccacgacttgccaatattcattagcttagtcatggcacaatattaggttattaacaatagtggcacctgttccatgaactctagtccccatgcgctctgaacgtaacgttatcagcagcgagaggagttctggcgttcccggggtttttagagagaactggatgagagaccccacgtcatctcaaccaggtttccataaaatcacacacacagatcatgagcgaaaatcaatatatttacctgcgcctcggtaaatatcataagatgccctgctcggcataagattgcctcctgcgcgaggacttacaaaaggaaccactgtacagaggtaccacattgttaattaacataatatctaggtctgtccccattctagaagctacggtcgtactcgttcgtttgacataagtatttggtggcaattatatcgaccgggacagtactagccacccagaaatcaaccaaatcttacgtattgtcccaatctaagttcattaaattttatgcatattctaactaagcatggctaagcaaaagctagcatataactggttcgctatatgttcagattatgcattcaaaatcatgtatggctagtgtatagaatataatatagaatgtagggtatttatgctcaaagggaaggaataataacttgccttgctccaacgcaaataaatccgagataggcaacctgattatccgatcctcgaaataccacaggttaccatccaaaataaaatagactctactaagaaagatgaagaaccaatttcaataaaatccataaaatagtaagaaagagataaacggttatgtgggctaaggtttagggtatagtctatctcttttatagggtatatggattactgtgttgatattttatgcggaggttctagagggttggaggctagaggggattaagcaactactcttgcttatatttcatgtgtgggtttgattagtaggaggatgggaagtatactggatgattgaactagttgaacagatatatagcaagtatcggctgatggtaggttttggtaggatcatacctagggtttagtatttttgggtagcatatcggctagactctatattttatgtgtaggttctggtagacagaaagtaggtggctaagagtatggtggatagatagtattgtagagggtatgtgtagcgcccgttccgtcgtggcgcctagcgggaaaattatctcttaaaaaccataattgcgaaatttgtttctttgcttgttgtctagtgtccgtgccatctcagatctcaaatccccgatctatcgtcgagttcaatcccgaatccaaacccttcccaaatcaattcctccgcaaaagtctattttgcctcccccgggttcgatgggccgaatctctctcggcccatctccccctccctgcccggctatctctctctctcgtctccctccctcttccgctccgcccgcgcgccgcgcgcgcgtgcgcgtgagctgcgccgcgccgagcgcctccccctcgctctccctctccccgtctccatccctggcgagctccccgcccgcgaagtcggcccccgcgcgccgttgttcgcgcgcgcgcccgcgtggttgccgtccgtgccgcgcctgcgccgtacgcgtcacccggacccgctgccctgcgcgacctgcagccgctcatttgctcggccccgcaagccagcgctgcgtgcccaagccgcgccgctcaaaccgcagcgccgcccgttgcttcccgcgcgcgcgtgccgtggtggccgaccgcctggtcgccgccgccgtcagcctctgccgcgcctgcccgcgcctgtcgcccgtgtcgccgctccgctccacaccgccccgcgtcatcgccgtcgtcatcgtctcggccccgccactccgcgcgcaagctgccaaaggacagaggcagagctcctcctccctctgccgcgtcgcctccgctccctcgtccttttcccgaagaggcaagggacaagccctctttcctctccctcttttcccctttttcctcccgccggcgtcatcctcctccctcctccctatcgccgttttggccgcgaccgccgagcgctagccctctcctttgcccgccctaagttggttcccaaaccgacattgccatcctataaacccaagcctccccctttcctttcctctcccattcgcctccacgccattgccgccgcctcccgtgctctgttcgccgtcgccgttcgtcgttgcgcgtgtcggaggagccggcacgagcaaggacgcggaaggggactccgggcacgccctctccttcctcttcctcggcccgaggccggagagattactcccgcgccgtcagcctctcgtcactgcgcctcgcccgcacggtagtgcatctccccgttctccctcctcgctccatctcctccccttagactcgggtagtagcacgagtagcctccccgtagctagccggcgccgccccgaccgttgtcgccgctcgccatgtgctcgccaccgtcgccgcccgagctcggaagcgcctctcgtcgccggcctcccccgatgcgtttcctcctaatccaacgctagcatcggattcccgtagccgcataggtgctctcgccgccgggaatcggcccctcgtgacctcgtcgccgttttccccttctcccgccgccgtttgccgccgccgcgattcgccgccgtcaagctccctccggtgaatccgagccgttggctcgtctcccctcgtctcgtgcaaccacccggtgtgctcgctttcgcctgtatcgtcgtggttcgctccgccgctcgccgctgtcgtccgccgtccgttccggccggcgtcgtcgtctacctcctgccggcccgcgtggcagccacgtaggcgccacgtcggcgccagctcggccaaggccgggtcaagtcgaccccggtcagcccctccccgtgcgcgcgttccaccgcaagccgtgaggctgcgcgtgggcccgccgcatccgttccaccgcgaaccgcgcgcgtgcaccgcgtccctcccccgcccgcgcgcgtgcgccgcgtgctcgctccgcacggtgaaccgtgtcaccgacaagcgggtcccacccgggaccacgcgaggtgagcccggtccaccggctctctctctcctcccctcccgcgcgcgcgtgcttgggccgccttgggccggccggcccatttagctcggctgagccgccccttttctctcgggccgcgccctagccgcccgaggaaaagtctaatttccctccccctcttcttttctttttcaaaaaggatttaattaaattcttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagcccaagatctcgagcaaggcaagccacctttgaacatcttgagcctatatttgaagttaattatgttgcttgaaaaatattatgcattgataggatcgcacttaatctgtttgtcccgtctacaaggcagattggcggacctacctagtttgttgcatttgatccttcctttgttaattgttataccatgttcccttgtaaccatctagttgcgcctcgatattcgtgcactctgtgcgagtatcgacggtcgccttcaaacttaaaatttgaaaaacaacttgggtaaaacttgggttttacaaaagacttggaaaacccgacacctgggtcggtgcttgcgaactaaatgaatttccaaaaccgcggaccggggaacgtaccgggtgtacggttttccgctcttgcacttaaggaccgtttccttggattttcatccgaacataagacaagtacgaccacatgggtggaatgggacacccctggctgagtaactagcttatcaggggagccttgatgccgagaaacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgccgttgtgaaaaaggggatcgatgtttgagaaatctacagctgatgggatcagctaggcccgggtggccgtttgaaagttgttggcccggttggccgtttgaaagatgttggccgggtaccaatcttggccaattctaaagactgatacattgcacatactccgaccggacgagacgcactgtctcatccgtgtcgtttgagaagcactcacttagttgttttcagaaaagagttcaaataaaatcaattgcaaaaacagcagccctttctttgtagcctgcattaaacacttatttcccatggcttgctgagtactcccgtactcacccttgctctatataaataatcccccccagttgctgaagaagatgaagcggatcctgctgatgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtccgcagcccaacatgactgtacctctactctataataaagagacctctgttgctgtgataatctgtcttcctgtgataccagcactgtttcctgggactggtatcaattaacaggttaatttggagcgtcgcgggctagttccggtcggtactagttcggggcgtgacagtatggaatttggatgacaactgggatttgactagcaaggtatcggctagggtttggttgtttgctagtcgttgctagagttggcagcataatgactagatttagtgtcttctctagccggtgtcgaccgacagtatatcggctagaggaatatgaggttggtgtaggtttggtggggcggaagtgttactccgacaaccgtgagtggcggcggagcggctaagatcaaaagagcccgagagctaactgtgcggcgtgctgtggaggtcgagggaatagtgaagctccgaccgctatacgcatcaaggcgtggggtgctaggagcagcacttcgaccttaggtttggtttttgtcgggctttacaaccaacggtccgacgtcgaggatagtaaaccgcgaacatccccatggaaggcgtaaagttccaaccggcggctttttagtggctaaaggggtaatttggaataaaataaaatatttgaaaagcaaatataaatttaagttgtaaattcaattgtaagatttaatcaaatatttattctaatagtatttgaataaattaaggaaattcaaacagaatcttaaaatagcaaatttggtatcaaaatatagattttgaatttatatgaatttaggtccaagtttgaatggaatcggatctacggtttaggagatatgggcttctaaagattaggatttgaattaaatagagaaaatacgaagagttactgtgcaggggcccacctgtcagtgtctgccttcttttctttttccttttcttcttcctcccgtcgtcttcctcctcttccttctactgccgagcaaactgacaggagggagaggaggggcgccagagctccagtggccggaaggcaacgacgccggcggccggtggtgttcccgagtgcagcgcacctaggaagggcagtgtcctgcaaagggagtgagggaaatggccggaacggcggatgcaaggtcgtgaactgggaggagagagagagcttcggtgaggtttgattcagaggtggaggaaggggggaaggggaaaaatggaatcctctaatcgaggaaatctcgatggcgcgagttattggccggtattgctccggtgagggagatcagccaatgatggtggtggccggtaatggccaggagagagaaggagctcggagagctcgatggtgtggaggggaaaaggggcagcctcgccgaatacttataggcggcaaaaggcggtggcgcaaggcggttccagaggggaagatcaaggaaaacttcgtgacggcgccgtggaaaagaaaacgacggcgtcggctctgtgctccgattggatgtcgacggcggcgcgcacacacgtcggctgccagggagttgggcggcggggaaggaggaacacggcacagcatcgacgcgacttggcggcgacggtagggcagcggcgacggtttcttagagaaggagaaaacggcggaggaggagggtaaggcacagcagcggcggaggacgaacacggcacggtgcaagttggcggctcggctgggtattgggccggcttgggccgaaggagaaaaagaatttcggcccaatttaggtagaattggtttctcaatt

SEQ ID NO: 56211 - DNA, 2837 bp, Oryza sativa
  unsure (1)..(2837): unsure at all n locations
tttggaagtggaatatggtggaatttaatgcactcaaatgagaggggaattaacaatataattcctcaatgtatatatatgtttggaggagaatggtggaggtaaaataaataggatttgaatcctaaatttgatagtagaagtatttgaagaattatttgtggctaatagggaaagttgagtgaagaatataaattgctattttcttagcacaagagcaattattcacaatatttacaataatactattcttgtgccgaagaggaaatcaagccacaggaattaaattggtggctagatcaaaaggaggaatttggacatttggatcgagaatcaaaggatgggtttaagaacaaagaatgggctaacaattaattataataaaattggaattactttgttttaggttctaggacagtatgggaatgtttctttgaccataattcataaaaaaatagaaagagttttcaaactaaatttgaataaaagaatcttagtctaaagaaggtttttaaattaaaaccaaatcaagaaacaccttaatttaaccaactatatttttaaatgaaaaacacaaaagaagttaaataccagaaagagattttatgcaagttagttttagaaggtccctctaattgtattttcctaggtttaggaagttattaagaacataaaaagcggcatgatgcaggattagaaaatagttagttttcggtatgttacaagcaagtactaatagaagattgtgagaaggctaaatgatagatggatgagagaagagaggagatgagagagaggcgcggatggccatatatttatagccggcataggtacagaaaccaagaaaatatatgagagagacatatagactatatatttatagttaagagctaaccactatacgagttggctgagcggtaaactgtaaagatctataaaaccagcaagcatttggctatattattagccatgctcttcaggatggatggagtagcggtgtagcacaactaacccactatttaaaaattaaatatattaagttagattgatgacatcagtcgcagtctacagtcttttcaggaattcagtcatgtaaaaatagagactgaattaccacgaagaccaatgcaagtaattcgctctcaatcttgattatgaccgaaattttaggagatcgaaacaaatcaccaaagaaatcagcggatccaaaaaaaaaatcacacacacaaacaaatctcagagatggggaaccattgctcggttaagttgccatcgcccattggggaggatgcaacatcgtgcttgcgtgtcagggagaaggggacgatgcgctggcataagtacgccagttcgagctaagagaagggaaggaggtgaggaggcgaggactggtggtggcgggaattttttttatttttaattttttttattaaaagttttacaaaaataatttttcattttgaaaattgatagaagtggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttctcctgtgcggggggccgcctgcaaatgggcggcggggggcctggaattttgcaggcggcccccttgccgctctgggggagggcgaatttatacttgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattactaatgaataagcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggcatcttctaggtcggtcagaatgcattgcattctcgtggtccttcaatcgttgatactctacttgtgtttctgactctgttatcttctggccatgatatgatagagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56212 - DNA, 1000 bp, Oryza sativa
ccattaagtgctgcatgttgttttccacatgaggtggggaagggaggcgttcttctccagaattgtgactagcagtgcggtgagagcggtgagactgttccatttctgcattacgggaagctgtgtgatgcgagcggttactgcgacggggttgctcaacttctgcgttgcgggaagcagtacggtgcgaacggttgctgtggtgagactgctcattagctgactcatgatttgcttctggctcaactctaccatcctcaaaaccaaagcgggctggtgcacgagcagcacggcgggggcggctaaccatctaaactcccagaagagggcggggtaagagtcagataagcacttaggagggcaaggagcaaagtaaatagcaactcagatagcacacactaggcataaactggatttttcatatcataaaaacacctagtacaacgggtgtagacaagtcacagagctacgccgagcttgactgtgcgcacaccacctaggagaaccagactaccaaacaatacccacaacaaacacacgcacgcactacctcgccacgactccaaaagagttggcggcggaacaaaagggcctaacacacggacggctgctgaagactgcctcctctactcctcgtctgcctggctgcttcctgtagtcggctcctcagtcgaagaaacgtcgatcggctgacgcgaagggaccggcggaacctgtcgagggccggcagcagcacgggccgctggcggtgggggagctgggtagtcgaaacggaacacggtggaagaaccaacaacacgcttccgcgcagtgcggataaagcgtgggcctcggcgggaggaagcaactggggtgtgtccgggggtgtaggaagggctaactgggtgtgggtagggagagtacactggtgagtatggcgcacgcgagctgggggagcgcgggccactgggagtgcgggcagagccgcgggagctgtgggaggacaggtggctggcgtggc

SEQ ID NO: 56213 - DNA, 6353 bp, Oryza sativa
ttctaatttatttttttaattaataccgtatagtgtttttttaatatttttattttttatcttttgaatttcagttgaactctcttttattttttattctgaattttaattaatctcatattggtttcttatatggattcttctttcactattgcttatttttaattccgaatttcagttgattttaagttgtattcctactttaacttttcttttctttttgctaatttcaatttttttatttttattccgaatattaactaatctcatattgggttcttatatgtactcttctctcaatattctttatttttaattccgaatttcagctatttttaaattgtattcttacttggactctccttttattttataatttcggattttattttatttttattttgaatttgtattaatctcgtattgggttgttatatggaaacttctttcaatatagcttatttttaattccgaatttcagctatttttagattgtatttctacttaaactctccttttctttttttctttttctccgattaatgtgggaatttctagccccccacagcgaacgtggtgtctccttttaaagctgttttaataataaaatagatatatcaaaatagcactattaatgcactatcacactaataataaaaagaaggaccgaacagagtctgactggaatagaattaattcattagatgtgatgtacatccttcatccatacgatctgtccatgggaaaagttgcacaaagtgagctatccatgtgggtttctgtagagtacaactgcatgcttcgggaatggtgcattcgatcagggcaaggatgcccaagggaaacatgaggagaacagcgtacacaatgtcaatcaagagatcaaacaaaccatggatggaatcagggtaaaacaaatacagtgcttacatgtagattatatgaatacagaattgatctaactggaaattctttccctactgcatgattttaatttcaagactctgctctccagtgaaaaggttcctcacacaacatatcagaaaatcaagactaggcacaaaacctgcgtaagaaaatggaatactctacaacattaaaccaagtttttcatgtgtagatgactgtggggggcgtggcagaattcttgaaaagtaaattagcaaacatggtacagaggggatgtggaaggaagagagaggacataagactccaaacagctcagatgcatgcagctctctcagttgcaagactagctacagcagttgcacgaatggttggtaattgccaatctgagtctaccaatgcaaacaacactatcatgactgccatagggaaagatgaacatagaaaaatgcatgttgcaattgcatctgccgcagcactggtggcagcctcatgctctgaggctgcaaagttaactggagctagcagagaacagatttcgacagtcattcacatgggcatggaaactaggtcgctaggggatttgctcatgctgactaccagcgcggcgacctgtaagaccaagaatagaaccagctcatatttctctatatattgtatactaagttacttgcatgaaacttggttcttttgctgcaggcttaaaaggagctaatgcctttaagatgcggaacagggcaataagcaattatgcctttgagaatctcatgagtaaccagaaagatgtccgacttcctattcgaacacctgatggtataatgcccaattaactcatcaatgacatgccacattcaattagattacttcattttccagggatacaagatgaatgcgaaaaaaaaaacactttcatttgtgtattcatgcagggaagatccatatcaggatggtttctgtgcactgcaagcatgacaagataatattgaacttaggaaaggagcatagtttgagaaccagtaaagaatgtgagcctcattttactatcctctttcttaagtgcaggaccattcaccataggcagtgcaaatctgaggtcttacctttgcttttaatatgtagctgtgctaaattgatttatccaattgtttaatcacccactttcttccagacataatttttgatgaacatggtgggacaacagacttcagctacccaacagatgaacatagctaccatgcaataaacctcgcaacatctggtggaaacatacagttattatttgaagaacatgaacaatacagcgcttggaagtcattcatcagatacctgataatcaacaagagatcaaggctatcctactgatacatgatgtacgaaaattcgacaatcagtagggactcatgctctacattccttacaaacccacacatttcttacgtgaacaataccaatgatcaacatcatgttatgggaagcaccatttgtgtggtggtggaacacatgactccatccacaaatatgattgtgtgtatccttagttggtgcagatcccggaagttatacttcctttgtccaaataaataaataataataatgtaatagaacttagtaatagttattccaccaaaatgcagtttattactaagatgtttggttgaatgatgagatccatcccctgaattatcatctcaacgtatttatgtatattttaagatcacagctagctggcaaaattcaactcagtaaacctgaactgagatgatcagacgggttccaaggccctacccctgccattctcacatattccattagcattaacatcacagcagtctttttacacatttgacaggacaattttggtgtgtttccaacttcagaactaaaaaaggcatgaattatttttgaaaggaagagtttctgtatttatttgaaacataagtatatttttgaaataagtatgtctgatttctatactttttagtggaagcaatagataaaacaattgcattcgctgtaaaccaccaacccatgagcaaaatcgtaagaaaaacaagcaattctacaagcagaataacatcacaagaccgacattaagaaggcaatagcacaaaaaaaaatcctacttacattttaatcaacgttgtaagctgaacttgcctaaacaaatataatgccgtgctccttaatggtgtcgatgacgatgccaagcttcccctcgatcctctcgttcttcttgggctcgtaggacatggcgaagacgtcggcgtccatggacctctcggcgatgaggcggccgatggtcctgcaggcgttgtcgtcgacgagggagggcagcgtggtcctgaggtccttggcgttggtgctggcgacggagatgaccttgctggtgcccctgtgcacgaccttggcgtggacgaagcgcttggagaagaagacgttgagcaggaacggccgcatgtacatgtccgtgcgctgcttccacgacttgcggttgggcctctcctccgcctccttccgcgaccgccgcgtccacgccgcgcgcaccaccagggacgcgcggttgctgggcacgggcggcggcgagagcgcgaggtgggcgatggaggcggaccacgagagcggcggcgacggccggagagagggcggaggtgcgcggcgcggggggagagtggcggcggtggggtacgcggcggcggcggccatgggagcgtgggggtttagacgaggtcgccttatcctgtacttacaccaattcttttaagagtaaatggcatatagggccacttctttttaccaatgtggtaagagtaaaagactaggaagtaggaacagccgagcagcccaacactttaaatttgaacccaaaaagattacatataagttttactttgggcaatttgcttcttccctatctttccctctcttccttgctctctgtcttcttgagcttgttgggttggtgtgaaagctcaaacagacagtaacatagagcctatggagtaccgccctccgtcgcactgctcgcatctcgtcaatttgctcctacaccacatagtccccaagctagagcagctctgcgcttgcgtcgattggaggcggccatctctacggtttatggtcgacgatgagcaggcctaggtccatccttcgttcattataggttaatagcattaggagggacatagcttgctcacgagctcattagtggtgatgagtgtggaagcgtaagcgtggatctggaagaagtgagtttcagtacgtttgaggacatggagaggagctcatcaagtggctaatgtatcaattagttccaatttgcaataaattgtaagtccatccggttcaaagtgaaaatatgagatgagatgagatctagttcattatacaactttggtaaagaaatcatgtccaaattacaattaactctttttttaattgcagaaaaagcatcataactatggcgaagcgatggcagttgagatattcaaatttgtcaagagtgtcagagtgacaacatgcagttttacaaattttcattaaaaaaatatagatcaaaggtacatgttatgaaatgcttttaccaaatttatcattatcctgccgcggattataatagcgtacattgtaaatgcagagtcatatgtgtagcgttatcccttatattaactgacgtaatgggtgcttttatcgtggagtattttacatccttataacaagtttaatagtatagcgaactattagctctaaatcatttatagtcaatctaatagcaggtacaatagcaagctataagccagctataaacatttttaaagagataaagaaagagagaaaagagcagcggactacagatctgtagccagctgcagcacagactccaagacgtaatatgtgtatgacagatgggaccaggtattaatagtatagtaagccactattgtatgaattggctattacattgactatagatgatttggagctagtactgggctatactattaaacttgctctactatcattcatacaatagttacctataagcatataatacaccaatatatggtctcacccctcatacacataatgtattgaagtctgtgctgcagctgactataaatctgtagctcgctttccttctctctataagcatataatacaccaatatatggtctcacccctcatacacacacaatgtattgaagtctgtgctgcagttgactataaatctgtagctcgctttccttctctttctcttctctcctccagctagacacacaacatattgaagtctgtgctgcagctggctcttctcttctctcctccagctagagacacacaacgtattgaagtccgtgctgcagctggctataaatttgtagcccgctttccttctctctcttttcttctctcctcccgcttttcttctctccactctcttttcttctctcatccccgctttccttctctctcttttcttctctcctcccgctgttcttctctcctccatctagctataaatctttcttctctcctcccactattcttctatcctccactctccactctcttttcttctctcctccccgctttccttctctctcttttcttctctcctcccgctgttcttctctcctccatctggctataaatctttcttctctcctcccactattcttctctcctccagctggctataaatctaaatctttcttctctcctcccactattcttctctcctccagctggctataaatctgctgttcttctctcctccaattggctataaatctatagctctgtagcccgctcttcttcgcttttcttctctcttttcttctctcttctagaaatctgtagctcgctttacttcttctctctcttttctccacatgtgcttacaggtgacttgtagcctgttattgtactcgttcttactccacatgtgcgtgcttacagctaacttgtagcccgttattgtactcgctcttactgatacactccagttcaccccacccagttgcccacaatacaaaagaacaccgatgcacaaaatccataacacgactcaccaaaacattttatacagcgcgtagcatgcatgtacagatgtacctatatgtggtcttacctctcttggataccatggagtcaagacttcaggattacacaaacaaaataatttttcctccagtgaaattagaatatcgaatttcacgagggatttaaccgcgaatgtcatttctaaactcctgattttgatgaccaagtggggacaaccaccacgaaggtaaacatctgaaaaaaattcagtgccaaacaggcaactggtagccaaaaaggctggattgaacgggccaatgagcaacacacgagaaataatgatttgggtggtgccgagggccttcctcttttcccttctctgttggcatctgctagggctgcaggaa

SEQ ID NO: 56214 - DNA, 4002 bp, Oryza sativa
  unsure (1)..(4002): unsure at all n locations
cgacgctaccatcatggctcgccgtgcggttggtcggtggctcactctgacggcggtgaggtgaaggtggggggctgggggaggtactttggtggctagggtttccaccccgagccgcccgcctggcgggacgacgtgggggttagactcactctatatcatattatcatattataagctgttttaattttttttctcagtcaactttgtttttttaggtttgatcaaatttattaaaacttaataataattataacattaaatcagcttcattaaatctaacattaaatatctttatatattatgtttgttttgtattgaaaataatgtcattttttaaaatttaatcaaatttaaaagtttaaccaagaaaaaaaaaatcaaagtcacttataatatgagaaacggagagagtattccgtttatcctcgaataattgttatcatctcagtatcattacatatattatctactcctatcaatacctattggtaacacaccggccaaaaatcattcacctcgatggaaatctgagaggcccattggatacttaataagctaaactaaaaaccaaaatttgaattttcagacataattttaagttgatcttaaaatatattaacttggtttttttatattagcttttaaatcactaagaaaagatataaattaatttttattttataataaatcattttagttttattagaaaatatgggtaacgagggcctcaacaagaaacaatcaaacactcgtacataccatgtggacttgagaaaaatagtttagaaagtcattccgacaagctaccgttattatttcttcccgtcacaatccaagtagccttcctcctcttcttcctcctctcgcgacggcaacaaacgattcacttccccattatttttccttacgctctccgcctctccgccaaacacgcccaaaatcgtcctgctcctcctccgctccatctactggatccgcgcgaccggcgatctcccccgaacctcgactgatctactggtgacgaaccctaataactcgcttgaatatattgttcggagtttttcttttcctggtcttcttgagcagtagtataatcgatactctgtagcatccatcttcgtgcggatcttgtatgctaaagttctcgagtagtactagcagtttattcatcagaatcatcaggggttgaactgaatccccatgctgtaacgttaggtccgcctcttgtttggtgaatcaattcatacctcgattctttcagggtgtgaatctcatgtactagtattgactagctgtagaaggctattcatagtcatagctttactgttggtctaagtttggtcaacgggtactattcttaggctttcctaccgctgtttctgcgaatggttagcgttgaaacgcagaattgtacaatctttttttgcgaataggttatcaaaccaagttttgatcatttgctggcatctataaagctaaactgacttccttacattggaggttggtggaagagccagcccctaccttcgttagagttccttcaaggagctaactctaatgaggctagaggttgtttcttgtaaggtgataggttggtactagtaaaatatagaatcctttgttcattcttgtccttccatcacagtcgtttctacagtttggaccgctttccaggtaagttcttttactaatgtccagtgttaagaaggtggtttgtttgacggacctcaaatcctcaataaaggaacatttgattctgaatatatagcttagacagagatttgctcagtaaagctaatatcagttgtcaaggcgtattaatttaattttgtgcttactgctaaaataatcagcacaactaatgcatatttagatgttttcaccattctcgcttctacagtccttttcagtggtagaggtgaaatgaaatatagagctagaaagtttcatgtgttcattcttcaacagcagtttaaaaagctttgttgtgttgcctacgtattcttgcatcataatgcagagtttctgtatgttctccttaacacagtacaaaaacaaagcattttctccttggtacagtaatgtgcaaagcttttatgtgttttcaaaaagcggcgcaagaacgaaccatgcctgggcgatgcatgcatgactacagtttgggctattgtggcaggctcagttctctcaaaacttgatttctaaaggaatctttgttattcccgaaacctatatttacctcaattgaccatagatggcaacaaaagttggagcaactgggtcatatatgtatgaaataaaatcagaaggtcaaattctatcaagtcatatgcatgatctcactgagaatctgacaactacctgtgggtcttcttaagttctatttacgcgatcagtcactatgtatgaattccattatctaaaaaaagacacaatgtatgaatatgatgccttgggactgatctcttggttgttggtgctgtattaagtaaatgcgtactgataatttcatcaaagacttaaaatgtttgataaaggtgcactgtgcatcttcattctttgatctgccaaatcagcaattgatgtgttagcttggcactagagctctgggagaatcactagtcaaaacttgctcgtgtttcttggttatctcattcattactatgttcagtacatattatctatttccttactgttgatgtttcaagtcttgagagttagatgaccccgagacaaagatcaagagttctgacatccttccttttttacatcaaatgtagcctttgaccgatggcatcgcctgcagcgccaacagcaacggagttcactcaggaagctgctcgtcagtctctcattgagatctctcagtccctcccggagaaaccttcagcccagaacctggaggtgaagtcaccgagcccacgtgcagcaaacgaagatcatgaagatggagcagagaaatacagatcaaagctgatctcaatctcctacctttctccggatgcccaaccgacgccgtgccctcccaagaatgtcctcacttaactgtgacgatgctcctactcgtgcgtgtgtggcacagtatatcagtgttatacctcacttttagctggaaagatggaaatggaatacttttgggtgcttatgtttctaaccctaagaaacattcagggggaaaaaaaagaacagatagttgtacagatgactttgtgacgaagaactatttaccaggaacaggcttgcttaatccttgcatgttattttgttgttgcataagcttagttgtttccttataatgtatggttattcgaagtgctacattttgccctctttcagagtgaaaataaaaatctcttgcggttatgaacgacctgctatgaaacgaacactggcacgcagtccaattgctaaccttgttggtctcttccatgcgccattcttggtcattggaagagtatcaagcacaacgactaacctcttgccttatccatctactagtattctttctgatttagttcaactttgttcagaaatacagaacgtctgaacaatttttgtttcgagatttgtaaacttttctgaagaaaagggaggcgaaggctcggttaattcaaaggcccaactcataagaagcccaaccagcccatcaaacggtggggaagtgaagtccaacctcctggcgatccaaggcccaaccgatcatgcattcacgccactcacggtgaaccggcggccggccgatcggcggaggatggcggccgcggcgggggactcgtcggagccgaaggcgagcatcggcgcgggcagctgctggtcgccaccatccacctcggtctcggaatcggtagcatctctccgcacctctcctttcgcgcatttttgcatttgaattaggttccatccgcatattaaaanacccggggggggggggcttcccgtcggtgatcgtgctgagggaactgtagcctgtaggtccgattggctccgggagtcgtcgtc

SEQ ID NO: 56215 - DNA, 708 bp, Oryza sativa
gatctcgccatgttgcatttgctttctttcatccagtggttatctgcatgaagtaacttcgatgcttacaggtgattatgcgtgtgttcctttttcctctattagttgccttggtttttgatattatcagttctgtgatatcgttttcctgcaacttggggcttagggcaggtaggataagactcagaaagcaagtattggcagtgactgaaaggtgtcctttactcttccagagttacatttgttcttaagaaatgaactttctaattgcttgtgtcttatactaaaaagatacttgtctagtttgcatttaggtttttcgtggtacatcatgttgaattccaacaagtgcgtattatattatatgcagaacgagcacttcgtgattgttcgtatggaagctatgttaacacatcaacctgcaattgcgtgcaacagtggtggtcatggaagttgtaaatgcattaatggggtttctctatgaggcctcctggttaaatccttgaaagaatgtctggtaaatgatcataatataacaattttgatgggaggaaataagaacagagcattgtggtgcaggaacaattgctagctcctcagctgctttattcttaacctttaccatcagatggtttgatagcatataatttgacttatcacatacagtatgaaagaattttccaggctagacatcaatttcctgaagtt

SEQ ID NO: 56216 - DNA, 2422 bp, Oryza sativa
cttctttggtactcatgaaaatttgtgtttgagtgagatggggggactgtgctagtttatgttactttccctcactaaagataagttttgaaaggaggaacgaggacagattttcttaaggagtactgtttctggtattagcatgtttgatcttatgctagtaacaccatgttgctctatccactccaacatgtcaactttgttgtgccttagttcatacttagttcttttcatttgaaatcaattggttttatttgccattacctattgacttgtgctgtgtttctgcaggacatatggttttatccttaccgttaaggacctatcgccaaatattggtgtattatggtgagttttgatcaaattatgtaactaactcaatgatattccatttgtctcattaaaggggttgtgcaggtacttctttgctgaagtctttgactttttcagaagcttcttccttatagtcttcaatatgaacattgtttttatggtattaccattggcaatccgtctgaagcatcgtccatgcttccttgccttcatttacacagcaattgtcgcaatattgaaatcgtatccatcggtaagtacacattacatgataatacctataaatttagtccctcggttgtgtaaaatttcatcaaactgtttttgttgtgttgtcctgatttttttcccacaagttcattgataccatattatgatttatcttgaaggtcggagattcagctctttatcttggtcttttgggccctatttgctaactgaattagcaggtgcttaacatttcttttaacatattttgaatgactcctagtcctctagaaaactaatggtttagttttacactacaacactaatggtttctctttacattttgtagagatgcaattcactttcttcttgttttttggatatatcggagtctctctccttagccctgtcatgcacaacctgtggatctggagggtatctccctctcccatccttcccctctcttagtattgtgtgccactgatactaacatgacaataatttcaggggactggcaatgcaaatttctactttgccactggtttggcttacacttgccttcaggtaaccaatatgttccgcattatttgttgtgctatgcttgccatggccagtacttagctaagcactcttgcgttttacaacttctctagaatgattagtgctgaatgttatcgtaagatgataaaacgtttatcctaagtcctactatgcattttcctttctaaacttgaatctaaattgtttttgccacttttttgcagaccgtgttggttgtagagagtgtaagttcaatgataaagcatgacaggaagctaagattacttgttacagcttgatttcattctctctaagttcaacaactctgacgctttagtgtttttgcttgttctcccggatacaagcgtgttttttgggcagagtttggagtatatgtagtttattatttttgtagtatatgtattgttacgattgttatttgtaccgcccgtggttgtgaaatatggaccacaaatcatgtaacccagtagactactagaaagacaccaggtttccccctcgaactgtgcccttttgatctggcgtggtgagattggtgattggtacattacatttgtaccatcagtttgtcaggtcaagacaaattaacatggcatggactggtacctttgttttcggttgctaaatgaaatagtacaagtactttggttcgttcttttttcccatcctggtaaatccaaggtctcagttattcagatgttgcagtttatatatttattactaacatttgtctgctctgcagggctttttaccctttaattcctttacagagatatattcattattggggcctcgggggtcccaggtccatcgataccactaccgtgctaataataagtgtactgagcttcattcatggtcacaccaacaaaatctgtgtagttgctgcaggtactgttttagtcagcataagcgatatcgctaaccaccaacgcttcacttatatacggaattgggctagctgctagcaagcttgttggctgcccaagtgccatcctctccaagcagtttctgttagttgcgaaaagccatgcttgtgttatgtcagtccttgcgttgttacacggctcgtattttacttacgtccgtttgagatgctaggacgcttattaaagtgtaaaagattgctctagcgagacgagagaagttggtggccaaactaactcggctgctaatggccgtcgtccatggtgtcagtgtcactcacgcttccgcttccagtgatccactttcatctgcaagtggaagaagactggtgcatatggtcatcgtcttcgtcgtcgtttcggcgtttatcgactttaataccaagttagcaact

SEQ ID NO: 56217 - DNA, 7067 bp, Oryza sativa
cccccccccccccccaaaacgagaagcagcgccaatcagattcccctacaaccccacgcgtttcctcataatcgctacagctgatgcacagggacagggtgaagctttcacaaatttggatcgaacggggccttggttttccttccaagctggtcatggatgattcaatgcctctgcacgcttggtcccgctcagccgtagcgtccgagtccgacctcgctgctgttgctgcaactacgtgtctcagtgcctgcagggaggcaggcggtccgtggacgtggagagaaagccctgcttcccgtgcaatgcaaaagtgtccagcgtgcaagcgtacacacaccggtgatgggcgtacggtcaaaccggctcacttcaacgtgccataaatactcggcgccaccgatacgcaggcgctaccacaactcgacatggcaacgagagacgacacattggtacgcacgcggcacgcaccatctgccgatcgatccgccaggcccatcgttttggctgatttgagaaaaaaaaagaaacgatatatctataaataaaaaataattcatgactaaaacttttatacatttgtaaaagtaagttgaaaaataaactatgatgaaaaaaattttaaaattaactttaaatttaagatcaaaaatttaaattttagttgatataaatataaactagcacggtggcccgcgcagattgcgcggctagcatcattatattttctctcatataataacatatatgttctctcattatgttattcaaatatattaaaatgacaacatagttttaaattttgcaacaactttacaaaactactaatatgtaatattcatattgtattttatatacgtgttagttattaattatttttaatatcaaattttagttatttgtaaatcatatatattcctatatggactctagactcgtcttttaatatttattttttttaattccgaattttctgtaaattgtatatctatatagactctatgctcttcttataatattatttactttttatttataattttttattatttctaattgtatttctatgtgtactctaaactcatctttcaatattctttaatttttaattttgaatttcagttacttctaaattgtattcctatattgactttaaactcttcttcccatgtttttcttaatttcgaatttttgttatttgtaaattgtatttttatacggactctaaactctacttttaattttattatgtttattccaaattttagttagttttaaattcctatatggactctacactctacttctaatattccttattttttaattccgaatttctattttattcttaattgtatttctatatggactctaatactctcacttctacatattctcttatttttcaattccgaatttcagttatttcctaattgtatttctatatggactctatactcctcttctaatattccttattttttaatttcgaattttagctatttctaaattgtatttctatatggactctgccttttctttttctccgattaatgtgagaatttctaggccatgagagcgaacgtggaggctcctttttctattcctttaataatataatagatataagtataagcgaaaagatgagagagttttttttttcactgcacggcacggcaccacgcgaggggaggcgactcttccctacgaaccgaagggcacgagacgagcggcgagcggacgatttcggtaggaaggcggagtaaatgagagcattcaaggtgaagtgcgcggttgggtgcagctggtcgccgcccctgcctgcgtggttaaaaccgacgacggcacagcaacgctgcgatcactgctcaaacccgtcaatccaattcaatgctacgcgacggtgcctcttccttgggtggcagtcaccaccagtcggttgtgtttggtggtagcagcagcagtagcagcagattagcagtggtagtagcagatttagcgttagtagtagcaggctagaaaatgatggtagtgggctggtggcgacgagctaacacgatcagtctggctgtgcgagaagaagccgagagcatggcgagacgatcgaattggttttggcatttgttcaggtatcgcgatgcaagtacttaatccgatgattggtcaccaggtccacatccgaggagccaccaacgctaacgagatcggagatctcagagactcacatactcccttaattcctaagtataagcactttttacactgtatagcagagattaaagataggagggaagatttcttttcagtcattttgttgatcgaatttcgaattttaaatcgcttgattctcgtcacttgtttggttgaaaatgttttgattcccgtgcactgaaatccgcgtaccaaaaaatagttgtatttaggaagtgagggagtatacatgataaaacctgaattcatattccccgggaaagaaaaaaatctgaattcagtatatgctactaggagggattggcaatttggcaccattgcaccaagcctccagcccaccaaccatatccaatgataacaaggaccaccgggcaggctacccaacttagcaagatcctcgactccatgacagagacaagccaggagcatgctacggtagcaacaaacaaagggaaaaaaaaactaaaactgtctacatactagatccaactaggatcactaatccattctctcagtaatgtcctaaactttttttttgttacactcttcaactgggcacaagaaaggatcaccacaacgaacaaacctgaagtggtgtgtcctcagttcgcaggggattggacacgtttttgactgcaagcctacgacgcactagggcactaagccacggccatggatccattccacccaacacaagtgattcagaatccacacatctgcacaggctgcaggcgcaccaccaggcttcagagtagccgcgaccagatcagctataaaccacaaggaaaaaggagcaaacagcacggcgtggcatcctgccgtgtgcgattcgcccggtttccccctccagaaaattgcctctccagaaaacgaacgaatgaccagtctccagtggttacaatctgagcttgaataccgccaaaatttgcgaggattgatgcgaggacaggaggagaatgggaagagagaatggcgacgatgttgtccaaatcgatggaaggttcagagttcagagacgttaagctcatctggggctggaattttttttctctttacaaaatagtcctagtaaaaaaaatgtggaaggaaattgacaaaaaaaacctcgtgaggtcctgtaattacagggggctagttctatacgcctacgatccaacggtacagcgtgacgaagcccggctcgtcgtcgtccaccccgcgcggcgccgacatcaccgccgcctccgggtcccaccgccacgagtcctcctgccggttgctgtggtggctctggctccaccgcgcgctccaccgcccgctccaccggccggagagggacgaggcggaggaggcgaggcggtccacgtactcgcgcagccatccccgcgaccccgccgcctccgccagcgcctcgccgggggccggcgtcacggaaccggtcgttgacttggccgccgcggggcgcgcgatgcgggacacgacggcctccacctcctcgtccacgcggtagtcgaaggacccgagcgagtaggtgcgccggtcgtcggccgcggcggaggagcggcggttgctgatgctgctgatctcgacgcggaagctcctcgagttgttgctgctccgcgagtagaggggatcctgttgcaccgcgttggagacggcggcggcggcggcggtgaggagtggcgggtgcgggagcgagacggtggcgcggcagagcgggcaggacggggtggtgcggagccaggcgtcgacgcaggaggcgtggaacgcgtggcggcacgccgggagcagccgcagctcggcctcgggcgcgaacggcgagaggcagacggcgcagtcgggggagctcttgggcagcgccgccagcgccgacgccatggtgaacaccgtcagcgacgcgaccaccgctccttctcgtcgtgacctcctccccaccccccgccgccgcctccccctcatggctcctccccaccgccgacgcggcggtagcctccccagcctcgacggcggacgccgtcgtcgcgcgttgggccgccgccgacgccctgggcagcgggctcggagccgggtgcgacggccgcgcgaggcagcggaggaggaagtggatcgacacggaggcgaagaagacgaaggcgaggagcgcggtgatgatgagaagcgacggggagaggttgagcgaagacgacgacggcgccggcgacggcaatgagggcggaatggtggcggcgagcgggtcgccgccgatggccggcggcgcgggcggcggcagggaggccatgggggggaaggagacggtgtgtttaaggctcggccctgcgtgtggtctcgcgcctttatttatgggttttggggtgcgcggcgttggcacggagagcgagcgaaatcggagcgcaaataccaggtgattagccgtgagacgagtagaagtagagcacacacaagcacacacatcactagagaccaggtcggagattactttccggtgagtgaacatgtccagttttttctctctactttccttgttcatctgtgatttgtgtctctgactttggttgctttttctgaccttgattgttctcagtgtcatttctctgtgtcgagatgtggtttttggaggtgtaggacatgagttgtatccgtctcgttcttctctgattaataacatacaaattggagtacatctcaatttttattaacactttttttaactgctaaacgatactcttttcaaaaatattttatataatggccgttctaaaatattaatttaaatatatttttattgtttataataaataaaactttattaattaggtgctgatgatttttttgtttagcatatttttacttaatctttatcttcatcaaactcaaacggcaccatattgttcccttcattacattttaatcgttggtagtttatcttatttttgcctcgtagacaaagcacatcattgtagtacaagtaactttgagaaagatgatgtactaccgtgaaatgggcacaaatttacttcagattaaagtggtactccaaaagatcagctaatgctctacttcatgtcctttgatcatatcactatatattttagcccagagtaatcccggttacaggtttatcagcctacgtgctgcacgaacgacaaaactaaatattggcgctggcgggtgtcaccgtgcaatgtagccgtcaggttaccatctgtcacaacgagaacaaggataaaaaacagaagagagaaagaaatggtttcagctagctatggcttcctgcatttctgaaacgaggcccgagtacatagatcaaaagccgtttgctttgacgctttgttgcctgtatatatctagaatgtttgttggtcgaacaatctgtggggcttgctcaagtagtagctttcaactctaaaagagagccagcctcatagttcttccggatgaagctcaagctaacatgagcgtcacatcaacaaaaaaaaaaatcacgaggttgatttaatttactgcagagctttctgaaaacatatcgaatgatcgaactgtacagtaaccgcaccgacagagaattcgttgagagcccattcaattcagctagacatgaatacatggacacacattaaaaatcattggtacatatatacatgtacgtgtatgtacctctgtttctacacgcatgcatgccaaggccatagtgtccatggaaatttatacagatcattgaaagttgctttcattttaatccatgcattgggtattcttaccaactagataaaacggcgtggatcgttgtcagagagagcaaaggtaccgtggccagcgtaatgggcttcctgtacgcatgctgtacgcgccttcaatatctcatctccgagaatttatgaacttcatcagacacgcatcaaccatgtcggccccttgatccactacactttatggtgtatccaatgggagaaaaaaaaactccaaaactacactccacttaaaatgtctcatgtcggattttttttaagaactgttggatttaatttgttgaacggttgattagccacagctttggatggtgcatgaatcggagttcagagcctcctttcgtaacacaagaatttcgggggaatttaggtcttgtttagttcccataacataaactttttacccatcacatcgaatgtttgacacacgcatggagtattaaatgtggaaaaaaatcaactaaatagtttgtgtataaattgcaaaatgaatcttttaaacataattgtgccatgatttgacaatgtggtgctacagtaaacatttgctaatgatggattaattaggcttaataaattcgtctcgcggttttctggcggaatctgtaatttgttttgttattagattacgtttaatactttaaatgtgtgtccgtatatccgatgtgacaaccaaatctaaaatttttccccaactagataaggccttaatctaatacgggaattttttttttcgtctcattatacacgaaatgatcggattgcgttgttaattaaggaatgatgatttggagacatgaggaattttgactttggattagtaaactcactcgcaaattccccttgcacatgcatagagaggtcgttggcgttgggggtaggagtatcgtgcagctgacaataattacaggtaccacgctgaccattaataataaatttattatagcatatacgagcaagcaagcctcacgtacgtctatcactatactttgcccttcaggagcaaatgtggattcgagcttcgtcacaccagcaggttgattaactggctcacatgcacgacgatgccatgattccgggaacagcaagcatggatgcatgaataatctttcaaacaacacaaaagaagaa

SEQ ID NO: 56218 - DNA, 1869 bp, Oryza sativa
  unsure (1)..(1869): unsure at all n locations
ttcctgcgnccctcagaggcaatagctagtcttctatccacattaaagattacactatttggccagcttgtcaaaaaattagagagccaaatctatctttcactccaacaatatgcctattacactctccaatatgatattgggtcctacatgtcactctctgtttacttctttctccctcatctttccactcccctcgacataacagcatgcggcgtggccgacggcaacgaggtggccgaggcgagatgaagcgccgtggtgttgtgggtggcgggaatcaataaggggcgggcaagcagacaatagatcgggccaagtgcactactgctagtggccggtggaaagggctggtgacacacctcaatgtgggcaaccacgctccgcctcccaaacttccctgactcctcccatcaaccccaacgttgtgtgctcccctacagtgccactgacgagatcatgcatctcctctttctctccccctttttgggtagcactggtggtggaaatcggcgtcgagaacaggagacgaccctccagacaacggcgatggcgtgcaacaatggatggcggtcacagcggagggactcgagacgacaacggagacgtccgcagtgaatggcggaactctagacgatgaaggcgacgatggtgtggccagagcgaatggtgaccctaacgacgacaatgatgatcgcaacatgtactcaatctgggtgcagtgacggagagtgtgtggggacaaagagagaaggagggaattgaaacaaaattggcgggcatggggtccacgattggtaaatcagttttggctagccgcccacaagaaggaggaatgaggcggcttggccatgggttggctaggccggctcggctcggttgggacgtgtgcctagctgggcctttagctcggctggaggagagaagtggtgtaagtttggccaagccattcggttgacaaggctgttagagttcattttttttttcataattgttaaattttagcttgggaatgagatagccatattgtttgcgatgctcttaactaagactttttttaagggtagtgtctctcctaatatatatacacttaaagacatgcatgcgatgatctcaccaaaattttattaaactgtaatatgcataattattcataattactcaacatgatttaaattctaggtagagtcatgcaccagaactctcaccccacaccaccagccgctttcccagtttgcatcggtctggtccatgctgatgcttatgcatgcatggctgcttccatatctccggcccgctgtttcatcgttgcttgcacgagtcgtggcggcactaccaacccgcttgttccgcggtctaaatatgtgtttttgaaggacgtactgtgacctaatgatgcaacataattaaagaaacactacacatgtaactagctctctctgatgttacacgcacattattatttggtttttagagtagtacgttgggtcagcttaggtctactgaaagtaaatttatacgcatgtgatgtgtgtcccagggaccgtgtttcgtctctatcacttttgtaccaccaaccttgccatttgtgcagaaaaatcaagtctactttgtctcagatccctggggtttagggtggatctatatgcaggttaattacataagttacggttcttgagaagctgagatgccttgagacacactacagccttgttctttctcctaccaatcccgtggagaccggccgtccaaagtaagcaatgactagtagcagccatcaaatcacagctatttgtctcaagcacaagaacaaacaagaatagattaattgtacttggtctagtttaatccatcaatgccatggggcaa

SEQ ID NO: 56219 - DNA, 918 bp, Oryza sativa
aatatgtttatatgatcagcacatgtattaattgatgattatgtctcatggatcatggtatagagataccaaattaataatgtggacatatgttggtgaacatgttgttaggtagacccaacatgagacactgcaagagccatatgtgttgtgtcatcagtgatctcattgagtgttgatgttgaatccttagacctgagattatcatggttctcaacatgtgtagtagcttacttagggactgctaaacgctactccgtaattgggtagttataaaagtagttttcgagtatgctatgaaacatgtatagtgggatatgaataatcaagatgggatttgcccctcctatggagagatatctctggacccctcgatgttgcagattatggaagtgcatggccataccaaaggtgattgaggagtcaatcacaagttatataatctatcaacaggttcgagtgaatgattgagctattagaggatggcacatatctagccttgagcttaatcgatatcgtgaggcaaaggggttcatacaactatacactagaggttcagccgatatgatctttatgtatgcccggtgggtatacactagaggttcagccgatatgatctttatgtatgcccggtgggttaataagttctgctggagtgtgttgcatagtagttatagttgctatactctgcttacctgttttcactgattcttcggttaggaataacccatgtgctaatttccagcctcctagtgatgcagctgctttatctatttattgcgttgattccaatggatgctgcaacttcagctgtgtgcaatcagccgtcgatgcgattcccgaaaatagattgacaagaagtgtcgtttgaatcaactccggcacatacatgtaagtgttttgcattaatttattgga

SEQ ID NO: 56220 - DNA, 3049 bp, Oryza sativa
ctttagtgattgttttattgaaggttcgattgattttatctttggcaacggcagatcattttatgaggtacgtaccacacaaatcttcgatggttctagttacgttttattttcattgagtgagtaacaaacttgccatgcatctaaccaagtttctgtgcgtttttcagaagtgtattttgaactcggtagctacaagcgatgggatcaacggtgcaatatgtgcacaaggccgtgaatacgcggccgatgacacgggctttgcctttgtcaattgtcgcatcaccggcagtgggctgattttattgggccgtgcatggaggccctactcccgcgtggtcttcgcgcacacggacatgcccggtatcattgtgccgagggttggagcgactgggacgacccgcaacgagatgcgtacgtattctttctactactacttccgtttcattttatattagctgtatgtttctaaacatgtatactacggttttatttgttttaacagcacgatgttctacggtgaatacatgtgtacgggtgtgggcgccaacatgaccggtagagtaccatatgccaaaccgctgacggagcagcaggcgcagatatacctggacgcttcctacgtggacgcggatggctggttaaaaccgttcaacgattctcttatagttaattgagtacaataccatgtaaataatggcgggggtgcaattctttgtacttaacacggttgtttagtactactaagggaccacctatatattcgtcgataaattttctccaaaaaatttgacagatgtaattatagtacaatcgtaatgtaattacactgtaacttatatgtaattacactgtaacttgcatgtaactacagtgtaacttgtaaataagtttcatttaattttgaatctttaaatctattacaagatttgttttggtaggaagaaaaataaaatcacagcacacatatatgtgtaaggatttgtttccacaatctctattttaccgaaataacatattacagagacatttttgaaagttacatacaagttacactatagttacagtgtaattacatgcaagttacagtgtaattatattacgattgtactgtaattacatctgtcaaatttttaggagaaaatttgtcgacaaatatatagcaaaatcgtactactaatatgtatatatctggtatccggagtactccctctgtttcaaaatgtttgacaccgttgactttttagcacatgtttgaccgttcatcttattaaaaaaaatttgtgaaatatataaaactatatgtgtacatgaaagtatatttaacaatgaatcaaatgatatgaaaagaataaataattacttaaattttttaaataagatgaatggttaaacacgtacttaaaaaattaacggtgtcaaacattttgaaacggagggagtacttatttactcacaatttggcgataaatgaaaatgagtaaccagtaacgatcctgtgtactaccacaaagggggtgtttagatggggctaaaactttttagaccatgtcacatcggatgtttggacgctaatttagagtattaaacatggactaataaaaaaactaatttcataaataagagatgatccacgagacgaattttttaagcctaattaatctataattatcaaaagtttactgtagcatcatattatcaaaatcatggcgtaattagacttaaaagattcgtctcgcgagttagtccaagctcatgaaatgaattttgtaattagtgtatatttaatactctaaattaatgttcaaatatccgatatgacagggatttaaaataagtctccggaaaccaaacagccctaaagttacgaattttctgaagtctcatcaccgcaaccacccgaaacgcaacccctctctggagatcaccagatctactcgtccccaatggcggccgccgccgccacctccccggcgcgggcggcggcctggaccttcgccgccgccacatgcgtcaagctcctgctcgtccccacctaccgctccaccgacttcgacgtgcaccgctactggctcgccctcacccacgccctccccgcgcggcggtggtacaccgacgcctcgtcgcagtggacgctcgactacccgcccttcttcgcctacttctcccgcctcctcgccctcccggcgcccctcgtcgacgcctccctcgtctccctccccgtccccgacgcgccgccctccttcgcctacctcctctacctccgcctcaccgtcgccttctccgacctcctcctcctcctctcctccgtcctcctgctggccacggacgcgctcacgcggcggcggcggcggccgttcctctccctcgcgctcgtcctctggtcgccggcgctgctcgccgtggaccacgtacacttccagtacaacgggttcctgatggggctgctgctgctgtcgctgcacttccttgagcaggggagggatctcgccggcggagtcgtttttgctgctctgctgtgctcgaagcacctgttcctagtggcggcgccggtctacttcgtgtatcttttccggcattattgctgtggccggggtgtggtgaggggattgggaaggttggtgctgatgggggctggtgtggctgctgtgtttgctgctgcatttgtgcccttcctgtactatgggcaggtgagttttgctcggttaatttacctttggaatggacgaattggtatgttttttttttgtttagatactgtaatccatctgtaatcatcagttcacttaaaagtaggaaattatttcttgagaggatttcaggatttttcctgtagttcatcaagtgttcagaattagaagatcggtgaagtttataattaagtagttccctatcagtttgtgcacgtaggttgcataattggcacaatattgtcttactcattgcaacaaataatcttgcagatgcaacagctctttaaccggttgtttccctttggtcgaggcctgtgccatgcttattgggcgccaaatttttggggctgcaggaa

SEQ ID NO: 56221 - DNA, 2193 bp, Oryza sativa
ccttgcctcatgaaagcattctctaaaccccagccaaggcacattattagatgggtgtcatatgcaactacatgtgggtttatgtttggatggcatgtacatgagaaggcatcactccatttcactattccgcttgccctaattgccatggatagcttggaggacgcgaagcattattttgtgttgtcaataggtatgtttgagactttgagtcagttgagtcaccgttaactcttgcttaaactcctacttgcttttactgtaatacctactgtttcacaattttcttagaaaaacatctctttctgattgatacactcctttcaccataatacatactccctctgtttcaggctgtaagatgttttggttttgtcgtaagtcaaacttcttcaagtttgaccaagttttttttataaaaaaaagcgtagcaacatttttaaacaccaaacaaatatattattaaaaatatattcaatggaggatttaatgaaattaatttagtgttctaaatattattacatttttctataaacttggaaaagtttgacttaggacaaaaccaaatatcttacattctgaaatggagggagtactatattcacaaaaaaagagttagaaagcattggggtactggttaccatgtgaataactcatatcaggtgatggttcaagacctaagccaatagaaaatacctaattaaactattcggaacagacaccatcttttgcacactgaccaagaaaatggggaaaaagggaaaagccaaccatgtgatacaacattgttttgtactccctccgtcccaacatgtaagcatttttagctatgaatctagacaattgtgtgtccagattcatagccaaaaattactatattttgggacggaggtagtatttatagtggtatagtccactgctgcaaaccatagtacttctagctttaataatgaaaatggcgtgcagtttttcttatttttataactgaaattgtattttgatgaaccagtggcgttcatctgttctgcactttcacttacgtaaaatctgttcactatggagacacatagtcacatactgcttaacatgtataatgagctattgctgtaatatcctgccatttcttagtttgctaacttgttggacagttggagttgaacaccatttcataactatattttaataactcattgtgtcattctatggtagcaactggagcaaaatttcgtgtaattttgcctcaagacaacctgaactaccagtttaacaatgacttatgaagtgctgattatatattgtttgttttgctttgacatacatttttttgttttgcagtttcatgttattcattgttcccattgttgtttgagaaccaagaatatcctataaaggttatgcttctgttgacctatgctaccctcatgtgggtaggattttcttcccattttgctgcaaaatctcctcaagaagggaagaaagtaaatgaatcaggcagcgtggtcaggaaaaatagcttcattgggtggatcagttttagctatcttttaggaattgttgctatagaattatggtctcaagtattccaccactatgtatttggcagcagatttcctttcctacctctcataatggtgtcactctactgtggtgtcggaatgatgtactcatggatgtggcaactcgcatggattgtcaggcactaatatggtctctggttagcaacacgagcatgctgctttgccttgctgggaacccagcctcgcactaatttgtgataactcacccctcttgaccattgcattaggccatctttcccaccccaagttgctactggggtgggaacatgttgacacattcagttgtacagcgtgatggcaattttcggagatgtaaacctcttgtgataactcacccctcttgaccattgcattatgccatcgttctctccccaaattactactgggaacatcattcatatgttgacacattcagttctacagtgtgttggcaatttttggagtaaccttttcgtgatgtaatgtattcttttgtatggagctgcttgtaccaatccattcttcatgggttggtctttttcttcttctgataattctggaacgtgctctgctgattgtacgatgaccatggagatgcttactgtctttcttttccatttttctggaatgcaataag

SEQ ID NO: 56222 - DNA, 5291 bp, Oryza sativa
  unsure (1)..(5291): unsure at all n locations
ttcctgcagccctccttaacggggcctctcatagatgatagatggaggttgaggagatggcaaacaaataacaacttcagctacgccgaagggcgacgcgggcggcgaaacctcgccgtcgcctcctcactctcctcctctcccccaccttgccgccgcctgagcagccgccggcaaagccgggcgactgcgaagatggcggcggcggggctcccttctccctcactcccggtcagccggttggggcgccgacgacaccaaagagcgagagcgtggtcctggcaacgacagccaaatccggcgccgttcggtttggatccggccccttggccagatctgggttgggacgcgcgggtcggcggcggtgtggcgcgtgggccacgcggaggcggcagagtgcacggaggcggcggccgcggcagcgccgcgggagacgcccatgcgaaggtggtggggtagaggtccgcggctccggcgacgggcaggcgccagatccggtcgccccgcttggccgaggcgaccggcgacgggctcggtcgatgccggcgccgctccacggacctggcaggggggtggctggcggcggcgatggtggcggatgtagcggcgacgaagttggcgacgaaggcggcggactacggcgcgtgccgcgacgccggccctcgtcaagaaccttgccgccatgagggaggcgcggcgcccgtcaattgtacgccgtgcccgtgacgccttcctccatggcgccggcgacccgcactgtgcgctgcaccttcaggtccgcgccacccaagccggtctggacagttggcggctggcgaatggtggaggcttacacggtggcgaactggacggtggtggctgatggtggcggctggacgggggtggcggtggcggtggtggtggcggtggcgatggtggctggcgatggcggctggcgacggtggtggctgtggcgctggcagtggcggctgtcgacggtggtgcaaggccatcatccgaggctgacggtgcgtcatcgtcggcagcggcatgtggagacggggaaggaggagtccgggtgcgggcgcgctgtcaagaactgtgggcggtggccttggccgaatttctaaagggacaatgttgttgatcgatgaagatccttcttgtgcggattagtggtgtgggtttggacagggaatcgcgggcgaaagccttgccgagccgtttggccggctgacgacggcgacgccgtttggcatcgttcccctccttggaggcgtcattttagattacccctctccttttctaaccatattctccgggtgaaaaccttgcttccttccgaacgagcggtggcggcgatccacgtcgcgtcctccttgggggcaccgctttggagaaacctcttcgtgcaaggattgtcaatggtctatgcattggcttcgaacttcagtcctaggctttgacgaggccttctagctccactttttgttttgcttttcttagtttgtgtcctctcttttcctgtttggtgtgttcaacttgtcttgaactacactctcttctggagtggaattttgtaataattggctgtagctctttttgagcaaaggccgagatattatattccattatctaaaaagctacgccgaataagaaacccaccagaagttttgataggggtcgacgccaaagcagataatccaaagaagccagccccatccataccaccggcaaggatagcaagagtaacaccactaactgcaaaagaaactgaggggcatccccgattagggcctccacgcatgggaggttgagaccatctcagcaaaacttgaaaccttcagccgtgtaattgatcttcactggaggtcaagaagaagaccacctcctttgtatagaactcgtcggagaaatcgagaaaggttggcgcaacctttttttcccagatctaaaagtatctcatccaacggctgggagaagaaacccggcaaagaggtgaccaatcactggctaaaaaaccggtgatgctcaccacaccaccaagacgaggagcgtcgaagccgacggacaccttgagcagtaaaagatggatgataacgagaagaactcgaactaacacgatgacctgaccaaacgagaaagcaagactactacttacactactagatgagaagagacatccgacccccctttcatccatcgttggtggtgatccaccggagaggaggaagaggggtcggagaatgaacgaggcgactgtagcggagattcgcaaaagctggagtggccgaggtctctcaaattctcagcagtatctttttggggctccgaacagtcgcgcatcagaacccacccacccccaaatatggactatgggcatttaacattttgttaagcacaacaatagcaacagaattcatagaaacaatcagacgcagccttgccagcaaactgtattagctgatgcctggaaatggcatgatgctacccacagcctcccaatacaatacatgggtagagtaagattaaggaggaggagggggaggtggacctatccatgcaacttaggctaattgtattaatgtaccaactggtacacgatgtcgctggttaactttgaaatggcctcgttgtacatgttctccgagctcaccgggttcttgtgggcgcttccctcaaacaacattatatcacagttgccgggctcgtccgaggcccggtgcagtttgtagaacgaggtaacggcggggcgcccgacacgcaggtcgtcgatggcgctggccacgagatcgtccatgtcctggtagtacttgatgcagagcttgagctcctctaccagctcggtgaggacgcgtaccgtggacgtcacgttgcgcatcgtgatgttggccgcggcgatggcgaggccacgcttgtccgtggcggaggcgcctgccggatcagccgagagcacgcccaagcagtagccatagttggaagttgcggtgcatgtctcgttgatgagagatggggaacccaccgtgagaccgggggctattgcggcggcgaggaggagtgtagcgatgatgggatgcatcgggaattctcaggccggggagaagctaatgatgcttttttgtggtttggctcctccaggtacactgagatttatagaagagaaaggaccttcaaaaggaaactgatcaatgtaataaattctaaattcaatgcgattgatcatgaaaatcgactctttaatgtacttccggctatattccaattctttcctcaataaattgccacctcctttaaatgggtgtacattgtgaataatcacaaatgtgtttgtgccgcgtgcaaacgtccgcacgtgaaacagaacatcccctcgtgcgacccttcgctctagtacgtgcctacgtgctctcctgcctgctccccacgcatcgtgcaagagtgacatttataagttcagggggagaaaacccatatagcattattggaaaatcagacttagtactcatttacagcaaacatgaaattatagatttgaatcatatttaacgcaggagtatagtattttactaatttccttgtgaagcagatttcataaaaaaaaactcatggaggccacttgaaccgggggaggctaatgggcgatcgatcgccagggcgattgcccagtgatcggtttcccccctccccctatactcctccctcttgttcccttcctcctccccttcttctctttccactgcagtgcaccacacaatttttttaaaaaaacaaaagttagaaaaatttatatatagaaatactatataaaaaaatttgaattcaaattcaaatttgaatcgggtatgtaaacttttaacttataaactttgggtctataaactttaggtgtataaactttagatgtatagaaatactatatatagaaaatatttgaattcaaattcaaatttgaatcggatataattcaaattcaaatttgaatcgggtatgtaaacttttgacttataaattttggatctataaactttaggtgtataaactttagatgtatagaaatactatatatagaaaatatttgaattcaaatttaaatttgaatcagatataattcaaattcaaatttgaacgggtatataaacttttgacttataaactttaggtctataaactttaggtgtataaactttagatgtatagaaatactatatataaaaaaatatttgaattcaaattcaaatttgaatcggatatataaacttttgacttataaacttttggtctctaaactttatatgtgtaaacttgaggtgtataaactttaggtgtataaatttactaaaatagaaaagtaatgcggtgccaaaaaaggaaaccaggtggaggggtggagggagggaggggggaggggatcnatcgctgncccatccccagggcgatcgatcgccgaacaacattctcgcttgaaccgtggctacctgacggcccacatgcatagtagagtaaggaaataagttcactttgattcccttacctagtggcataatctgattcgtatccttaaaccacaatatcagatatgttgaccctcctaagtcctaactattaaaaccggtgcaatttgactctgtcggcggttggagggtggtttccttgacgtggtgactacgtagcggcattgacttggtcttcatcttacgtgacgttgacgtgacgcttatgtgatactacctccgtcctaaaatataagaagttttaggcttgggcacgagcattaaaaaagtaggtttgattaaatggaagagggttgtgattagttgagaagagaaagtatgtgaagaatttgaatggtgaaaggttatgattggttgagaatgaatgtaggtgaaaaagttatatacttttggacaaactttgaatgctaaaaattgttatatttttgaacgaatggagtattagaattaaaaaaaatatgtgagacccatttgtcattcacaaaagaaatattgtgggacccacacgtcatcctctctttctccttcccttcttcctcctccctctctctctcccttctctctctttctatttctctcccctttcgccttttgcagggagagctggagcagcggcgaagctccgacatcttgaccgaccggatggcgatggtgacatgccattgctccccgctgccttcatgtcccggagctcggggtatgagaagtgcgacgagtggaagtagcacgaggaatggaacaaagtcgacggcttggtgccattgtcggacatagcaactccgttgtcttatcctcccacct

SEQ ID NO: 56223 - DNA, 1479 bp, Oryza sativa
  unsure (1)..(1479): unsure at all n locations
ccgcccaactccagcggcgcccgccccttgctccgcttcggccgcgcatctctgcntgnttcgcccgcgcgcccgtcttggccccgtcgcttacgcgctgaagaagacaagagaagtgaagaaaataaaagagaaaagagaagaaaagggaaaaaaagagatgaccacgtgggtccacgctgactcagccgccacgtagaataaaaccggggtcaaaaccatcgaaggagctattgtgactggttttgattagttaagggacgccggatatccgattttgcggttagaggatgattttgtaactcgatgacaaagttgaggaacctttggtgtactttttcccttcccactttcatgcggcctgcagattgcagatccaactcttcggccttctattccttcaaccgcggcagcccatatattcttgccacacaactatatataggcttgaatgcttgattacatttatgacccatgaatgaagccatgtgcctgcatgcaactaaccgccatcaaatgtgttaggtttctcttcttagcgtctaaattaagctgaaacaactgatctgatccttctttccccgacgctagtcgctagatgctggttcggttaggttgttgtatcttgtgctaaagaggccagtacatgaaaggtatgcatgtcaagttgtcaacacgataagttgcaaattattgtctagctaactcctaatggagctttttaataggtggatagcactaacaaaaaaaatcatcctttctgcaagggacaaatgtgattatggtgttaacatttgaccgactaatagtgaatttgatttaagatgcattttgttttacctagaactcattctctaatatatctagcgaagaataaacacgtgatatcgttattgtgattttgatttaagatgcattttgttttacctataactcaatctctaatctagcgaagaataaacacgtgacatcgttattgtgccacctcgattaatgattattgagtaaattacagtttaggcctaatttttccctagtgcaacatgtgaccttttatcagttttggaccaccctttatcctgacttttcacttttgacttgttaattttactacgtggcactttggttcataaaactttctttcttatctattaacatctagctcatcctatgctaaactaaccgtgggagttgtttcttctttgtatgattaaagtacaattctttgtatgcttgctgcagcccgtgcctcgcaagatccaagcaaatttacatataaagtaagatttaagacaaacttggcatgttaattaagagatacggagtaccgtacgcgtgtagaattagaatcaatctctagctagggcctttacatgcaaacagactcaaaagagttttgtccgatttcctaaaccaattaactagagttagagatgaattaggctataatacacatatataaataaagcagcgggcaac

SEQ ID NO: 56224 - DNA, 1651 bp, Oryza sativa
tcaaccagccaaaactccatttccaagtcaaaatggtagatgattcagacaaacattatgacattagccatgttgccctgttgcctgttgcctgttgctttcacgaaaggctcatgttccgctcatgcttatggtgatgcacactttttattaaaaaaactttagtttataaatggtttaacacaggcatggcttagctctaaggtacggatgtgactcttccacatctcacttacaatttaattatttcttttcataaaagggataacccaaaatataaatatttgaaaaggtgtgctttcaatgtaaatctattgaaattactacgaattaaggggcacaaaccgtgggggaacgtatgtggtcatttggggaagaaaaaggaagaaatgcttccaagagagaacccattatagacacatgcgatttgctattgactttatactttggacaaaaattccaagatatcatattataaacataagattataaacatccaaaatttggtcaaaaacttaaaatttgatatttcagaatttgtatccaaattttgtaactttttgtcttaggggtgttttggtaatttggataaaattgtacattagtaatggaggctcatcagacgatgatgttgaattgtcgaagttaaacaaaagccgatagcgtattgtagaatatgactaaatgataaatcataaacatgtgacaaacttagtggcatatccactctttaatttatgtgttggctttaacttaggccctgattgattcagcttagcattattataatctggattattataagtagattgaaacaaacaagtaaattattttgatagattattataatctataagccagattattataatctaataatctcctttggaggagctttttccagattattaagtgactaaagactcattacccttacatgcatgtaataatctatagaaacaaacaactcacagcttattttatgtcagcttattataatccagtttagagtaatctgatttaataatttagattacaataatcttaagctaaaacaaacatggccttaaacgaaactcttcacatgggccacttccattgggccaagatattctgtagacactggtgcaggcttccgggctcaaactttgaaatgtcatagaagttccttctgcagatttcagtgtacagggtgaatttctccgtaattggctaactagtcactagggaagactttttctgtaaggatcactagggatgacttaagaaataagtccaatttaactacctcaattgtagggccaatctgatttatatccctcaaacgcaatattgcatatgttgacccccccacgaaaaaaaataataaaaccagtacaatttgattcccttgatattttttagggtggtttcgctaacgtggcatgttgacttgatctacctatgttgatgtgacaacctagttataaattgaagtgggaccacatgtaaatgactaaggttttaaaaaaaactgtgggacccacttatcagctcctcctcttcttcctcctctcttatcccccacttatctttcccaagctcgtcagaccatcctactcggcgtgccgtgccgttgtgtggaggcatggcttagtgtagctagctcacc

SEQ ID NO: 56225 - DNA, 7516 bp, Oryza sativa
taattcctgcagcccacaacatattacaatcaactatgtttttttaggaaagtcatttagcgtgctttattaatctacaaacatagttacatcgttcactggaatgttccacaagaaaattggggcctcatcaacccaattacaagaattcttaaacttaaaagcatgattacctagaacatgtgctacacaattggcttccctattacaacactcgacagagactttaacaaaatcatacatcaaaaatctggcattcatagaaaattaccacaaccgttgttgccgaaaaacccccatcttgcatcatctccaccacctacaaacaatctgattgggtaacaataaatcgttgttacttcaactatgttagcctcgtaaggactttttttccttcttccttattaatttacaaaaaaagttcattttactccctgaactatttcattggagcacttagcccctttaaacttttttttctcattttacaccccgcactattgaaaatggttcacttcacatcccccccaaccaacgctacctctcttctttagttctccctgtataagtcatattttacgtcaacattcttttgtgatttttttccctcactgtttacataggttgaaagcacttcaaactgatttaaacatcaaaattctaaagttcgagcaaacaccatgaaaaattttaaaatatttttaaactttggtaatggtgtcatctatggctctaacaatatcagcttaaaatacagcttgtataatgagtaaaaaaatgttattaaggagtaaaatgaatcatttttaatagtttaggggatatataaaatgagccaaaaaatagttgagaggataaatggtctattgaattagtttgggcgagtaaaatggatttttttttctaatttacatgctcattttattcacctgttacttgtaatgtactaccgttgcttttatgtttgtgtactccgctgccatggagacatggagtgtctacaggacaataccatttacagaatcaccatatgatatttctgtatcattttcacatctatttccttacgatagctattcagcctattctaatactagtatatgctctgcatagaaaatgtgaaatgaaaaacattcgggatatggtccactaaacagcataggaccatgaacaacattttttttctttatgggcacgagaacaagtgatcaacagttgacactgcacaatcatgactaatctgaaggggcgagttggcaagttgcttcagaccacgttttgttgaggagtgaaccagataatttttaggtcatacactgtacgacctatccaaaaggttttttgtggagcttgtgcacccacgatactgaaagtcttcagatcatgcactattttctatagtccccacacactcaaatcaaaagccccatttttattctagtagcatgttttgtcaaaagcaatcatggtatttaatcgttgaaaattgattcgaggtaacaaacttggacagttcactgccccagtttaattgtagctctgtttatctaccccaattcgatcattttctgaattctgataatcgaaaaaggctatcaggaagaggcagggaacacacctaaccttaaaatttggccacgatattactggattctgtttctctccccccgggacatttcagaccaaggaatttgcttccaggtagtcaccactgttgacttatctcaagttgttcaattctacatgaccccaaatcaaagttgaattggtggcaaggtacagtgaattcgagacaagtggtggggggaaaaaacgagctgctacagttgtttctccacgacgcatgaacgcatttttaaccgtcaaaatccttcagatgttcactgctcatgctcagtatacataacaacaaacgaccatgtcattttccgggcacaggaggaagccattaattagatcagggggagaaaaataaagtagcaagcagacctaccacagcacatatacatgagtcactctcaactccctacttatctcgagaaggcttatctcactctctctgcatcgcatggaagccactaaagccaggcttcatccaaagatcatggccataggccggggaggcagtgttagttggctgtagccatcagaatttcagaggtttatgcatgccagtgtggcactttagccccggctgcaaccttcaagacgtgcatttctcagccagcaagcaagctgcccgccggacagcagcggtggtcagttcacggccgtgctggctgaaaattcggtggcttcgtagcatcgcatctcttcttcgtcggactcgctgcagcgacagctcggggagctgccacacagtcccctgcagtcgtttcgccgtcgtcgactcttcgtcgtcatccccgcgcgaacgcgtggtggacaaaggcgacggggatcgagagggtagctagctgcgctagtgggggcgcaatcggagcgcgacgtcctgctaaaggaggccctctgcaaatgcaatgataggaacgtcacgttggtttttcagagcatatatgagaatgagaccgagaggtaaactctgtaatatagccaaccacgtaaagtggcgggagtatgagaagaattaggtatgtcggtgtcataccgtttacatcaagaatcaggtatgcctagctgagctagccgtgtagctgatgataattagaagatcgaaggcgaattctatggttagtttcagtgacagactggagtaggtctagaagatttttttagcgttgtttatttcattaatcacgaaagtatggtaaagcgaaagtcgatttgaaataaatcagtcgtcgtttcgaattataaagtaggctgcagccgctgtcaggcgatccatctagaatgcacttaaccagcgtgagcttggttacctgaaaaacgtagctgcgtgtcacgcatgcctttatgctaaaatatggaggcgtgcagtgattgcagttcatcaacgaaagggaaatcggaaggaaagcaatgattggaaagtcctaatccccattagttaaaccgatctgtaatcactgtcgagcaattttattcacccactgcttgctactcatctggtcgcaacgcacaggaaagattgattggattagcttacctgaaaaatttgcacgcctagagtcctggacgtatgcctggtaaggcttctacgtccagccctcctagtgcacgcatctatgtctttttaaaaagacaaaaaaaaagagagagataacatttctgcatttttcttaaaaggaaaaaagtgcgcaaatgcattggaaagcacaatgcaattgctttctttagcaaatatcatagtcactcgtactactacgttttaatctggatacacagtatatggacctgtcgacacactttcatggtagtcatgcaaaatgcagctcatgtagcgctgcagacacgtaggagtaaatcactagtacagtgcagacaaaagtgataacggctcacaatatacacacacctgacaatatgtcgtcgtatggatggcctatattcccccgatcatcatatctggcttaccgacaagaacatttgggtacattcaactgtaaaccccccccccccccccccacacacacacacaagaaaagctcggccatatgacagggaacacactgtcacacactaaactctgctaaaaggtagctagcctaaagggacgacctgtgcagaggaaacggtaggtcaggatcgcttgaactatgcgagcgtctacccgtgcaggaccagaaaggggatgcgccgatagatcgatctcgctgctcgccaccattgtacaccgcgagtacagtacaccctgctcccgaattgcggctccctagtccctccatcgcccattgcccgcgcgtgcaatgaacacatatgcgcggaagtcgaaccaactaatcgattcgcctgcaccaacaggaacaggggaacagccagctctgtacgctcgccgagccggcggagtgtgtgcatgctgcatgcgcgcgatctggtcacacatgggggtcgtgaccaggaaacctgaaaacagttggcccaacttcttcgtgtctctcgcggtctcgcgtggcccgcggctttagcgcgcagcgtgcgagcatggcagcatcacagtcgtcgcggatccgtccatgagcagaagcgcgtaccacgtcccagggagcagtagctatagctaggacccctaccaaagtagtagctgtcgtgctgctgcacaagggggtggatggatggatgcgtgaccgccccggtcgtgggcattggatggtcgacggcgatgtgcccctcggaacggtcacgatcgggtaggcccagcccttgcgatagccgatcgggggggttgagtggagcgtgacagggcggatgcatggcagccaaagcccacgcgtgcgcgcgagcgatatgccaaccacaggagagagagagagaggcgtagtagtacgggcgtacacctacgtgcgcgttgatattctcctccgcttatacggccgcgagaaaagcgggggaaaaccggaaaaaggaagcccgaagcctagcctccccgcgcgcgcgaccgtcctggccgggagatcgcgtgggattcggctgtcgacgtacgtgggccgcgcgcgggccagtgctcgcgagccgcgcgttgctgtgcatgtatgcgcgcgtgtcgtttcgcgcacggtttcggagagggaggatcgattggatcaggggttgtctcttttggcctaaccacatgtcacgaagggttagttgatgtattatcatcggcacggcagtgaatatagtgattctggcatgcatgcagcatgcatgtggttagtagcagtaagctagcgtgcgtgcacttacgttgcattggttgatcgttcatagtatagctataagaacaggcacgttttggtttttatatttttttaagcgtgataaaggcagtgacgggtaggattgttcagctagtaacctttggttatcttgagccgtcgaccatgcatgccctttaggattccaaacggtcgctgggtttaatcgatctgccgtactgccaatgcgctgcaaagcttggaccatagctatctcagctcagatgttagtagtatcgatctatcaggacgtacgtggaattcgtcagaggcgtctgcctgattcagcctgaagacatatatatgtagctttctggggggaaataattagcggaggtttatttttctcgaaatatcattacaaaggacggtttgtgtaattgtattcattccagaaccagtgaaccaggacactagaaaatacagagtccaaacgtatggcgcccatctgattgacagcatgtccaatgtgatatctctccatgttttttgcatttagtttaacggtcaaagacgggcaatctgaattaagcagcatgcaatgatattttgagagcaggactgtcaggaaaatgttattatcagcatgaaggtacacgagttcattgcctcaccccgcacagcggcgtgccgtcaggttaatcaccacgcgaacggcgcccatcagctgcctgagagtcattatcagcagcgataattagtcccatctacaatgatcgatcgattggtcatctcaccgaaccctgcaaccgtggatgtgatcaattcttacttctcaggcacagacctaagttaggactggccttggacaatgatcgcatgacattagttaccagtagtccgaatcgagcaccagctagcacatcttgcatctactgttacgagtgtacagtagaaccgattaggtcatgtgcaatgcgagggcggaagacctcttttctttctcacactacagtctacccattgcatgcgtcaaatttactctgtaccaggtccaggtttggaccttgaaacaaatgaaaatcattactattgttttccaagcgttggctcaagactagtgaggatgacatgattttttaagtatatatattgttccacattcagtgttaaccactgtgttagggataaaccccactcttagggttagagcaagtttaataggatagccaacttctagctacgaatcatctataaccaatgtaataggcaattcatacaatagttgcttactatactattaatacctagtcctacacctagctatagctggctacaaatctgtagcccgctgctcttctctctcttcctttatctcattaaaatatgtttatacctggcttatagtctactattgtacctgctcttatcgtgttaactaataacataactacactattgatggcccatgcaaattgcgcgaaaagtatcttttttttcttatataatagtgtgtgtgtgtgtgtgtgtgtgtgtgtgtgtgtgtgtgtgtgtatatatatatatatatatatatatatatatatatatatatatatttcacattttattattaaaatagcaacatagttttaaattatttactaaattgatcatacgtgatagttattaattactttcaattttgatcttagttatttctaaattgtattactacatgtactctaacctctacttccacttgtcgacgtttgatgtcacgactacggtatttggacagtatggggatcgttggtgctaggatatatgtgagactgaggtaaagagatggagacatggatttttatacaggttcgggcccctgagtagttaggtaataaccttacatcctgttggccgaagccggtattgctcttattcaccataatcacacctagtacaatatgatgggatagcactatctaactgttgttgacatgtcagtttgaaggtctaactcgtagtcgccaaccaggtagtcttcctcctcgaatccgtgcccgacgagatcagagatagcgctttcgtatctcctgacggtatccggagacaccgtaggggaatagccatgcctatccctgaagtcgatatccggcggcgtgtcttggcgtatgtaggcttgtatgttgattgtgttgggtgttgatgaggtggtcgtccctatcgtggtgatcgtgttgatcgtctcatggtggttgtcgatcgtgttgatcgtctcatggtgagtgtctgtccccctgtcctcctaggggggcttgtatttatacccataggtgtccccttgtccaagtagaactagggaaaccaatatggatacaatccgagtagtccttgtcgtttccatgtagaactctggttgtctttccttatccggaactccctccatatctgaagtcggtttccgtataggacatggtatgtggtgggtcctgccgagatttagtcaactactattaggtatgtagtatccataaccatgacaccactattctttattttttaattccgcattatcattatttataaattttatttttatatggattctaaacacttaacacttgtttcaatattttttatttttaaattttgaatttcaattatttctaaatagtactcctatatatggactctaaatt

SEQ ID NO: 56226 - DNA, 914 bp, Oryza sativa
  unsure (1)..(914): unsure at all n locations
tcctgcagcccttcatattttttaccggatacgaaaacgaatacggatagctcgaatacggaaacaaatacagattatctcgaatacgaataagaatcgaatatgatcggacacaaatacggaaacaattttttctcggaacacgaaaaccaactcaacttctaatagaaacaaatatcaacatatataattagctcattttatataaaataaggtataatttataaatattttttaaaatttaaataatattaatagtatggactagtgttaagagataaactactattaaaatctataaaggtatattttataaaggtatattgaaggttatagagttagaaagatatggggtatgtctcatgggtcctgcggatatccgaattattatccgtatccgacggaaacctggtaccatattcgtattcatatccgggagaaaacattcgtattcgtatccgaactatccaagaattatccgatccgaaaggtatccgtatccgtttttgtccggagccgacggaaactatccgctccgttttcatccctagtcacagtagcttgattcagaatcccagtcccttcgtaagttccgggagaggaacaatcatgcgctggacaaaacgatcccattcaagcagtttttctctcccggcgcctncgaagggtctgggtttccgcaccttgccgccgcgcagggggccgcaggaaacgttaccacgccaaacattgccgccgccgggctcccttctccctcactcccgtcagccggttggggcgcccaccacaccaaagagcgaaagcgtggtcctggcaacgacagccaaatccggcgccgatcggtttgaatccggccccttggccaaatctgggttgggacacacgggtccgcagcagtgtgacgcgtgggccac

SEQ ID NO: 56227 - DNA, 1416 bp, Oryza sativa
agagagagagagaggaagaaggtaaggagaaagggaggatgatgtgtgggtctcacatgttagtgtctcccggctcccgcaatattccttgttgtgagcgataaatgggtcccatatatttttttcattctaataccacataagcaccacgtcaacgccacgtaggacaaagacaatgtctacaccaccacgtagttgccacgatagcgaaacggcctttcaaaatcatcgagggagtcaaataacatcgattttaatagttggggtcgacacagtgactagttaaggtagtcaaagtgaacttattcttagagtaagcacatcaggcctcatcgcactcgtataagcatagtagagcccaatggctgcatacatagacaaatccaaaagcccagagccacttcccacttggaaaaagtacaccgaaggtcccccaacttgtcatggagttacaaaatcgtcctccaaccataaaaccagatatctagcgtcccttaactaataaaaaccggccacaataggtcctttggtggttttgacaccggttttatcctacgtggcggctgattcagccatgtcaggctgagtcatctatcttccccttcttctcttcctcggttcctcctctctctctgcacctgtaggtcggttggcggagcgagggggaaaaggaggagcgcggcgccgcgatggcggccgccggcggcggccacagtggggatgcccgacggcagcccggcggagctccacgacgcgggcgtgcagcgaccttgcgcgggcgtcgacagggaggcgcaggcgtgtgcaggcgtcgcgggcggctggaaggcgcgaacgacgcgggcatcgacagggcgaggcgggagaggaggaggacggcggcgcgacggcggccggcggtgggcggtgggcacgaaggtcaagctcccagccctcaaccgagctcgagcagaagggaggtggtgctcaccgacgctagttcatggtgctgttcattttctcagctcgatactctcccgctcgtcaagctccactacttgaccgaacaaatcgcggtcacgctgactcaaaacagagcgagcagaaaaccatgggaggagggaaaatagctaacaaactaacagaaagtaaataagagtataagatcaaggcaagatcaaatcccaactgacataagttcatttatttaacacataccaccttctccggcaccacggcagcatcatgatgggccagatcaccccacggcgatggcggcagcgccgctttccgccgctgacattccaatggacggtgcaccccatcgagttgtggagctggttcggcgtctccggcggtgagcagctgagcttggcgtccgctacaccaaggtctagctggtcggcgagttcctccagcgaagcggttcaactacgg

SEQ ID NO: 56228 - DNA, 783 bp, Oryza sativa
attagaaaaagaaaaaaaagatttcaattagtaatacaatttataaataactaaattttttgataaaaataaagattattgaaataaaaaaccatctaaaacacataacgagataaattaaataacatgcctataaaagagtagagtggtggcggttgatacgacatataaaaattgttaataaaacaccaaatagaatcctaatgacgattaaaaggagggacgtcaagcaggccgtgaagcaaacgagtaaggcggttgccgggacgtctagaaagaaaaaaaaaacaaaccccattgataatcatattcgatttttaaatctcaatgacaataaaaaggagaagcagcgggcggggtgcataagagtatacttgcagagccgccgacggctgacgggacttctagaaaataaaaaatgaattccaacgatatttatgttcgatttttagaatcataatgacaataaagaatagacggcggacgggctatagaggggcatagtggcatcgtttgatgggacttctaaaaaatataaaaaatggaactacaagtccaatttttaaaggttcgaaacttctaaaaagtaaaaaaaaaacactaataatcatgttcgattttaaaatctcaatgacaataaagaaggaatgctgcgggcgagctatagaggagtacaatggcaaagccatagacattttggcgagacttcttgaaagtaaaattgaacccagacaataattatgttcgatttttaaaatctcaatgacaataaagagaagagac

SEQ ID NO: 56229 - DNA, 2671 bp, Oryza sativa
acggacactagacaacaagcaaagaaacaaatttcgcaattagggtttttaagagataattttcctgctaggcgccacgacggaacggggctacagaccaacccccctaacaagaatctcgaccccgagattcagcacctaagggagcagctccgggaactcggcgcggagaagatcttcttgctcctaggttgcctcatcttcagaatggttgctccattggactttgtagaacttgatggtcttccttcgagtctgacgttctgcctcttcaagaaccttgatcggtctttccttgtaggtcagattcttttccagcacgatattacccaggggaacttgttcttctggaacacggagacatttctttaactgggatacgtggaacacgttgtgcacatctacgagaccttcaggtaactcaagctataagccacttcgccacgtctggcggttatgaggtaggggccgatgtagcggggtgctaacttgccggacattccaaacctcctcataccacggaggggcgatacccgcaggtacacatgatctcctttttcgaactcaaggtcacgcctccgattgtcagcgtaattcttctgacggttctgcgctgtcttcaaacgttctcggatcagcttaacttgttcttctgctgccttgagtatgtcaggaccgaataccagtgcttcgcccacctcattccagcacaagggagtgcggcactttcttccgaacattgcctcattcggcgacatctgaatgctggcctgatagctgttgttgtatgagaactccgcatacggcaaacaacaatcccaagtgccttcgaaatccagggcgcacgcacgcaacatgtcttctaggatttggtttaccctttcggtctgaccatcggtctgcggatggtaggccgtactaaaatttagatcggttccgagggcttcatgcaactgcttccagaaccttgaggtgaactgagtgcctcggtctgacacaattttcttgggacagccaaatctacatacgacatgggtcatgtagagttctgctagtttctttccatcaaaggtggttttcactggcacgaaatgagctgatttcgtgagtcggtccacgattacccagatggagtcgtacccgctaggtgttcttggcaaaccggtgatgaaatccattccgatctcttcccatttccactcgggaatcggtaggggttgcagcagaccagctggcctctgatgctctgccttgactctttggcaaatgtcacacagggctacgtattctacgacatctcgcttcattccggcccactagaagtatgccttgatatcttggtacatcttcgtacttcctggatgaatggagtaggcggactcatgagcttcctttaggatgagatctcttaactccttcttggccggtacacagatgcgtggaccgcaccaaactgtgccttgatcgtctatggagaaatcggtgtctttcttctcttgtattctttttattaattcttttatcccttcgtcatctttctgagcctcccggatttgcgattctagggttggctgcaccgtcaagctggcagggacacctgactgtaccacggtcagcctcaacttctccaattctctgcacaggcggtcttggtcaggccgtatttgagctacattactgtaggccttgcgacttagcgcatcaccgaccacattagctttaccggggtggtcatgaattccaagatcgtaatccttgattagttccaaccatcttctttgcctcatatttaactcggtctgagtgaagatgtacttaagacttttgtgatcggtgtatacttcacatctgttcccgattaaatagtgcctctagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacagaagatctcgaaatcttttcggatatctagcaaggtgagaactggggcagtagtcaaccttttcttcattttttgaaagctgtcttcacaggctgcagaccattgaaatttattttccttctttaacagctcggtcataggtctggctagcttagagaatccttcaatgaatcttcgataatatccagctaagtcaaggaagctgcgaatctctgacacattcttgggtgggttccaagcaagtacagcttcaaccttgctgggatctacttcgacaccgttggaggagatcacgtgtccaagaaatgctactcggtctaaccagaattcgcatttcgagaatttagcgaatagttgatgatccctgagcttttccattatcagcctcaggtgttcagcatgttcttccttattcttggagtatatcaggatatcgtcgatgaacaccacgacaaactggtccaggtattccatgaagattttgttcattaagttcatgaagaatgctggagcattggtgagtccgaaggacatcactgtgaactcatatagaccataacgcgttgagaaagcggtcttcgggatatcttcagatctgattttcagttggtggtaacctgatctcaagtcaatttttgagaaaactcttg

SEQ ID NO: 56230 - DNA, 1139 bp, Oryza sativa
tccctaggatgatgtccaagctttgcgagtctaggactatcggtttggctagaaagtcaacttcctcaattctaaggttaacttccgggcatatttgagtggcccttatattcctcccaggggaatgtactatcattggtacacgcaaattttgggttttccaaccatttcttttcacaaaagcttgtgatatgaaagaatggaaagctcctgaatcaaatagaactattgcgggtacggagttgacagagaacatacccatcacgacgtctggagcatcctgacggtctcagcttgaatgtggttcacccggcctcgaccaaagttgttggaagcacgtgaaccttgtccacttgcctgagagctaggacgaggctgagctgccgctggagtaggagttctggcagtgctgccattagcatgccctgagttggtgttggtaggattctgagggcactgtctggcatagtgacccatctggttgcaccggaaacactgaactgctgacggtccctgcggtgacttgaaagaggtaacactgtttggcgcagtattgccactaggggcacgctgctgtggctgaggtgccggacggttcatctgaggacgaggggcgtagcctggctggcggttagcctgagtgaccgactggtgatattgcatgggttgaccgtagcgagggcgaggtgcgcctcgggaagaatttccctgatggttagacttgcgtttcttgtattcttcggtagcctcttttctggcatcttcaagtagaagtgccatgttgatcatatgttgaaaagtggggaagtcatgagcaagcaactggagtctcattccaacagcgatccctttcaagaatttcctgatcttcttcttgtctgtgtccacttcctcaggggcgtaccgagccaacttgttgaacatacttaggtactcattgacactgctgttgccttgcttaagtctgttgaattcctctttcttcatgtcaatagtgctttcaggcacatgagctacacggaaagccgtagcaaactcatcccaagcaatgttagtgggttcagggtgtgcattgcagtaattctcccaccaatctgcagcaggtcctcttagctggtgagaggcgtagagcgtcttct

SEQ ID NO: 56231 - DNA, 3175 bp, Oryza sativa
  unsure (1)..(3175): unsure at all n locations
gagtgaaatagaccaaatggtattggaacggagaagacaaaatccaaaacaaatacaatgataataaaaatgttcccctccaaaaataatgataacaaaaatgtacctttgcatcaacagatgagatattgccattgcatttcacctgaaaagtcaagaaagtttgatggcacgttcagagaacattcaaaagctcgaaatcctgagtcccctgtctttactatatactacataagcataagccaaatgacacaaagaaatcaagcatacagtnnnnnnnnnnnnnnnnnnnnngtaagactggtaatcatctgcttcctcagaagaaatgccttcatcacttgaagtatgatcagattcatcgttgcatccattagcctggttcaaaggatctggaagaaaccatacacaacacaaatcaaatgaaaggccacaatgtgtcaagtatttcagattccaaataccataaaggtgtctgaaactctgaatatataacctttaatcaaatcctttgaatctgagtcactaaaaacgtctctgccatctggactgctttccctgctaactgagaaagcttgaactgatcaaattatcaattgagagcaaagtggaacacagaattgattcctaaaatatgtgaaacatggcaaaagagaactgtttttcggagatcacctttatttttagtgtacaacttgagaatatcatccagtggtagatcagcttctgcctgcaaagcagccaattcctcgttgcgctcagcctccgtaatttgagcttcatcctcatcgattgtgtgttcatcatctttctacagcacaaacacacacaagagtaattcaatgtcctgagaaatgaaaaacaaaccaaaaaggaaaaggagaggtgtcattattatcttttttggacaggaaaatatgtattccttgccctggtacacaacttacaaaaaaagtaataatggttggtgccagtaccagtatctgtagaaatctaacaagttgtaatgctacccacgaaaaataaaaaaaagaatcaaaaaaatcacaatagtagcttactggctcttcacccaaggaactgttgtaatcatcatcgatttccacattgtctgtaaaagcatactgttaaaagctaaagaaaaaggacatttaaaatttcagagatatacagaacatttcataaagctacacaccaacatcagtcggacttgatgcatttatgttctcttgtgctagttcctgctgggatctttgattagtctgtaaagagtcattttcttgattttgaaggcgcacatcaacaagattttctgccagcattgttgaatatctagaaaaagtttgcacaaaacaacagagagtgagcatgcagcgatgaacttactaaaaagtaagatagttccaaaacaaaaccaactgataatagatggtagtacctttcagtctgtcctaagaggaaatcaagttgcttgtctagggccttttttttcctttcctcaagctccagttggttcttataaaaaacctgcatcaaacccaaatataaatagcataaggtttagtatattggaaaatgtggtgttctaaatatacactgagccacaatgaacttgccagcttctctattttggtccagaacttcttcacgtccttagaaatatttagggcaacttttctcaggcgaacttcttcctcctatgaaaatcgcagccaacattaagataaaacccatgaatactgatttgctatccacataatctacggtcattgagtatgtcgctcaatgtgctggttatatatttacttgcagttgaaagaacaaattaggggaaggaacactgcttggttctcaacttatcttcatcaaagttcaattcaatgtgctgttataaataatgtcttatgtactaatgaaatatatttcctagactgaccatagtttatgccaaaacatgcagtacttgtgaatttaacctattctaggctttatttgtcaacctgatcttattgatcaaagtctccaccaaatttaggtttagcaagcagttaagcaatcagttagctatggttcttcattctttattctcggcaggttaaagtcagatcatggtaataaataaagggtactcagttaaggtccctgtgtactgcagtgaggataaactaagatgcacatcactcagttcagcaaacggcaagcatgcagatgtggccatgtgggtcattgccagcaataaattacagtccagcttccttgtcgccttcccagcctccaacctttcccattactacagtttattattctatgtatataaatgataaagctgctgatagccttcaatatgggacagaattgtaataagacaactctcatggagtcatgttaatctgcctaattaataaaaaaaagacaagcaaaccttctgttttctctcgtcctttgttgcttggtcaactacacccttattagctctttgagcaatccttttagccatggacagcttccattttctctcagcatcaaactcctgcacaacatttaatattaaccaagccaagggaataggattagtatatcttcattataaaaccatgcaaattcactcagtgaaagaaggatcatgatctgtcaaatgtactaatagcaagtaacctttgccagccaagccatttctccaagaagatggtcccagtgagttttcgtccttcgaggctccccccttggggcttcaagagcctgcacaagataggacaaaacttttcagtcagtgcaatacaaagaaagtgaaaatggatttacatatatacaaaagaacatgacttaattttccttctctaactaggcctgacaaaatcaaaaacagtattatgcaagcgtggaatagaaagaaaaatgtgtgtgaagataagagaaatagtataacaatgatttgcagctactaaacataaataccaatgctaaaagctaaccttctggcgtctggctcttgtctcatgatctaactttgatcgaggaccttttgatgccatctttccgatattttgtagagaactatctcatgtcttggggcatattcagaaaaatcgtatacaaactgtaaaatacatttagtgcatgagataaaaggtctaaacttttttccaaaaaaaaaaagtattacagaaagaagaga

SEQ ID NO: 56232 - DNA, 8330 bp, Oryza sativa
aatcgaggacggcagtcagcggcttggacgacagagccaaggagaatggcgacggtgtggccgaagagaaggacatcacgtcactactagcctcgaggaggtcgacgctggcctcccgttttgtcatgtcatgcacatgtgtctttccctcgatcctgaaccctgactggacgtataggtatgtggtatgccaatgacagttattgaagctgccatcagttatgcatttatggattcgggtctagtgaatagggtatgcctaagcgcccacccgagattggactcgatggtgggtaagacccggagcgaggttgtccacgataggtcgcggcggtgacctcagtctcctcctcatggaggctcgcgacaacgggctctgatgctgcctgcttcttcccccctcttgtcatcgttgaacaccatagtccttaccatggatgaagacggtggcctcttcacccttgacccgctagtcggcgaggaagacccacccatccttgatctccttctcatcaaggctcgcggcggtgggctctaatgccgcccgcttcttcatccccaatctctttctccttccctcttctctccctcatccctcctctgtcaccccgtcgccccctacccgtcacatctcccacggcacgacgttcatcccctcatgcgcgcgacaccgcgcaacgaagattgtgtccgccttcacgatgcttctctccaccggtgcttacacagggacgtcggtgatggccactgcctcccaacccccttgagctactgcatcgtcgttgcgctgttgccgccagcctctgccctcccctttacctcccaccgccttgcctcccgtcgagagacatggggaccgcagctcccttgagctcctctgccatcgtcacactgttgccacccattgccttctcctcaacctcccatcgcctcgggcgccgcgttgcccactcctagagtcgcgccgaatccagaagataagggtagagaagagggggtggagaaggagagaagggatttggcatgtggggtccgcatagtaactcggcctgctagagtaggtcaacgagtcacgtcaacaaaaaaacaccctcaaaaccactaagggagtcatcttgcattggttttaatagttatgggtcaagatatctgatatagtagttaagagatacaaattagatcggaccttcaatcatcaaacccaactaatgaaggaaacggtccatttcgcatccctaatttgagtttgcatcactcaactataaaattaggtaagagtatcctctaacttttaaaatcactgcaaatcgagtccctcgactaatttgaaagtggtttttgacctatgtaacctctacttggcacgttggcatagtcttaatctaacatggcacttgtggtaatcacgaaactagaaaaaaatttaaaaaattttaaaaataaggagacccaatgtgagtcgtagttgtgccataatttttctaatgaaagatgtaggactcatatgtttcacatggaaaaaaaatataagagtaaatttcacaaagctataaatactttgattaaattatcataaaactacatatttaaagtgatgtatcacaaaactacagatctaacaataaatttatgacaaacctactggtttaaggctaagtataaaaaagatatagatttgctgatgaaattatcgtaaactacagattttggggtttaaatcctcagcactaatgctatgtttgagttatataagtccaacttctgttattaaattgatatcaaatctatagttttgtgatacttagtcttaaacatgtagttatgtgataaatttagtgctaaatctatagttttgtgatatatcatgttaaacctgcagtactgtgataatttactcaaaataaaaaaaacatctatacaattaccacttacatgtggatacgagtcctattatatattttttccttggctgtaattacatgtaagcattacgtcggataaggactaagttaatctgtcatgtagccgtaggatgaaagcgccgtgtaaactaccgagggacttgatttacattagttttgataatcggtaacgctctatagccggttttgcgctaatggacacgaatgaagctcaatgcatagccaagataattagggtgtgtttgcataggctggtttccaacccggaacagtaacacggaaaactgagcagtcaattagcacgtgattaattaagtatttgttttttttaaaaaatggattaatatgactttttaagcaacttttgtatagaaactttttgcaaaaaatacaccatttaatagtttgaaaagcgtgcgcgcagaaaacgagagagatgggttgggaaaaaggggtgctgaacacacccttaaagtgtactcttccacagaaataataaacttccaactcaaatttggcccagcaatccaaatatggtgagtgctaggcagccaaatagataactcgtctgctactgaaaaataacgatttcatggttttcggctacaagttggatgtgaatccacataccacatttacgcccccacaaacccaagtgggcgcacacaccttatttttctaccacttaactttatttcagctgttcaccgccttgctgctaacaaagggcctatttcgtacagttccaactcctaaatataactccaggagttgagtctagagtggagttgtgtagctgtctaaggccccgtttggtagggctccaaactccaactcctaactctaaactccaactccagtgagagctagctccggttgaagttgaaaactcgttaaaagtgtttggctatactttcagttctagatctgaaaaaaaaaatgaaaaaatgaaaaaaaacgaaaccaatcggccccagccgcgccgccggccgccggccacgcgcgccgcccgtcctcgtcccgcagcccccggccgccgcagcccttcgccgccgccggcctccgcccgcgcgtcgtcgtcacgccccgtcgccgtggccccctaccgccgacgctaccgtagcccgccgccgccggcctccacccgctcgtcatcgtcacgctgcgccgcctgtcgccgcctgtcgtcatcccgccgctgccgcagcccgccaccgccgccggcgcccgctcgggattgggaggggaggagagagaacgggaggaaaggaggattgtaggggtagttgagtggcattttcgtgtagatactctaaaaaattagagggtagtgggtcttttgggatagagtggagctgtggagcagcaaaaacccagctccaccccgtagttcattttttaggagtagctctgccaactccactccaaaaaaaggtggatctggatcgtttggcacaactccggctcctgataagttggagtgggagctagagctatgccaaacggggcctaaacccagctccacaactctagtacattttgtgagagagcttcacccaactccactctcaattttggtggagctgaaactgtttggctgaactccagctctaggaggggtggagttagagctggagctgtgccaaacaggcccaaagtaacagtgccaccgtgaaggaacagcagtgaattgtaaatagtagaaacaaaacagtactaggcagggaaaatgaagtattattagcactagtatgcgtatcaatcaacagtcggcaatgcacagaagcattgatcagtcactcttgcagaagaaaaaacatgagtggtcagtaacagtcgcgttctcttgttacattggccagaaaaatgtgaaacgatgaaacacaggcgtacatgatagaacaatactgcatctgtaggcgacctcttattctttagtatcgtgtcactatccccccgtgcatgtcctatcatcaacggagacttgtcgtgctaaaccaactcgtcccaatgcaactcatcccctcgaagagtctgcagtctccgtctcaagaaccacgacagcctgccatgcatctatcgagcgcgagcagacggccgattcatcctgacgcttacaccgttgccgccatctgcctgccggccacgccatcctcctcctccccgtcgctccggtcgacgtccaccgtgccactcctgtaccggctcgcgcacacgaggtacacggcgaagtccgcgacggccagcacggcgagcaggaagaagaacttgtcgaggtggccctcgttaaggtcggcggggatccagccggggcggccgcgcacggcggtggccttggtcaccgcgctcacgatgacgtcgctgaagtagttgccgagcgacatggacatcatgcagagcgcgctcccgaagctcttgagcgcgtcgggcatctccccgttgaagaactcgagctggccgacgtacatcatcacctccgacacgccgatcagcgcgtactgcggcacctgccacatgatgtgcaggtcgctgctcatcgccgtggtggcgccggccttcctgaagtgctcgaccgtgccggcggtggccatggccatcgcgccgagcaccaggccgaggcccatcctctgcagctcggttgggccggtgtggcggcccgtgagccgcgacacgagcgggcagacggcccggcggtacaggaagatggtggtggcgacggtgaggatgtcgaaggccgacatgctggagggcgggacggagaagcccgggaaccgggtggtgcggcgcatcgcggcgccctgcacgacgaacagcgacgccatctgcgtgaacacgaccgaatagaggatggtgcagagccagatggggaggagccgcaggatgctcttcacctcctccacctgcgtcaccgtgcacagcttccaggggtcacgcggttgggtgcacgtgccaagcttcgggttagcgcccaccaccgccgcacggtccaagaacctgcaatacatggcgagttcagtgcgtgcatgcgtgatcagttcacagctcacaaaaccacacaacactttacctgaaaccttccgtgtgcaggagcttcctcccaccggaatccgccttctcgtcgctctcgtagagtgtcacggcgcccggcgactcgccggccttccagttcctgcacgcggcgaacgcgacctggaagatcctgccaaccgggttgccgctggggcggatgtaccggtagcggagcgtgccgccgaggaacagcagcagcgcggtggccgcggcggcggtggagacccagaagccgagcgcccagttgccctcgtcctcgaggaagctgaggaaggtgttggagaagagcgagccgaggttgagcgccaggtagaagtagctgaagaaggagaccttggagtgcgactcggccgggtcctcgccgtcgaactggtcggcgccgaaggtggcgacgttgggctggtacccgccgttgccgaacgcgatcatgtacagcgcgatgtagaagatccccagctccgcgccggagtgcggctcgcagggcacgtgctccgtgccgcacccgaccggcctgatcaggtacagccgcgacgacagggacagcagcgcgaggccctgcaggcaaaacaccgtgacgcgaacgagtcagccgcgtgatccacatctcctgggcgtacgcgcaacgcgaccgcgatgtgccttgggccgatcgaccgaccggtcggcgccaccacgtactactctatgcctctactatatggaccatccactttcgacaccagcatacgtgcagatacaatccacccagtacagagtacaggccgaattaactccactctggacagattctcccgcaccaatcgctgttactttgtacgtacgttcctacgcatctatagaccatcatttcccgtgaaatgggcaatcagaacggaaaaaactggtcactgatgattgcccgaccaacagatcagaccgaagtagctagaaacatgagatcaatcgatcgcaccgagaaaggcgcgtggttttcagatagaactgcggagagagagggatgtgccgtgtggtggtgcttacaaggacaaagatggcctggaatatggcgcaggtcttgtagcggccccagtaggagtcgctgaggaaggcgccgatgagggagaacatgtaaaccgtgccggtccatttgctcacgttgttggcggcgtcgccgttgctctgctgcagcaccctcgtcaggaacaacaccaggttcacgtttaccccgaagaacgccagggttgccagaccctggttcactgcacaacacacacaaaataaaaaggtgtcaaggccttcaagaataattctaaacaaacataaaacgatgcacacatgcaaacagtgcgccgcttaactcccccatgaaagcagcaataaagccaaactgtggtagggcgatatcgtactccacataccctacagatcgatcgatcatttgatcgctatgcatggttgctacatcgtggataccatgtccgatgtctcctacggagatcctaatgtggcgctagtaatgcgtgcgcccgaatcccccgtggcgaggaaccctccagttgtgggcgttgcatggccgatgtcacctcgtcatgcagcattccgcgtaaagacccggcgcctaccgccactttaagcctcaacgtcgagtcacctcagaccgacttgcactgttgcgaaaacacttcactggaaagcccagtcatcgactttgtctccattttttgctggcccgtctcagccgggaaggagatggtgaaatcagcagagttcagcacaaagtacttacgaagaataaggccgccggcgagccatccgccggacttgcccttcaccgccggtgagcccttgatatccacggagccatcgagggtgtactcgcagcatacatccttcggggcgttactcgtctcatcgccttccacgacgatcaccctcatcttcatgtctccgtcgttgccagactgcaaccatcaagttacatgctgtcagttagtttccagtttcatgtgctgccatgtatacgcatggtgtttcatcactgaacatggagacaaaactgaatcttggctacagaccaacaagctacagaaacaagctgaaaccgtgtagctttgctaacatatatgccaagaacgatcaaatcatgagcacgtactaaccatttcttgctcctcctcgggctctcctcaccggtggcctccgtcggctaatgcaacgagaagctctgtgtgaggaagccgagcaggaggaagaagaggaggggatctatggaagtggttgtgtctgagcagagaggtctgggatttatagagctcagctgcagctggctagctggctctgcgactgtgagtaggatgtgcagatcacaaaagggaggtggaggagcgtgcgtgtcttgctcgcatgatgtcacaaacaggtattcttaggtatgtgcatcacaccgagacgtcgcgctcgacgatgactgtcgccgtttttccacctctctttttttttttttatcccgttctcatagcccggccatcgtagcacgcaagagcagccttttcccaagaaaaattcagatcgttcctggcaatctcaagtgtgccttttactcttatttgtggtcggttggtgtggctgctcgtgttctgtttcagtaacttatgtgactttacctggttagataattggcaaacgacgaaaaacttagtgccgagtccagcaatttgtctggttttaatcagggtttatctgcacaggaatactacatgacagcatatatagcccgccgcatctttttcactcgccagtctatttatgcagggtaattgcaagctgctagtcgaccctggaaatgggtgcacgccaaagatgcccctcacgctttctcttggaaatccagaaatggagtggcattctacattagactgctacgcttagtcgtggtcaaccaaccattccttcatataatcacatctgcttgagtaaatgaaggccgagactggaactctggattgtttgcccctgaatatgttgccacttgcctgtgtgaacacaaccgcacgatgattattctacgaggctgtacggaacacgagcctcgtctctactagtagctggctagtgcatcgtcacttcgtcaggtagaaatggcaaaaaagaccgaggccccaaaaaaaaactgaaccgaactaagatcagattattgtcatgttttttcactagccaaaattttaagttgaaggttgtaattgctataattaatgctatctcgatgaattgatacgttatatgatgtttgctactattatcttgtgatgtttaattgataagttaaacatgtcctcaaagaggggaaagtgatgccaaaaa

SEQ ID NO: 56233 - DNA, 23905 bp, Oryza sativa
gcacaaattcaaataattactccctccgtcccataatataagggattttgagtttttatttgcaacgtttgaccactcgtcttatttaaattttttttgcaaatataaaaaacaaaaagtcacacttaaagtactgtagataataaagtaagtcacagataaaataaataataattttaaaaaaatttgaataagacgagtggtcaaacgttgcaagcaaaatcttaaaatcccttatattataggacggagagagtagacagtaagaataactagttcctgagagttatctgtagagtatattctatgcatccaatgcactacgtatttaaagagatgctcacaatacaaaggatggagtaattaaagcttttatcatttgagccttgaaccttttcccatttgtatcatatggttgaacataaaatagtcagaaaacacatgtatgctgctagatgccagtctgagcatattctttcagaaaacaagtagtcacacaaactccacaagacggtgtgtgtttcataacatagaagaaaagcatactttccaagattaactgaaatgcatcaaaatttaaaacaaactatatcaaggaaatgaaatgttttcaaatgagcctgacatataaatgataagcaggtagtatgcttactcgaaagggaagtcgtggttgtgatatggtgggttctgtttgctgctgatcagttcttatgcccttatatacgttctaaatgtggaagttgttattaaaagaaccgagatgaggtggtacatacgaatggttttcactttggattatattattgcatgatctgctagtactgtcacctgattatccagcaatataacttcatcggacttaacaactactctattgactaaggaagctattattgacttaaattagtactcgtcatactttttttcttccttagaagatgatgttgaaagtatacgtcggcactgggacttgaaatcttgaattcctgaatattagagggtataccatatcacttgtgtaagaactaaccaataaccaatgactagtacatacatccataactcttatcaaaatgttcttagatcaactacaatgtcccattgcccattgcacatttttaagactgaaaagataatttgtatttatttggctagtcagtcagtttgtagcatactaatgaacaggggccctccttgctttcgggattgatggaatgtgccattatcataggcatatgatcttgagcctcaattctttatcgacgatggtgatacatatccgaggatgtggggacctcattttaccattattgaaggggaccatggagtatataagcatgtttcttcaaccaagtgctattaacgaagcagttttggatccatttgacccatggtttgagcacaagttgtcaccacttacgtatccttcaggaatcaggagtagttgcaacttttttttgctctcaaggtacgtacttacagcatcagtgtgtaataatcaagttttgtctggcgacctttcggtaaccatctagagccaagtcatgggaaactggagttgggactgattcaactgagcttcgtgtggttcagaggctggcacgttactggcacttcctagtgcaatcgaatcaaatatcgacactcgtcctatactcctagttgctgcaatcaatcagagcttgacactcgtcctagttgcgatcgaataaaaagcttcacagtggcaggaactccaatcgacacgatgggcactacaaactgagctggaaacttttcgtttcatctagagaagtagagagagccaccacttgttcagtcctcctgttgtgcgtgtgcctgccgagcgccatcaaactgcaaattgctagtagtagtgcggaaaggctgattcgcgatcgatcgacaggaccaactggttgcgatcagttccatctttcttcacctggtttctttttttttcaccacattacttttctattttagtaaatttatgcatataaagtttatacacctcaagtttacacatctaaagtgtagagagcaaaaatttataagtcaaaagtttatatatccgattcaaatttgaatttgaattcaaatattttttatatatagtatttctatacatctaaagtttataaacctaaagtttatatacccgtttcaaatttaaatttgaattatatctgatttaattttgaatttgaattcaaatgttttctaatatatagtatttctatacatctaaagtttatacacctaaagtttatagatccaaagtttataagtcaaaagtttacatacctgattcaaatttaaatttaaattcaaatatttatatataatatttctttacataaatttttctaacttttgttttttcaaaataattttgtggtgtactatagtagggaagagaagaaggtgttaggaaatgataggcaaacaaaagataaagaataatagattaatcacagaagacacgagattttaacgtggaaaaccctcccaaagtaggagagaaaaaccacggacgctagccagcaaaatatcttcactatatctggggtgaggttacaacgccgcacggcggcttacaagaggtatatatatggcgacgcgcctccgttccactatggcagaagctggtatttattaagtgcaaatgaatttggataaggggaggaggaagggggaggagagagacgtataggggagaggggtgtggacccgcgcattagcggtccccgcagtagtgggctattggcccctggctgtggccggcttgcagcactggtgtctcggcccatcttatcgcgagcccaagcctctcgaacaatttctcgtccaaaactagctccccgttcagttgggccacctgggacaagggacgtagccgccacccgttttttgccgatgcgagagagcccaccgcccacgggccgctttgcacctgcgcgcccccaccctgccgcacggccgtttcacgagcaaagcgcaagcgcaacgcggcgaacgggcgcgaggcgatgtcccgtccgtcccgcgcgcggcgcgagcccgcggcggacgtcgatttggcaggatggcacgacaagtcctcgtatattcatcggtttcacggcgcccttgtgaagggggaaatggatatataggtgcatatggaagagtgggagagaaaaaagctagcacacggtggcggcgcgtacgtggagctttcaggcttgaccccgcgaaaggggcgcggatcatgatggttaatagtactagaaagcaaaagttaattactagcagaaatagtgctacagatgatcgggctgagtcgtgacgtttaagctaagagtattaagcagaagaagataatgttgcccttcctgtcgcttctggtatttgatcagcaagaagctacctggtcaatcgttaatcagccctgtgtgaattagatgcgactgcgacgcgtggcgtcggcacgacacgtacgacagcattgccgaaatctcatatatatatatatatatcgatgagatgaaaacgatgaacctgacggtatctttccttaattttcatcgtgagtgtacaagtaaaccagacacgagtagtttaagtgcaatgatgatgacgcttccactatctcgtcagcttcctttgcgacgtgagttggacaaacgcagccaaatgctttagatcagaaaaaataaaatcaaacatatagaccctaatgaaaccactagcaatatatccgaggcgtgtgatacttggttgcttgctgaatggcaagtaggttagcttcttttacattattattaagcaggatggactaatcccaatccatctcgacaatgaccacttccatgaacaggttagaaacggacgtatccttacacttctccctccagaagacgatagaattgtcgccgttctgatctttctacccacttgcacagttcccccccgcgacaaaatcaaccgcgcgtttttcactatattttccctcgtgacgccgcaatcccaccgtgattccacgaacccgcgcggcgcgagcacaagaaacccggacagcgccatcgccagcagcgccagcttctccacgagcgcgacgtgacgcgtacgcgcgcgcgcgcggtcgccgatcgatggctgcatccgcgcgcgcttcgcttgcctcctcgctcgcgcgccggcccggtctctcgagtcggtctccatcgatcgcgcgatcaatcaaccgaccagtagctacgccctgtgctctttctctagacgaacgaacagtccatctccgtcccactccgtcatggcgcggcgagaggccatctcggcgtgatcgatcagcgaccaaattaaaaccgatcgacaccggcaaagtcgcgctcgtacgtcttgagatctttctgttttaccgggtcctttctcgagtgactaatgactaagcatcagtgtaaacgggaagcttctactgtgctaattaagtgcggtgaaagttgctcttttccataacttttggtgcactgcatccgtgccaaagctgagagtggatgaatggatagtacggctcaggatgagcgcaaacgtcttctggaacgcgattatatattacccgagaaagtgacgagctggtttatacgtgtggtgcatgcggttcgtgcaaggcgttattaagtacgtatagtacgagtacttgctaatttgctatcgatttcacgccctccgaatggattttggtcgggcctttttttttttacctgagagatcacagtcagcaacgtaatcacttgaggataaattatagagtgaattgcactttagggcaggttttattacccaagttgtaaattggaccagctatcagcagatcttttcacttttgaccgggttttattactgaactttgcatttttaaccagtggcccacacatcaatatcaaatagtgttcttcctctcctctcctccctaatcacggccagctacttgtggtcgacgaggaagcagagatgagagcaggctcaacggaggaaggagatgagaaggatatacacacacaaaatgttcaagaacgcatgcctccactagtacgttgccgtccatatattgctgctcgagctcgatttctgctggtgccgtacgcgctctgctcgacctacacattctgccatgcactgcgtatcgtgaagcattggagcaagcatagttgatgctttggtgaactgcaccggggaatgtccccaatttgcggaggctacgacgagcgcctactgctcatcgccaaggagcatctcctccgggccgtgccctctacctgacgtgaagctcaaggatctcccaggctcccagttcccataatcaacgcaagaagcgagcacctagctagcagatcctgtattggtagtagttgaatcatgctcatgctgatctgatgcattaagaatttgagccgcgtgctgctgccttcacgagctcaccaagtttcctagattgtagagaagaaagtgatgagagagctggagagggaagtggtacaaagtgaatcattttgcaaacttatctaaatcaaagtgaaaatattttcttctccctagtccaagttgcaaccttggtaaacataagtggcccactgtgcaattaactgtaaattatatggtgtataaataccgacgtgtctagacctcagcgacacactggagcgtatggtttaacgagacaattcttcgcttttggttgaaccataaaccaaatcacctacaccagatcatgacaaggaaaaaagggccgtaagcaaggctgagaatcgagaggtctgggaagtccacggcttgggtttataggcttcagagaggaagaacctgaaaagtaggccgaatggccaagcaacaatttgtgggatgctagctagtggagtggcagcatttgttcaataacagtagagcatctccctggattaattaagataaggaatccctttaagatgactcgtgtagataggccaaacccaaaatacacttttcaaagattagccgataaaaacgaacatgtatgtctcgctctcaacggtgtgcatgtgtgctcagccgccgcaccaccgcaaccaaatccaagcatggtcccgtgccaaatctatctcaactagtactactactatacatctgcatctactactattctactctactcgcaagtctcacaaacacgaatagaaaagcaaccgcaatcaaaccaaaattcgcccaaaagcgtagtcaaggccaccatttactccgtcccccctgcacttggtaagcccttcgtttcgccgaagcttatttaagcccgcggacgcagcgtcgcggaccgaaaaaaaagaggaaaaaaaaatcccctcgccaaaacgcgcaccaatctccgttttaaaaaactcgcccaaatttcaagggaagggaaggggaagaaggaaggcaggtgcgcgtgcgccgttgtagattgctccttcctcgtggccggagcgcgcggcggcggcggcggcgacggcggcgagatgagtcgatgagatggggatgaggtgcaagaagcacccgtaccaggcgggcggcggcgtctgcgccacgtgcctcaacgaccgcctgctcgcgctcgccgccgcgcagaacggggcgtcgtcgtcgcctcctcctccggctgcgccaccggccgcggcggcgccggcgttcccgaggtcggtgtcgccgtacgtgtcccgcaggaagtcggattcctcgggcggcggcgcgcttaagcatcatcccagcctcctcttcttccggacgccgcaggtcggccccgcctacggcagcagcggcgggctcgaggagggggacatcgggtacgagaagcggcgcgcggggaagttctccgtcatcgccacgctcttcggccaccaccaccaccatcacagatcggaggagaaggacaagggaggcgacaacagggagagcagaaaccgttcttggctcgccgggttcatgccgcgccgccgcaagaagcagccgccagcgccagccgcagccgcagccgcctcgtcgcccccgcctaggcgctcctgccgcgtggtcagcaaccgtgggctctcgccggagcgggactgcgacggcagcgacgaggagagcagctcgccgactgatcccccatggcagccatctccttcaccgatgcggaggaccccatgccggcggcgccaaaccagcaccatgccatcgggcttcgccgtctgcctcagccctctcgtgcggcccagccccgggcgccgccaccgccacgcccatccgcccgacccaggcaccttctcctgcgagctacggccatcgccgctccacaacctctcctccgccgcctccattactcggtgccgctccaggaagctcgccgacggcggacgcttccggtgatcttttcacgttttctttttcacctttttcatcttctcttcaccgcttatcaccacctaatcccaattaccatcctttttagatttttcttctcctttcttactcgcattttgtccatccatgaaaagtctctataagattttatactcccaactccaaaccacttcgttgacatataggttactactgctcgtcagccgaccattactgtaagagctgcttgtttgtttgtacagctagttgtctaatcttgatttgcaaaattgttaattaaccttagtttcttttttttttctttgatgcttgggtttaagaatgagtggacttgttgatgtgcatggactgcacggtacaggtcgtttgtacacaggattaaatgctggatttatgagtgagagggatctgagtagagggggataggagtgtatgtggctttgtgcacagggattaaaagaaggttcttgattgttttgtgtctgaaatgaattctgaatctgatccaatggtctatgaatactccatgaaatagcatcaattcaattcatttggtcagagctttcacatggaggcaggcagcgtatttatgggcgatggctgcctctgcctccattactcccttttctggtgcaccaaaccatactaattaaatggtctcaacctctttgtgcataccgaagttaatagtatctgctcattccattttttgcacagttaccacgtacagatggggaaaaaacaacatatttgaagcgctctgtgcaacacggtgcgcacaggccaaaaatacgctgctaaatcttagaaaaacttgatgggggggggaaagaacatgcattcctctactagcatgacacgatgcaaccactttaattcatccctttcaaatcaattaatcagtgttagagagtggaatcattgcgataactacattctgatttgaggccttgactaccgtgacaatagacaaacatcatgagattgtagtattcgttttcttgatggcacggtggaagatgtacacaaacaaacatagtattcgttatgagtacgtcctgttattagcgagcataatttccttcgattatacgaaagttgatatcgatttagatgatttggtatgattctttgtattcatttcaggtcatttcaggtcttgctggcgacttgtgggctgcccacgatgtgcatatgtgatgatgatgatgttgtattcgtgtgggcagtgttgtgactggtggctgattatgacgtgttaactgttaacatgcactgtttagtgtttggattctcctagctagcttaatactgcaacattttgtgttttgatagattcctcttaaggtttcggtacaaattataacatgcaactgcaaagttgtgaatagaaattcactccgatgctacattttgtgctttacatgctgtcccactctctccagctctttagttgcatgcattattttcttactttctcctggtgcaacaagttatttgtttgtttaactttatatactccaatcttccagctctttggtaggattcatccttttgtttttgctcatggtaccatcaacataccaaagtacaggagttgctgctaataaacaacatcaaaccagtagctagtactcctacttcactaagcaaatatattatttgggagatgtggctcactcttgttaagatcacccgttacactttctgttaattaaaatagaaggttggacttttcaattgctgtgctaatatttttctctctgtttgaattagccctggatcatatagtagtattatccagtggagccggtagaaaaatatataattttttgaatgttactcctgctaatctaacgtgagctttgcatcatcactggaattgtagcggcagtgcaggcagagttttgattcgccttcggctccttgttttcaacgtatttcgccttttctatcggactctactccctccatcaaaaaaaaataaaaaaataaaaagataagtcacgtataaagtattaatcaaaacctgggttttcgtatacaacgtttaaccgtatgtcttatttaaaaaaaattataaaaaaaattaaaaagataagtcacgcataaagtattaattatgttttatcatctaacaacaatgaaaatactaattataaaaaaatttcatataagactgacagttaaacgttggacacggaaaccaaagatttatcttttttagaacggaaggagtatgttctatgaatactactagtactaataatcatgatgtcaaaagagcaaaagagccatgccactgggcagttgccaagtcaaccctcttcgtgcaagcaatatgtaaaaagtcaacctgcatatgttctctccacaaccgtacttgcaaagtactccccccatcaaaagggttagacatattatttttatactgaggattaaggaaaaaaataatctatctttcatataacaaaaattaaatagcatatatacgcatgcaaccaatgaatattaagatgatttctcatgttttgattaaacatttaatttatcttttcatttaaatcttaagtacatggaaactacaaatatggccaacttatttgaaaaaaccaaaatatgaaataagcctattctcatagtaatttatttggaaggagggagcgcaatttgattatgtaaaatgctagcataagtccttttaatgacgcctcccatggaaatctgcttgtcgtattatcagttgcagcaaaagttagacttttaccccgtataacttaaatttaagttgatttctttcatttattttttctgcattggctttctttgcttaaaatataattttgtatataaattatcattattgcgtaggttagctttttcacagctcataaaaccacgatcaaacaatcaaggcttttcttcttcttctcccaactgttttggaggatgagaatggaagagactcggttctcccagagaatttggaggatgatagcgatgtgggcgctagtaaacctaagaatagatcaacgggacatactccctctgtcataatattatatgtcgtttgaatttttttcatattcaaattttattaagtttaactaagttagtagaaaaaatcaataaaatttaaaatatcaaattagcttcattaaatctagcattaaatatattttgataatatttttgctttgttttgaaaatattactatacatttctataaacttgattaaatttaaagaaaaaattaactagaaaaaagttaaacgtcttgtaatataaaacacagagagtaatgagcatggtggataagaggagagtgtcccttgcacagacacttgagcttcaaagagcccgcttcactcgttgatccaaatggtgagctagtaaatttgaaaagtgcgaaatgcccgactcttttaacttataaatcctattgtgatagtagcaaagataaaacgaagatcacagattttggtgcctggtcagaagtccagaacatggaagcttatagatcacctattgccgagggaatatgcttaagtccccttttttttctagaaataaactctcttcctttatcgataaaaaggaggcagcctagcattggcaacgaaaaataaaaatcagcatgcatacatttccagcacacaccagaaagcaatagaaacccgcaagaagtgtgcaatcatggcttgcatttcggcaccactggcccgcccaggacgctgccgtccgctacctgcctgtcgcttcgggaacaagcttgcctaatgcgcataatcctcaccccgagaggcgttaagctcaggtcagccgcggccctcgcggtgcggtggatgtgaacggcagacggcgcgcccgatcgatgggtggcacacgcattcaccggcggtgtggtgggtggtggctggtgggggcgcgtgtgatgatgagccgagcactcgctagctagtgcggcgtcacgtacggttgacccgcgctccaggacgcagccgcgcgtactagtgcgtaaccctctcgtttcgccatccgctccgccttttctgcgcgcctcgatcgggcggtggttggatcgcgtttctgcgtgcgttttggctgactgcgccggtggcggcccgtgcccccgggcttgcgtttgccgagcggtgaaccgagccagagcctcttgtcggccggggcacaccacgcctgacctggtcgatcgatcggtcgatctctccggtcccggtgtctgttggctggctggctgtctggctgctgctgctgctccccttttgctctgctttgcggcgaaggatggacatggacttgcccctgtgggctgtggcctgctgctggtcaagtgcctcgtcgccaacgcgcaacaaacttcaggtcccgagcgagcgtgattacgcaattgattgaatgacggatcaagcgtttgttgggagccagggaaaaatcgtaggacgtcacgcaactctcttttaatttgggacattgtctacaccgtggctcgatcgatcgttgctctcctggagaatgaaaaacacgttttgctcttctgtttttgtttttgtacttccaggacaacatgaaaccgcctactcagaatgatttttttcttgcgacctggtaattgagatcctaagcatggcagcatcgtgggctaattttgcgtgctcaattgctcatggaaccgtgaaagctagcctggttgcatgcacggcaaggctactgatccagcactgtgtgaggccgattgaagcttccgtggagtagaagaatcttctggcgtttgatgtacggagtacttcatctccagggacaggtacggtgatggtcgccattccaccaacctcgaggataaatgcgtctggttacagttgttaagttgatgatgtacgtatgaacgcaatagatgagcaaagtatttcaagcacatgcgtcgctaattgatgcgttcacaacaaaacaagcccttaaatggagaactgtattaggaccatccatgataagtaccacaaatggagttgcacttaaccttcttgctgacgcgccagcgcatggcgatgacccaagcacgatctacgaaactggctgttgagagtatttatgtcatagattctccattttcggtggcagcggtccagttggtttctccgtttctgcaaactatgtagtcttgtactgcaaaatggacggacagttcggtgagacagaatccttacgctgtgcttggtgatttctgcagtactgcaacatttcttcttcttcttcttcttcttcttcttcttcttcttattcttaacggaaagactgcaatatttcttggacgggccggaaaagcttgtgagttgtgatcgatatctgttcttgacgggtcgtgcaaactcatcagggaataccaacttcatggttaactgctctacacgcacatatattcgtcagaaattcagaattttctctagttttgtacaagggcctaactattgcgtagaacacacgagccacttgggccttctgccaaatgggccgttcagccgcacagtaaagctcaagagtggcttttcctaggaaaaagtacaccgaaggtccctcaacttagtcatcggataacaaaatcatcccttaaccgcaaaaacaacagatatataacataccttatcttacaaaaccggctaactctgaatccttaagcggttttgaccccggtttcgtccgacgtagtatctgaatcagcgtgggaccacatgaacccatcctgttagactatccacgtcatcacctctctctttcccctcttttctcacctcctcctctctctcactattcttctcgtttgggcaggggggcgcctggtggggaggaggccggcggggcgaggcaggagaggaggcgcgacagccggcggtggcgacggcgggagcatgggggaaggcgaagggggagcatagggagggccagctgcccgtctactccaacgccaccgtcgcggcgcgcctgtcccggacaaaccgcggcggcgctgtcgtggttgacgatgagcagcgtctccccgatgccgtggatgcgggagaggctgtcgatgacgaggaacggcgcggcgcggggccagagtcgagcgcggtggtgggaggaggaggcggatctcgagccggtcgtcaaggtaggcggcgtaactgtggacaaacgcagagagtcccaggtccgtcaccacgcgctcctcctcaagatcgacgggagagaaggggcgggggcactatgggaggaggtggaggaggggtgcacatggagctcgtcagccgccgctcgccccatcgtcagggtccatggcagcggggaggttgccgccgctgctcctcctcaagatcgtttggagagaagggaaggggccggggacgccgaggaagagggagctagaggaggggagcgaggaatggagcttgtcgccgccgcccatcgtccacgccgtcgtcggggtccgtgggttagcggccgctcgccgctgcccgttgcgccactctggagtgcggacgcgaggatggggaagagacgggagagggggaaagaaaaagaagggatgtttcattgacatatggggcccacgtaggtgctacgctggcttaattgccacgtcagatgaaaccggtgtcaaaactgcctaaacaccccgagtgacccggttttgcggttaatggacaattttgtaatctgatgacaagatgagggacattcaatatactttttcccaattttcctgcgagtcctctttcagagtggccgcgtgggaattctggtttttgggagcagtctggctgaggaataagttcactcaaggtccctaggcagtatatatgggtgattttgttgacgtggcatcatagtcagcaaaaacaattaaaagaatacgtggggtccacatgtcagccgtacatatttttttcttctctgttattcctcttctcttctcttttctctcttctctcttctcttcttcggtgagggaggccggcggcggggagcggtcagcgggtggcgggtggagcggtgggtggtttcgccggcgtcatctcttgctggctcccaatacgtgccgcgacctggagccccgcgcgcgtggcggcggtgctcgagcaggccaccgcgggtgacctgctgaccatcgcgctcgacggcgccggtgagcgcgtccagaacgtcgacaacgtgcgccgcatcatcttcgggcggcgtgaacggccggagccggaagccggaagccgagattacatgacttttatagctaagaacacaaacttcggccacatcgtacgcgcacgcagcacgcgatccacttaatttggcagccactagctagccgcatacacgaagctaactgccacacaactcatgcaacacatgcatgtattgactaactctaactaatcagctaactaagctatgcatgcacaccactaacggttttgtggttaggaggtgctgaccgcgctctactacgaccagctcaagctccagcggcggcaatggctgaggagacgagggcggcgggtgggacgcgtatgggaatggcgtgatgaagtcgtcgtcagtggggtcggcgcggaagcaggcgaaggaggagagctgaagcatgcaggatgctcaaagccgcctcctccggcgagctcaccttcgccgaatcctgcacgccgcacgtcgtctcttcctagaaagaacgaaccagcggtgtggacgtcgtcttgtccacggtggtggcgtgctgccccttgacgacggacaagaggaactccacggcgccgggcgcgccctggacgcaccgccggacgagagcaaggtcggaagaactccacgcacgcgaacgggagcaaggtcgccgcccgcctcactcgccttctccgccattctcctcgccgccccggcgcgctcgtccaccgccggcccgctgccgctccgcccaccggccgccggcctagatccctcactgaagaagaagagaagagagaagagagaaaagaggagaaggataagagaagggaaggaatgtgcagctgacatgtggccctcacgtataattttttttttctgactagtatgccacgtcagtgaaaccacccatatatactgcctagggaccttgagtgaacggttttgtatagtttaggggtagagatttctggttttgtggttaagggatctcaaaaaatctcgttgttaagttgagggatctccggtgaacttattcctctggctgactggctcaatgggccgaatgtgatcgctcgtgcaaaagcaacgaagaagattcgacccgtatatggcccactctacctcagcagtcatcatgggaccacctatacatttgtcgacaaattttcttctaaaaatttgacagatgtaattacagtacaatcgtagtgtaattacactgtaatttgtatgtaattacactgtaacttgcatgtaagtttcacgtaattttaaattattagatctattataaagatttgttttggtgaggaagaaaaaaaaatcacagtacacacatatctgaaaaaaaattgttcccacaacctttattttaccaaaataatatgttatggagagatttttgaaagttacatacaagttatattataagttatattatagttatagtgtaattacatataagttatagtgttaaatttttaagagaaaatttgtcgacaaatatatagcaaaattggtcatcataggttgcccgtttgggcgtccgtcaccgtcgtggccgtcccgttccgagttttgttcacaaattagacgcgagaaaaaaaatcaaggagatgcggtgaagctgttggttggcgagctaactcctggtggcgttacagtatggcggcgtctttggctgattcttgtcccattgctttcgcctgctcaatttcaattctcctaatatttttatgagccggccagagctatcagcagatcgagcgtcgtcgccctcttatgattggatttcatcaccaagtaagtcattgtgataaccatccaatctggatgtttgacatacacatagacactgataacatatatttgaacctgcattcgactgtatacacttgaatcaaacccaataatggcacagtatcaacttgccaagcgtgccaaaaatcacaaccacaatatcgacttgactactccacaggacaaggaaaattgggggtgacataaaatttattctcttgcttgatacatccttacatcagagtaatcaagacaatatgtatagttatataccaaatggtgcaaaaatggaatttctttgatgaggttcctaataactacagtaccttactcagaaccaacaacttaaattggtaagagcggcattctaggcaacattgtgatgattaggaagtttcctctacactgactgtagtctttctacctttcttgccatcaacatataattggtggccatatgacataaatccccaaatggccatcagcatagctataatctttactccatccatcttgtcatgaaagaaaatcacagcaaaaacaggaatgatgggtagagctagggtgcttatcacatttgaaaacagcgatgacaccacaaagatcaatcccaccactccaactgatgctacctgccaagatatagccgtccacagcagtgtcattacatatgacagcttcccagactggaatgcatgcatctctccttgtaaagtcatccattcaccacttgcaaataacccaacaagagaagccaatgttgccacgagagctgtatatatctgcatgttcaacacaactgagaaggtctccctcttaataaccttctcaaatgtgacttgcatcagggagagaatgagcgagtatgtagctgatgcccctagtgtcaacaggaaacccaaaatgtacttcccatgtgatatactagtagttccctgagaatcttcatcaactccaaggagtgaagcagaaaacgtaaggaggactacggaattgaaaatcagaggggtgaatttttgagcattgaggaaatatgagaagacagcattgaaggcaagctgactagcacagatgagcgaatatgttgagaccggaagatatagtaggccataggaatacatcaagtcgtctgcagcaatgatgaggcccaggacaacatatatcagagtaattttggggatagaaattgtaggggcaggactactagtgactgtttgtgtagaagatgtctttgaatggaaaagaaatagggcaatgaacaaaatcggaaagccagcagtttggacgaatgtggacatccacttgctattgccgccttgattgtagtagaacctcccaagaagtgtagatgcggtctgaccggcaatgaggaagaacatgttaactcccaccatcagccaccattgccaactcttgacaggagagttctgtataggtacttcatgagttgacgaagttgcagctttggatgaatctgcaagttacagaaggtaggcagtatcaacaggttagcccaaacttcatgtgttaagcatagcacggccaactgaaactttcttttcctattcaaaatagactaccaaagttcccatagtgaagtgaaaccctcctctcctttttttccccccaacaattggccatataaaccccaaaagctctaaatttattgagagaaagtcgagcaacacaagactatagctccatccttacagtattgtccattggtgaaactatcaaatgaaagcgagttacttggaatctcagggaaatcctgcactaatataaaaaaactaatataaagattttacttttgttaaatgcagtgcattactatagctggtgctatcatcaaccacttatccagctcatgtacgcgaacaacaggggtttgccaattaaactcacatgcctactctgccactcgatgatgtcacgatagtctgaaaagttaatatggtctataaacaaaaaacaaatcccatatgggcatatggccatatccaacacgccacgcacgagaaggcaattcatcgaacacctcgcgggcttacttccccacaccatcgaacaccaaataagcccgagagaacgaacgagttcatttcatctgcgtttaccgccgcccatcgcaagacgactctaacctcctcacccccactccctcaacgaagaaaatcggacatagctaaacagtgaggctttcgacagaggaagggggggaaagatttgattgacctgcgatctgtatctggacctcctcatcccggttgctaccgccgtcgctgttgccgctgtcaccggccatgcccgtcgttgggggcgctgctccgcgcgagcgcgagcgcgatccgaggcaagcggagcggtggagagagagggagttgataggaggagaagatgagaagaggtgtggcgccgcacgggggaagacaagtggggaaataaaaagagtaggaaagggtggggcgctgcagtcgtgtgaaaattgaaaactgcctcctccttctttcgcttcgcgagccgccgaccgatcccttgttttactatcgtcaggggcaaaacgagccgatctcgaccaagcccacataggggtggatatcgagccggctcggctcggtctggcttgctaggataacaagccaagccagctcgttattctaacgagctagaagactggatcagctcggctagcttgagctagctcgttcagctctcgcgagccaatacaacaaaaccaaaaagtttgcaataaaattcagattatcaaaccagcgttcaaatccaagtatgcaactgtatctaagtatcaaagtaatgaggcaacgaatcacagagtcaagtgttcaacaaatgaatcatcagttgaacaaatcacaggaggatgttagtacgttacacctacacggctgcacctcgtcttcctcctccgtgatgcacagggacactcggcatgggttgctcatcgagaggccgacagcgaccagtgagcatcacggcgtgggtagctccgcagttggggaccggccatctggttcctgggcatgaaccggcaagcagcgagcgtcggccactggacgctggacgggcgacggcgaagcaggatggagggagtgcgcaggcggctcaggatggagggagcggcgtgggatgtgcggaggcggcgcagacggctcaggcggcgcacgggcggctgttgccgatgccgaatctggatctatcgagaatgaggggaaggggactgattgaccaagtctactagggttttggacattcctattgcacattttctttgggcctagcacgggatggactgatttttctctttctgggccagcaagttgagttatacttatgggccatgttttgttaatgtctctcctatctagctcattaagctcatgagcagctcgcaagctcgatcgagctagctcgttatacgtggcttggctcttttaaaaaatacaacgagcatagtcgagccaaaccgagcgagcgaggtaacgagtaacgagttttttgtccagccctaagaccacatgcctgagctcgagcttgacacagcatcgagccgagcctagacatttcttttccttttcgggcatgaattggatttaccctaatcgatcagcaccgtgaagcgtgaagcaccaaagctcaaaagtagaatgaaattttaaaatataccctaatcgattttcttcaaagaccatacatttattcgaaccgctttgagccggatgaagtggccatacgaataagccataaatatgctaccgaaggtctattttgttaacaactagtgtaactagtgtttttttttctttttacaaaaataacaagaaatggtgcaccgagtgggttggaggagctagtcctagctatcagaccatccaacaacatgtgaacatgaggaaagtggagtgtaccatggaccactcagaacatattggatattttttattgtagaattaaccggattcataactttagacaggctaaaatactaatttgataggtgacaattattttcatcttttaagttatattttatcattatcaattattgatatgggactaaacctaacatgaagaatcaaagccaacggacaataaaagagcctagatgagaggggctattggcgaacagctcgagcttggctggtcagagctcgcaagcttcagagcaggctcgagcgaatcaaagcatgtaacgaccaagctcgagtagctaacgagcctcaaacgtcttttttccaactttgcagccaagattcgttctgggtggaccaatgattttcaggtagagtgaggatcagcccaactgatgtatagttggcactccaaatttgaccacagaaagcacgcaaaaaaagggaaaaaaaagctaaacgatatttgagaatttcgcaaaacttattttgttcgtaaacgctccaaaattctgattatttgccatcgattatggcacacgttgttatattatttcctgctattttggacacagaaacattatcaaatgacctcagtaccactcggttcatctatagctcagagtatggatggcgtcatgaccctgaggccctgtttctttcagcttagaattattataatccagattattaggagtaagctgaaagaaacaaacaacttattgaagtagcttattataatctggagtccagcttattataatccgataagctcatttaggtgagctttttccagattattgggtgaaaaattacccaccatgccaccccactccctttttagacttgcaaacccaataatctaggctctaataatttagaaaagaaacaactaaccgcttattctactacagattataacaatctagcttatagtaatatgactcaataatatagattataataatcttaagctgaaagaaacagggcctgagtccctgactgagcttacgatgatgatgggatacaaaacaacgctgggcagcacgggctgcaaggggatgctagcccgcttgagtcagcatagcggatgaatccaatagcttgcaccggcgctgcagcaggggtaactaagggcctgtttgtcatagctccagctccaccccttctggagctagagctcagccaaacagtttcagctccatcaaaactaggagtggagctgggtggagctctctcacaaaatgaaagttgtagagctgggtttagacagctccacaactccactccagacctaactcctagagttaaatttaggagttggagttgtaccaaacaggccctaaagaacacaaccttaagaggggatcgcagcaaagacgtaatgtgggcatcccaagtaatatatcgtccagtgtgtccaacatgaccaacacacgtagatccaaatacatgtgttagtcacgataagcactggacaatatattacgtgtggtgcccacagcagttggtatcatagcaatgctaattgtaagctaaagcttggcttgacgatttgaaaatagtttgaaaaaaaaatcaacttaagctatttgtgaaaacccttagaatgtatgatcctttttacttctcacatctttctaataattttctcaccttactcccaatttaatttgctcccattgacacgtgctaatggtaatgcatgacaaaaatactcgggctgcccacgcataagcttttattggtgaggctcaccggtcgccacctcgaatttaccctgttaggatgatagcagtgtagataccgcacttgccgagtattggttgttggttagtcctaagcccctgaaaggatacatgctccacagtgtagttctcctctcacttttcatctcccctctctcttctctctacctttccccactggcggatgaagttgagacactgagcggagcaaaggcagtgcggcccaagtgaagcagcagtggcaccgagtggagtgggagaagacatgggcgatggcgttgtcgagcttgcaagattctgccttgggcggtggcggtggcagttagtcgagccgtggtgcgaggacggcagctgctcgatgatttgttcacatggggtgacagatgacgtgttgaactatgtggcttagatgaagtgatagacgtagcgaacatggataagttttgaactactcccttcgtctctaaatatagggattttggacttttggttggatgtgacatatcataatataacgaatctggaagaaaaaatcccttatatttaaagacggaggaattatatagtaaaaagaaagagccaagtttttttttgctttaacggtgtcccctagccaacaccaaaatttttgaaagtatctatgaacaaattttgctaagaaagtacttcatacatgtacaatcattagctgtgccgcacaatagtacgtaatggaacatcgatcgtatgctatccacccgggaagtgctccgacacgagtggactactctagtgtagttccatcgcgtacgaagcatcagcgtcatcctagggccttttttggattgtgttgctgtagcaaagagatcacgatcgagttaggacacacatcgaatggaatgggatgctgagaaccggacaccgatccgccggaaacgacgcccgtccatggtcgagattttcgtcgatctgcctggctggctgcattgggttctccggtgtcccgaccacgtaacacgttcctcgctgcgctacgcactctcgatttgggcttttctctccctgaacaaaacaatccagtaatataagcccatttggacttgtgttcataattagaataagttcatctgagatcccttaacttgtcaatgaatctgattttcgtccttcaaccgtaaaacaacatacaatccatccctcaactatcaaaaaccagtgcagatgagatccctcgacggtttggatggcggttttggctgacgtggtgcctacgtggctaatttgactcggtctccatctgatgtggcattgacgtggcgcttacggggcaataaacctcgtgggacccacctgtcagtttaacacacattagtttaataaatgtggggcccacgcgggatgtcattcttacccctcctctctccccctctcctctgcgccacgccgccatgctcctcctcggcggctccgccgtcgtcaacggcctcaccggagtagacatctaagccgccagcttcctcatcccgctcggcgtcgtcgtctacacactcgccagcccgcgtgtggtgtatgaccgcctcatggccgtcgccagctagcgccgctcgcgactgctccgccgacctctcgcgcaacggccaggcgtgtggccccgtcgccggcaacttcaagggctcctacctcgccatgctcagctcggggggactcgtcttcggcatcatcaacatcgtcggcaacttcggaacggtcttcgtcgacaacgtacgtacctagctaggagtattaattatcttcgtctgctgattaattaatttgcagggctactagatgcctccggcaaggggctgcaggaa

SEQ ID NO: 56234 - DNA, 4072 bp, Oryza sativa
cctgcagccctgctcccctctcccctctcttcatctctctcccctctcctctccccatctcccctctcttcacctcccgccggcggagcttgcatgagcagcagcagcagtcgtaggagcaagacgggatcctcaagtacatgctcaagatgatggaggtgtgcaacgcgcaggggttcgtgtacggcatcatcccggagaagggcaagccggtgagcagcgcctccgaccacctccgctcctggtggaaggagaaggtccgcttcgaccgcaacggcccggccgccatcgtcaagtaccaggctgacaatttgttggcgacaatgccgtgccggggtgcgacggcaacgtcggcggcgccgcgccggcagggccgcacttcctgcacgagctgcaggacaccacgctgggttcgttgctctcggcgctcatgcagcactgcgacccgccgcagcgccgctttctgcttgagaagggcgtgccgccgccgtggtggccggaggggacaggcgtggtggcccgaatccgtcgtgccctcaccatcgcggcccccgcccccgtttccaccgtcctccacgccgccctccgacctcgacggcatcctcgccatgggcggcgacggcatcctctcccgtcggcgccggcgcgcgccgctccctctccgtcacgcctgagagagagagaggagagacaggaagagaggggagatagggaaagaggaggaagaagaggatgggtgagaatgacacctggggcccacatgggccccaccatttttattaatttatgtgtgaaactgacatgtgggtcccacgaggtttattgtttttcttagatcaaattgccacgtaaacgccacgtcagtgtcacatcaaatggagaccgagtcagattagccacgtaggcgtcacgtcagctaaaaccgctgaggaaccttatctgcactggttttgacagttgagggacttgttgtatctgatttttcggttggaggacgaaaatcggattcgttgacaagttaagagacttcagatgaacttattccttcataattccacgtctctcggaagaagaatgttaggcctgcttcattcgtgcaaacggcagacaccgatcgcaaacggcagaacgtgtacgtcctgaggacgggccggcccagatgtaggaaaagattttttttgaaaataaaaaggagaaaagattagagcgcacacagacacactgagacgagtatcctcaggttcatcagaattttcagattagttggaattgcctttcatttgggggtttgcgttttcataaaactgctaattacgggctctctttgcactctgcaatgctgcaagcctgtcgatccctcaccttctctgagccccctctaagcttatggtcccctgtcccaaatctttttttttcgaggggacagacagggagctcctgcaattcactatagaagaagagagttgatccagtttataagggaaaccggacccaaaaaccttacaacaacacggttaattaaaggaaaaccagcaaaaaccccgacattgacaaaccgaacctaagtacagccgtccaacaagagataaactcctaaaacgaagcctttaagaaggttacgccgacaacgacgacatcgtccgatcctaacgaatctaggttttcacccggagaaaactcttgaagtggagttgaacgagggctccagtagcaacgccttcaagaaggtgaacggcgtccaagggtgtcgccgttgctagcaccgagagcggagcaagactttcgccttggagcacccatcaaccatagcatccacgacaggagccaccaaatgtcacctgcacaccgaggatacctgcgatattcacaccacctgcacgacgaccggactccaaccaccccgttcccacccgaggacgcgccggatctgggcaaggagccagatccggctgtcttcctctccaccaacgccggccgacgcctagaggggcgccggaggacgccagtggcagccgcggggtgcctgcgtgctctggccaccaccggccgccgccggatccgggtgcgccaccgccggatccgcggcctccaccattgccaccccaacgccgtcaccatccccgccgccatcacccacaacaccaccccgcgcaactcacctcgaccgccaccggcgcccgtccccgccgccagcccatcccgtcagatccggccggaacggcgcggatctggcggacaccgccgtcgccactccgggcggctccccaggccgcccgagcgcgaggagacgaggagcgccccgccgccgccgtccttgtggctgcgcggcttcgccggcggccgctcgggcgacggcgaggcggagaagggggtgggggtgggggagaggggcggccgggtcgttgcctcctgagccgcccctgggagagcgacgcgtgagggtttttctctgattatctccccctgccccaaatctaaccaatgagctaggctctaatctgggtattatatagtgctgccacctcagttacgttcgacgcacccaaacaataagacgatagacgatgccatcaagagcatgaatcgtgcaagatgcggtaagaaagctggcttagatctttcagtttctggctaccggtgaacgtcaagacatgaatccatgatcaatggcactattactctcattggcttctgatgcatatatctttcttgagatcaacatctagcgctgctctgctcaattaccgaatggcctttacgtggtactacttaaaactccaaataatccagaacgatacacaaatcataatttcgcagcagatcaatatatatctgtatatttaccagtacaattttgtagcaatatatgccaacaagccacatagaaaagaagggagcgaaggcgaaaggcaaaagtgctgttcagaaggcagcacgccttgcttccactcaacgctcccacttccagaaaacagctagcacccacgttcaaagacataccacgtacggagtataaaaaaagcgcgagatgagattccaagctggctactcgcccactaaaccacgttgcatgcgtaacatgcaaggcactggacaaaatccttccaagtaaagcataaaaaatttaacatatcatcgaaaaatcttttattatagctgaatgtagtccacgatgctaaatttctaattatgcgcgaatcacgatgattaatagacagtatcaatccatggttgccggtgtcgatggcggcggcgagagggacgcagcgacggcgagggcgatggtcgccagcttcgcgaactcggcgtcctccggggccagcggcgacgcgtcgtcggcctcgccgaacgcgtcctcgcacgtccctggcgcgtccagcgccgcgctgagctgcgtcaccgcgtcctgggtggcctcgtccccgcccctggcgatgtcctcggcggtctccccgagctggtccacggcgtccgagtacacctccgcgcacacgccgaggcggtccttcctcctcgcgtccttctccgcggctctcagcgcggcgatgcgcgcggacgtggcgttggcggccttctccgcgatcctggccgcgatggcggcgaggccgcgcgcgtcggccgcggtggcgctggcgctgtcggcctggaaggccttgatgcagtcgttgtaggtgacgtacttgtggccggcggcgacggacttgcatgtgtcctgcaacacggaggactcgcaggtagacaatccgagcatgaggaggagcaccgggacgagcagacgcctcatggtcgctgggattgggtcgacggccggcgatggtgagcttgcgtaggttgggagcttgggattgtgttgtggcggcggcgtacgttctcgcggcttgtcgcgtagacgtcgactgcgtgtagacggtttcgatcagaagctagcgtgcgagacctgggcattttaatacgcgggcaagatttgataataccataatagttgtcttaataatttataagtttgctaaaataaaataatgttgtaccagaccctacttgtcatcgtcaagacattatggtattttgagaa

SEQ ID NO: 56235 - DNA, 2052 bp, Oryza sativa
tttgctatatctcactcgaaagattttttcttatctctcactcgattttctcactcaaatttacagtgcattttcttgtaagttacagtgtaatttatgaaacttacactgtaacttttgtaagttacactgtaatttttgaatcttcacatgtaaattttaaattttatatttgatttggtctttttcttgaggatatggtaatttaatgttcattatggtgtttcttaattgttttttgctttttattatatctatcagattttaatacaaagattaaaaatctgtatgatacgattataaaaatctttcgaaagatgtataggtactcccgaattgcagatgatttgggccatccaaccggtgctggctgctgaagcccaactcaattacgcaaaggcgacatccatgacgacttggcgtagaaggcccaatcgccaggccgcggctccggttacagccgtgacgacgaagcggtggctgtgcgcagatcggagttgcggcagcggcggcggcgatggcgatccggaacttctggtcgatggccgcggcggccgtcgggttccggctcgttctcgtgctcttcggcggggacctccacctcgcctcccgccccgaggtctccacccccctcacctccatccgccgccgtaagcgctcccttgctcccctgcctcctcgtcccagacttgagctgtgctgtgttgtcgccgtaattggactaatagcttgttttcctgtgtgttttgcagtggcggaagggtactggctgaagcaggcttccatgtcgccctactccggttcgttccacacatcttaatcttgcttgattacttttttttgggggggacaactgaagtcgtgaattgttgagctcagtatagggatggaattactagctacatgagagcacttttaaaagtaaagtaaattgattgggtgctacttcttctagtaagctccattaagcatgaactgctgcaagcccgcactaatggggtgtgttaaaaaaaataagcgcaaaattgccataccttttacttagcaaataattgtgcaggtatttgtcattgttataggtttatccatgatgttttagtagggtctctttgcaatgtgtttttcttgtagcatgaactggaagtgattattcagcacggtgaatgttttgtctttcaggttcaatgtatcatggttcccctttgcttctattggttcttggtccattgactaacaaaaggtgatcaattccttgtctatgatgcttctctgatcgcaattggttgcactactgcagctatatgctttgacaggattggtttattttatcacaatatcagatcaatgtttgaaatactcacatccttgtatttcatggtattacaggtctgttggacatcatgatcatatatattgcaggtaaataagttgttatgtaattttttccattacacctaggatctgtgtctctattctctaacagtattagccacttgatttccatggatgaaaaggattttctatgatgattttttaaattatgttcttattatttttatgttaccatgtaatgattcagaccaaataaaaaaaatgaagcctccaatgtactccattatctttttgaactatgttggagatcttgtaatttatattacactcatgaatgcaagacagtttgatttttgtggccgtagattttatagctgccatgcttatccgagcaactggtcgtagactccaaatagcacgcaacagaaacttgaagtcacttgagctcacagaggcagtgagtaattcaggtgagcactatagttgaggacctacagttttgtgtccctcctgcagaatatgctttattggatactgacctagttgttcttagtttgttgacactagttatctacttgtttttaccaatggagtagcatacagagcttcttgcagaattatattatcaaagcttcaaatatttcattgactcattgaattgtcattctttattgtagagccaatctagtctttcataatagagatgcacggaattgctat

SEQ ID NO: 56236 - DNA, 711 bp, Oryza sativa
tcctgcagcccccaggtgtcattcctaaggtcatgtgcgatgtggtcgggacctatagagtttacggagagtgctacaaatcgaaagtctgatattttttaaaatatcggacggtgttgcagcgcatacggagaaatgtttcactgaccaataaaaattgtttcaagaggaatgtttcagtgccgcagagaaatgtgtcattgacaataaaaaattgttttaatataaatgtttcagttgtttgtattttggagagaaatgtttcatcagtcttgagaaaatattttatcaccgggttaaaaagttgtaactagatgcaacacttgaaaactactacctgcaacataaagacaacaatatgtgcaacatcgattaaaaacacaatgaaacatcattccacgacaagatgcaacaaaaagcaaataatgggacgactcgatcaggcggtgggtgaatgcaacagttgaaaactactgattgcaacaaaaagacaataatatatgcaacatccaataaaaatacaatgaaacatcatttcacgacaaaggtgcaacgaaaacaaataatgagacgactcgacgaggcggtgggcagcgatggagccgtcggcatggccggtgaagaggaagaagaggtgtggcgcggagagaggtacacaagcagggcagtgatcggcggctcgttgcacaccctaggctccagctcgagcag

SEQ ID NO: 56237 - DNA, 988 bp, Oryza sativa
aaccgatctatacaaaatgttttagcgcgcgagattagttgcccatgatgtctctcgtacatgcactccactagttccaccgctatgtacagtgcgtgcttcatgtagaagttgatgatggaatttaatttgtcaacgaattctcgcagaaaacctttactacagtactctctactactccttagctagtagtaacagtggaagttggtgcaacggctgcatgtactggcacggtcacactgcacgcacggggccacgaggatttaacggcgccctggcattaaccggctcgccgcctgcacggacgtcattcgacccaatctcccgacagctagcttttacagcaaaacgaagcacaatattacgccacaatgtcaagaacggcaaatccgatcgggttgggtcctcatggcgttgtgcgaatcaaggagcaccggacgcgcgcgcagagctagctactctctccgtcctaaaataagtgcagttttagcactgttcacatctaatgtttaaccgtttatcttatttaaaaaaataatatgattaatatttttattattattatatgataaaacatgaatagtattttatgtgtgattattttttaaaattttttttgaatgagacggatggtcaaaacgctaaacatgaatatctatggctgtatttattttgggacggagtaagtacaagcgagacgaccatcgcattcagggccgaggaggtcacgaggagtcatcaggagagtagtgtggtgtggtgtggtggtagcggtatggaggaggcaggctgcttgcacgtactgaaacactcgtgcgatgcgtggtaagtggtggggtggagcacactgcacatccacaaatataaggaggaatacaatataataggtcttaacccgcctcttttacataacaactgtctttaaatatatggtgcaaatcacaacctagataaaaacttatgtaaccccaagtgaaaggacgtttaa

SEQ ID NO: 56238 - DNA, 9806 bp, Oryza sativa
ttacagtcctggtcatgctggtgctcccattaggtcatctgtttttatgcatactccccaacaatttgctatgccttcacggccaggagtcacatatgtacatccacaggaacccatgcgtccatttgcacaggtttgtatccgtactttagatccttgtcgcttttctcattgttcaagttgaattgatgtactacaagaaatatcattgtagaggtgcgtgaagttattgatagttcaattgttcatttgacataggatttactacctctgtcccaataagacttcacttttatacacgaacctagacaagtttgcctgtcctgagttgtgtctaaaagtgaactcttttttggagggaaggtagtagttttttcaaggtacatttttgtgacatgagacttttattatgtttatacacatgtattattgcacatacaacatctattctgatatttcttcgatgcaatttatagattatgcattaacactcagctgatgtgttcctttttcacttgtgcagactcaccaacaacaacctgaagctagtttgcgcttagcccggccccgatgaggggcctgggcatgcctgcaccctgtcagcgtgccctgaatgtgtaaatcggatgtcatacccgattcatttcttgctggtagatggtagcaggcataaaagaaccgagaactacatatctgagctaaacaatccacttgatcttgttagcttgtggttcttggtgttgttgcaccctgcacattcaggtgcaggagaggcaccttcttcgtcctggaagtaaattgcagactgttgcatacgggacctcaagtccaatgcatagaagctgagaaatgaaggggagagcagtcatggctggcatgatcggtgctgttctgctgctgttccttgcagttcagttttgagattcaggaggggcacattgcccccttgaagtcaagcactcagcgcgggtgatgagaagagaatcggcacaacatctaatatgtggatatttattcaggacgtggttagttcaattcttgctgctatttgttttgcttattagcatctttctcgctgaaagtttttctcgactatttgcagctgcttggtccttgtcgcttgctgaagcttcgccttcgccttccacctgaagtggcgtcagattgactggaccgaagatgcagcgctgtagtccccacagtgaacctaagcccctcgctgaggcttaatcagtgtctgttatagatcattgtagttgtagttgagtaaccccaactttgtaactccactctagtaagttaaaacaatgtactaagctcgattgccaattgtactagtagcactatatgtattgtcgtatggactgggatgtcgcagttactgcttgtacagtggagctgcgtaactttaacccattactacagctttatgccgccgattttattaggtccctttgtgttctgtattgaaatgatgccatccttcctgcctgctactcacaccctctccatgtttgttctggtcatagggaggcagccagcagagacgaacaagcagaagagtcaaagccaaagcaacaaaaggaagggaaagggaaggagatggaagggatgcgatgccgtcatgatagctagcgaatctcgtggtggccgggcctaaccttttgccatcattttccttccacggcctacagaatccagcatatctgctgctctcatgatgctcttgcactgcctctgccttgcattaataggctcgctccgagggctggatcaagtgaaatgatgaccattcgagctgctcacgttacctatgtcaattctgcactgctgctccttccttttgcttctataaataccttaccttgtgctgttgctgcttcaatcttcagttcttcactagcaggagctggagctagagctgcatccattccgctcacatcgcagcctcgcaaggaggaaggaggtggtttcttgacttgatgtaagatgccctctgctttcctttgttttctctatctcaatatatatatatgctctttgttacataattctccctatcttatgaactgcttgtatatatgttgcgatggatttagtaagatcgagtgaggagggaggagatggagaaggtgaactcggagcttgtgctgcagaactgctacatcatggagcagaaccagaggctgaagaaagcggcagagctgctacacaaggagaggcagaggcttctctccgagctcaaggcccagctcctctccaaccagcaccgccaacctcccgctaatggacatggacatggagacgacgacaagcccgccgccggtggctgtggctcttccaactagtgtcattagcctttataataaaacatatattccgcatgtgttttcctttgcgaggtactccagtacatgtcctgttaactgggtaggagtaatatggttagtgcatcatcacaagcaaatgaaccaagagctctcctaacgcttactactcttgagacggctctatgtgttagcagtacaatgttttggcattttggcgcctgtttatctaacgggtaacgaccagtctgtgtgctgcactgtttgttgcctatgtggaggtgtgaaactgccctcagtttattcatgttctgctggaaattcccaattctttgtatgcaatttgtttgtgttccatttttctttcttttagaaaaaaaccgagcattgtgggcctgatctgtaggtggagagcccatccaggcccagcccagtagactggattggcctgaagaagccatgggcgtaagctaagcttgcccaagccactcgccgatgtcgctcgcccctcctccgcaactccgcgctttccgccgcgatggcgacgcccccctcttcttcgccgccggcgagtcctctcgcgctacatctcgatctcgatgcgggaggaatctagtctccgtctcctacggtggcttcgcccgcgcgtgctgcctcttctccgccgccggcagccgcagccgcagcaagcaggttcgtgcacaacatctccaatcccccccccccccctctgattgattgactgattaccttgccagttgaacctattagctactatcttgcttgcgccgaaatcatacgatggtgttgaagaaggagaatcatagaactgactagccatccctgcctggattggatttgggcgagggattaacttggccaaaccccttatctagcttggaaaattaactagtgggcttatgtgatactccgcatgtgttgattttttttcatggggagcattacatccaggatggtgattgttgatgtgataatctattaatcttattatatgaacatttaccccgcaaaaacaaaaaaaatctcatgtgaacatttacaattagaatggtgattgttgatgtagtaatcttatatggtatgatgacgataatatcgtgctaaaccaccaatccgattgctgtcgaactgtatagagtcataggattcagtggttctcttaatttggcatgtgatgataggcatgcattactgcaataatgccattccacataggattatctgctgttggtttgtgtgagaatccaaaattactcttgattcttcaaagttgataggccaacagaatatcacaataacaaaccacaacattttttcctctcaggatgaagctaggaaagcagtggaaaatgccctggggtggaagaagacggggcttccaaaattgggtatgcgaattgaaagaaggcagcaaagactgcctccttcagccggtggtggaggatggtctggaggaggtggttggttcaggtggttcagcagtggaggtttctgggatgctgcaaaacaaactcttcttacgatcgtcggtattatcgccgcggtaaagacaattaatatcctgcactttttgtatgaatgagttgtcaacctagatgtatttctaactgctgtgcaatttctttgcagtttttcctgattgcaaacttcaatgtgctggtagcagctattgtaaattcactgctggctgtgctgcggcaaattcggcgtgcactgtcattcgtagctcagtgtattcttcagggcgtacaatcctcggctccgaggcgatcatccccttctctagacactggcaatcaggccgctgtggttgtgaaagatagagttggaaagtcagcgaaagagagagttgtaaggaaatgggggaatggcgtataacacagatctaccctgtcttatgagccgcataatttttgttcttgctgtgttgagcgctttgcgaccaccataacttgttctatgatcttgtttgagaagaaaaaacgataaaaagaaagttatgatgtgcctctgcccaaatttcattgtagtttctccgctgttgtctaggagagaatgtcttgggggttacaagtacgtacgcagcgaacaactcttcatccgcaattccattccgatccgatttcaagccatagttaccaatgaggtgaggtgaggccctcaaaatagttttcgacccagcaacttgttcatggttggtattttcttaatttccttttgatggggccagtgtaagtatatgttgttaactttatttgatttttctttaccagatccggtatgagaagcttaggattgaacacagtagagcatcagaggggtggtcggagtttaaatctccgacctccttggctgctctaagaaaaccattccaatttccaagcgctatgctgttgttggacaagccatatattaactctcgtctccatccatggctttgtccagccatcgtttctccatgttaacaccaccatggcgataatgctggctgctgggatggaagctggcaccatcaccagatgcaggccaggtctgatacaggcaaccaaacaagccctttgtgtatcaaagccaaagtggtgcattttcaggcttatattgtcctgaaaacaccgcttcaacggtgtctgccccttttgaatggtttaaacaggaatttgtcaactgatgaagccgccaagtgccttaactatgatcgacagaaggagctaacacagatgaattatgcagcatctgatcaagtctacaaatatttttcactgcaaactgacatatggaaacaagcaccacacagcgtttacaccgcaaaggggcgtaatgctagcgtatttcagattcagcatagaactgcccggtttccagaaatgttaatcctcatcagtcttgccatgatcagctgcatcgttttgttcttgtggcagtgactccttatctattttccttctcttttcagctttcttttgggttgtttctgatctccgggcggcatttttgttcctaaattctgaaagaggcatggcacaaatgggggaaaaaagcttgtgtaaggtggatagatagacacaattaaaggttctgatagacgaacaaatcatctctaaatcagaaaggatcaaacagaatgctgtgagaccccaagaaaattgaagtgattgcagttacgtacatatagtaactaatggaattgctcagttgtacgaatattaaagttcagtaacctatattattgtaaacactcagatctttaaggcaaaggactaaaataactaagtatttcactgagtagaaacatgtggcacttcatcctacatttgacatttgtaataccaaacactgaatggaagtagacaatattgaccttgcaaagaagtattaaggggctctacaaactcagggaactccatttcatcgagtgccttgaggacatcatcagcgttgatcgtctgcctctttgattctttgcacatgtcattggcactgcaaacaatttctataagtaaaggcgctgcaaataaaatcatcacgaatacttacaaagaggtatggtactgcagtttgattctaatagatctacacaaaaagtcttcttttttaaaaaaagaaaatgttcacgaagggaagaaaaatgattcttatgagtttgcctgtaccctcaagtacattactagagttaagaaagtttatgaacaaatgcagatcgtggatcacctgcaccatcaaatgtcaataatttttttcccgaagtaatgtcaagcaattctggccatgagcataaattcacttagctttacccagcgaaataaataaattcactaatagctttctcccccaaacccctagagattaaacagaaacatgaaatccatgaccaaaaacgtgaaagttatactatatcagtatgagtatctatattcatagtccatatccatagatagaaggaagaataaggcgaaggggggatggggtacggacgtggcggagaggtagtggatgaagatgcgggcgctctcggcgaaggcggacatggcgtccttgttgacgatgacctcggcccctccggcggcgacctgggcgagcttctccttcactaggcgccgcacgatggccttgggcagctcctccacctccgcctccgccatggacgccgccgccgccgcttggcccggctgcttctcaggttgggaatgggatcccccaccttcccccgtctccccagccatctccctctctctctctttctcaggttgggaacggtggtgcagcggcgattcgacaaggcaaaccctagcctagtgaaaaattgacgagtcgcgcgcgctttgtctcttcttcccccctcccttcccgcgctttgcttctgcttgagttcgcactaccaaaacaagcaactgtccattccattttcatttcgagcactaaagaatttcagttccatttttcactctaaaaacacactccaacaaatctaaatctaaaccacaattgtgaaagcaagatggtgtctacttccggttccgggtcgagattatgcacacatcactttgaccagtcaccaggactacatgtacagttgagtcggggacacagaaaaagggagaggaatcagatgggccaggaaagaggagagggccatgaacacaaagcccatgtcagaccaattcctattttttaaaaaaaattagacaaaacatggggtgttgcgagaatcgaactcgcgacctctcgcacccgaagcgagaatcataccactagaccaaacacccgattcgaacttttgtctctggaacatttaactgacccaagcattttacaaacagtaagaacagctactacgaagaacaaaatgtgtttccccttccacaggtagtaagaggtaactagtcaacttggaagtaactcagatggattcgcggtcaaaaagtgggtgagtgttactgatgccagcaacgggccggtttcagcccacgcaaatgtttaaagcaaaagcaaagcccggcccaccataaaccctagctctctttctagcatggacaggaggacaggacccgattcctcctccctcgccggcatataagtagccgcagccgccgcctccatttcccgaccttgctccacacccgcagcagcagcagcagcaaggagaagaagaagagccaagatgcagatcttcgtgaagaccctaacggggaagaccatcacgctcgaggtcgagagcagcgacaccatcgacaatgtcaaggccaagatccaggacaaggaaggtacgcttgcttagcatttagcaatgcttcttcttcttcttcttgctcggtctcttttgcctgcttgattgcgaatcgatctgctccgcggggcctcaggcatccctccggaccagcagcgcctcatcttcgccggcaagcagctggaggatggccgcaccctggccgactacaacatccagaaggagtccacgctccacctcgtcctccgcctccgcggtggcatcatcgagccctccctccaggccctcgcccgcaagtacaatcaggacaagatgatctgccgcaagtacgctccttctaatttccttctccttgaatgctcgacttttgattatgcatactcctttatatgttcctatagtttattatgcttatgatatgatgcttgccttgtgagggttggatctgtggtttgtaactctatgacgcgtggcattgggttccccatgggtccagagattgacaacccacctatactttgtctgctgcctagcctatttcggtagttgattttcactggtgggacatgttaaatcattcgttgtcataccacatggaactgcgtagaagattggcaggaatgatgaatcaattagatgtgcgaagtctccttgtgagcttaacttttgaggcatacattctgtctgacctgccaatcagctcatctatgtttcaaagcaagttgcttttttttgtcatttgtttgtgagctttaccatatgttttgggaagataaaaacactacttttcgacttgaaatttcaagtgagctaacctatcgaggcacatttttcattttaaccatcttctaggatgtattattttattcaattaatataccctgtgttatcttattgctaggtatgagtgactcactgactcttagtttgtgaagttctatcatcaagtattttgttgctgtgtccagcagtgccatgtagtatgtatgtggaaattagcagattggctgggatgatgaatcaattagatgtgtgaactcaccttatgatctaaaacttttgaggcataattactttctgacctgccaatctagtaacattcaaaacattttttcactgtgtttggctctgatgcttggactggcatgccttgccagaaagttagtgtcatttgctaatgttatgccagtagtaccatcatgtattataggcacagtagtgctgcatctgttttcctgatattgctcccttttagggtagactgagttcagcatgtgaatacatttcgactgttttcttgcaggtgctatgctcggctgcaccccagggctgtcaactgccgcaagaagaagtgcggccacagcaaccaggtgattatcattgttctatacaagcaagtgatttagatttgctgtttacttggcaccaatgttctttagtaataggagcaacagctaagggcaccattagattttagaatttgtattgacccttgcaatttagagcggtgcaagtctgctgctctaattatgtttgaagtagtgtagtgtgttgagcatattaggtttacatcagccttagatttgtgattttttttaatactgttgtgagaaattgcacttgaaatgtcaaccaagtttagtatagcttgttgacaagtattctatatcctcgccgaaatgcgtcttatctactgtagcatctaacgtgctttcaaattcctaccctttcagctgaggcccaagaagaagatcaagaactagagtttgagatatcatttccgcggatcattgaaatcaacaggaagatcagagtttaagtttttttgtagtgtaatgcctcatgttgtatgccgaactttctgtttatcctgttgtatgttaaccttggttacgctggagagtactccagcttattttgatgacataattgactacaaagtcaaggttatatggcccggccttaatttttgtccccttcgaagtttgcccctcattgttgtttgtggttgctaccatgctgtgatctgaattcaaattgtaagtttataaccgggccatctcagttactacgtgtgattcgtgtgttgtcaagtggtgattggctacacagctcttgtggtacaggctgcagattggaacgcctctgtcgttttgtttgatgaatttcaaggcagacaaattccttcgttatgtgagtgtctactactcatgtcctggaaagttgaaatagac

SEQ ID NO: 56239 - DNA, 3023 bp, Oryza sativa
aattaaggcatgattcggatttcagaaaacatgccaaattaaaacattcatttcattttatttgcaaccaacagatcgaaggtgacgatggtttgatgaaaacacacaacagccatgagctccaggttcaggttcgctcacaactcactagaagtaaaagtagtaggaggctgcgaagcaaagcagcagggtgatggcccagcgcgacggcagcaaagccgcggcggcggaggaggaggaccccggcgagggcctcggcgaaggcggcgcctggtcttgcttgagctggtcgacggtggcctggtcggtgtgcatggacttgtcgaggatggtgtcgtcgatgccgctgccgaagagcgcggcggggagggagatggtgccgggggtggcgctgccgaaggcggagaaggcgcgggcgacgacgtcggtgccattgttgaactggaagtgcaccatgcccttggggaacacgaacatgtcgccggtctgcagcgtctgcgtgtacacggtgccgttgcgggcggcgtcgacgagccccaccagcagcgggccctgcacgaccaccagcagctccgacgccctggggtggatgtgcggcgggttgacggtgccggcgccgaagacgagggcggcgtaggacacggactggccaagcagcgccgggaactcggcgtgagtggccttggtgacggtgagcttggccgggtcgccggagttgccggtgacgaggttcttgtaggtgaagaaggcgccgtcgatcccggatgggtcggtgtcgctgggcacgacgaagtcggtgaggatgtccgggtcggcggcgccggcggagaggatcacggccagcaggagcagcacgccgaggctgacgctgctgcggctactcatcatcatcgtcgtatcttagctctgttagttagtgtgcgatggatcgatcgaggtggaggcagccgcaaattgatgaacgagcgagacgtacggtggtatttatgtgcgtagaatcgccggctcggcttaggaaaagctgtcaccatgctgcatggcttgtcatgtatgtaaacagcttcatcgttgctcttcatcagcttattaattagccacaatcaacaaagttaaattttaatttttaattttgaagataatttcaatattttttatactttattttttcaacattaacttttaaatcactaggaacacacatgcataaagtttttattttttttatcacaaataaacgttaaggtttacgcgaaaagatcagactgtaaagttgattccttcgtttcctaggtcgtttcacaaataaattaattactacattcatatatgagagcatatgcatacgtgcgtgcgtacgtcgtcattcggaacagagctaacagtccagacccccagtgtacaaacattgttgaaatactaattactggaccagtttgatcaagctgccatgtgtagtatattagccggcgccttgtgccgccatatatttgctcgctttggaaacaactacaacatttggtcttaattgctgtctgattagctttcctgctgtatagaatatgcatttgcatttgtgtactatacataaaacaatcgatcgagtttccaaggcatttgggtttagtggtcttattaattctcttgtgtgcactacaccttagccttttccattagcatattgcaccatgcaagaagaatgatcatccatcggtttccaaacgcaaataattaaattattagaggtaattaagcagctaccaagtgcatggctgtgtatatccattgagatatagacgccggattttaatctattttcaaaaaaaaaaagtgcatgtgcgcaacaactactaggtagtcattcttttcttaaaaaaaatcacaaaacaacaaatactatcacacaactatatatatatatttatttaacatcaaattaatttatcatgaaactatagatttaagatagagaatcacaaaaatatattatatgatgaagttatcgtagaactagcgccaacttaatcacatcactacaacgttaagaactccaacaggacatcgttgttagggatttaaactatacaatctgtagtttgagatgaatgtatttaaatgaaagttcgtggcgacagttgaaagttttgtatgatttatatatgttgaaagtcacatggttttaagtggaaagtttcgtaggaaagtgatactaaaagaaaaaagtgtgcgctagctggtcatgcctacttgaaacaagaatagaacaatcgccgactcaaaaaagaaagggaaaaacagaaattcaattttgacatatctcaatcgaattaagttttcaatgatcacaactcaagtcaaaacatacataaatatatactagcacactcgactcgaggtcgaggattattcccacgtacggccacactacagcttgcagcattttcatctgtcacgcttttgcgttgcactgcatgtctgcattgcttggtgttattcaactagtaacagccaacaggacgacatacgacaatggcgagagaaggaagagtagctaattaggacttgttgggcggagtcaggttcgccttgagcttcaggatcgtgggcacgtcggtcttgaacgatttggcgagcacggcgtcgtcgatgccggtgccgaacactgtgaccggcaccggcacgacccccggggcggcgctgccgaacgccgagagcgccatggccggctggttcccggagttgaattggaagtgcaccatccccttggggaagacgaacatgtcgccggcggccaggtcctgggtgtagagcttgttggtcgtgtcgatgaagccgacggagagcgcgccgtcgacgacgagcaggagctcggcggagcgcgggtgggtgtgcggcgggttgacggtgctcggggggaagacgagcgtggcgtaggagacgctctggccgttgagcgccgggaactcggccatggtggccttggtcacggtgaagctgttcggttccggcgcgctgctcgtgttgaa

SEQ ID NO: 56240 - DNA, 1978 bp, Oryza sativa
agcacatggtcatgatgcagtttttgtttccaccatctgtttgttaggtaacattttgcgattatagagaaaggcatccattttacagtcatatatgcacagccatttaactgggcattggtcataaaccccattctgtttcatgattccctgcctgtacataggttatatctatgtaatatgtttattagctcactgaagtgttccaagacagctgtgtcaagtattttgttaacaccagacaagtagcgttctgaacttgattatcatcagcggcatagaaacaatgagtatcatgtcctacagtaatgtccccttgttcttgttagtaaagacaaaggcacatgtttccaattgattagcacatacatatgcatcaatctaattgatttaatataactatcaattataactcacaggtttaatatttctgaaagcaagcaggagtatcaattaaaacttgtaggtcatgatggctagcaatgcaacggatgacagaattagttagtggatgcgccggtagaacacataaattacctggagccgtaggaagatagtctgatatcctactgcttatgtaggcagagctaatgccaagagttcttcctgcgccaaactcggccacatcttttagcctcttgttcttcatgtcaacagcaagcacccatgcattctggtcatcccagaggtcgaccttagccatgaagcaaacaatgtcatcagagtgcaagctgagctttggaaggcccacgtgaagtctctccaaggtttgctgaggtgtgccaagctcaggcagcaactcaaaattcatggtgttgtgatcaacagcaagatgagaggcagagatttggcagtcctggcgccaaccttgcttccaaggattggtgggtggtgcactccaagtggcagcaatccagccttgagaggcgtaggtgccgttgatagcggagcctggcctgacatgaacctgcatctcgatgtacttgatccgaccttggacaagagcaaagtcccgaagtggccctggacagcctactatcatgtcgtctttgtgctcgagtggtggcggcagcgggaggtagcggagctcagcggtgtcgcggagaaggtcgcagaagagaatgccatcgttgatgtcgacccagcccatggttccggcttcaccaccaaccgtgatgaccttgctagtgacatggctaaatgatggatcgaagaccaaaccatggatggagagcggatggcaggtccaagcatctgcaccagagcggtagagatgatcacctcgtttgaaggcgctacagagcgcggcgacgatgtaggtgccatcatcaaggcagcgcaggatgccaacctgtttgtcgatgaacctgttgtcgagtttcggggcggtggaagaagcgtggtagatgaagtaatcttggcggctggttttgaagctgtcgtcccggggccctaaggcgaggcggaggaggacgaggtcagcctcggtggcgatgatggtgggctcggctggggatccaatccagggcagtggacgcacatgtaggagacgcgcggcgggggcgccgcccagaaggatacctcgatggggtggccggtcctggtcctggacgtggcggtggtggcgttgccgtggttggtggcgatgtaggcatcgcattcgaggaggacccaaggtggtgtcgtcatcgccgcagtagcgacgtgggtcggcggccggagggactcatccatgatggtcttctcctcccaatcagaccacccatcactctcatctcctcccatgctctatatgcagctactatctactccctccgtttcgttttatttgacactgtcggtaacatgggaccggaagtatcatgactagaggcttgaggcagacgccatcgcccacgtggcctggcaccctcgggggacgtcgggcccgagggtgatgtgtgcgcccacctcttggtctccccgagggggggggggg

SEQ ID NO: 56241 - DNA, 5352 bp, Oryza sativa
atccaccaaaacacaggagtagggtattacgcttctcagcggcctgaacctgtatacatcgcttgtgtttcatgctcttttgggaggtcgcgatcttcccgcatacacggagagcttgagatctcaccctgagcccccggccgaaccggcaaagggggggcctgtgcggtctcccggtgaggagcgccgcgctccgtcatctggcgcgccaggtagggggctcagcgtgtgttttctgagctctcgcacttttccgtgtgcgtcaagtttttcttgatcagcctcatggctgagcaagcaaaggcgtccgacctctctcccagtgtgagtggcgacgacggggagccgaacccacgccgtcgagctcgtactccaccgccccctccacgccaaagtcctaagcagggggaggcgctcgaaagggtcgaaagatccgcggcttcaccgatcgcgggcgatggaggagaacggcgagatggggaccgtcgcctcctcgtctacggcgacggcagcacgccccagggcgcgctccaagctgcgggcgcgctcttacgccacccgcctgtcgtccctgacccggagtctccagcccaacgatggctggacgatgtggccaaattggtcatgacggcacggcagcgcctagatgctggtgggcggtcctccgccaccaaggcctctggtgctgctaccaccggctccgcgttgtcaagacggagggcacgacgagcggcagccgctgttcgccgttcggctgccactccttcgtcgactccttcgacccgggaagatctgcatggggagcaggacgcccgcgccagcatcgagcgccggcgtaatgaccgaagtgctgcccacgcaacggagggcgcttcctcgtccagagtgtcacctcgacatggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaagcgcggggttggctaatgaacttgccacccgcgtctgtccactcctgggaggatttgtgccagcagttcaccatgaacttccaaggcacgtatccgcgccccggtgaggaagcggacttgcacgccgtacagcgaagggacgatgagtcgcttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccggttccggtgtggcagcttcggccgcccccggatccgccgctcaggcagggcggcgtgacaggaggaggaagaagaggtcagtccgttccgacgacgagggtcatgtcctcgccgtcgagggcgcttcgcgggccacccgaaaggggaggcctgcgagcgacaaaaagaaggaggccagcgttcccagcagggagcgccctaccggcaagtggtgcaccgtccacaacacctccctccatgaccttgtggactgtcgcgcagtcaaaagcttggcagagcggacaaggaagtgggaggaggagaggaggcaggagcgccgggaaggcaagtccccggcggttccttccggccgtcggcgaagtgaggccaggcagaaggcccccgccgaggacatcgatgatggcgatgatgacctgggtttccaagagcctggggccaccattgccaccgtcgatggaggagcgtgtgctcacgtttctcgccggagcctcaaggctatgaagcgagagcttctggccgcggcccctactcatgaggcgacgcgccgggcgcggtggtcggaagttgccctcacttttgaccagaccgaccacccgccgtgcgttgccaggggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggcgtgacgccggggcacacttggccgctaggtcatatcgacctcccggtcaccttcggtggacccgccaatttccgcacagagcgggtgaacttcgatgtggcggacctcagtctgccctacaacgcggtcctggggaggcccgcgttggtgaagttcatggcggcggtccactacgcctacctccagatgaagatgccgggccccgacggccccatctctgtccatggcgacctcaaagtcgcgctcgcttgtatggagcagcgtgcggaccgcctcgccgtcgtgtccaagcccgagggtggcgacgagaggcttggcacatccgcccccgccgccccgaggcagcggatagtcacgtccgatgaggtcccggtcaaggaggttgcactgggcgacggcccgtccaagaccacacggatcggtggtcttctggacggcaaataggaagacgcgctcgtctccttcctgcgggcaaacgctgacgtcttcgcatggagaccggcggatatgctcggggtccccagggaggtgattgagcaccgtctcgccgtgcggtcgggcgcaaggccggtccggcagaaagtgcggcgccaggccccggaacgtcaagccttcatccgcgaggaggtcgcgagacttctggaggccggatttatccgtgaggtcatctatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccaccgcggggtgcgaccttttgtgttttctagatgcatactctggttaccatcagattcgcatggctagggaggatgaggaaaaaactgcgttcattactcccataggaacttattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatttagcggaaacttttgagagcctccgctccgcccgcataaaactgaaccccgataagtgtgtgtttggtgtacctgcgggcaagcttctcgggttcttggtctctgcccgaggcatcgaggccaaccccgagaagatacgagctatagagcggatgcgcccccccagtaaacttagggatgtgcaatgtgtcaccggttgcatggccgccctaagtcggttcatatcgaggctgggagagaaggcgctacccttatttaagctcctcaagcgctttgggccgtttacttggacggaggaagctgaacgcgccctcactcagttgaaagcatatctcagctctcctccggttctagtcgccccggagccaaatgagcccctgctactctacttagcggcgaccccccaagtagttagtgcagcgttggttgtggagcgcgatgaggacgatcctcattccgtgcacccccaccctgtgctgacttggcccgggagcgagcagggaggagaggcccccgagccgaacggtggcctaaggcccctgacgaccggagtcggccctctgcccgctcgtcagatggtgctgggcgcccccgaccctcaggaaggccccgaggccactgcgggaaggctgcatctatcgccctctgaccccgaggctaaccctgtaccgattcgacccgggagggagcagggagaagaggcccccgagccgaacggtggcctaaggcccctgacgaccagagttggccctttgcccgcttgtccgacgacgccaggagcccacgacccccagaacgggcccgaggccactgtgggaaggccgcccctgtcgtcctccgaccccgaggtcatcggcacagaagacgagtgcgccccgaggggccacttggacgaggagcgccccggggatatggcccttagcgaaggggatcggccccaccgaagggtgcagcggcctgtctactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgggagggtacaggacgggtggtaaaatgggcaatcgagctttctgagttcgatttacactttgaaccacgccatgctatcaagagccaggccctcgccgattttgtggcagagtggaccccggctccagagaccgtttcagtctctgaagccagctcggacccctcgcagctgcctcacgccgcccactgggtgatgcagttcgacggctccttgtctcttcagggcgccggcgcgggggtcacgttgacctctccgaatggagacgtccttaaatacttggtccgcctcgactttcgagcgaccaataatatggcagagtacgagggactccttgccggactcagagtggcagccggactggggatccgccgtctcttggtgttaggcgactcccagctagtcgttaaccaagtctgtaaggagtaccggtgctctgacccgcagatggacgcttacgtacgccaagtgcggcgtatggagcgccattatgacgggatagagcttcggcatgtgcccagatgggataacatgattgccgacgaactctcacggctcgcgtcctcgcgagcccagaccccaccgggcgtctttgaagaaaggcttgcccagccgtcggcgcgacccgaccccttaggggagacggacgcgcctgatcggtccccgaggcctgtcggagcccaggcctcgggacccgaggggagcgctccaagctcccttagattgattgcttggatctctgagatccaagcatacctcacagataagactctacctgaggaccgcgaagggagtgaacgcgtccaacgcatttccaaacgctacgtgctggtagaagggatcctctatcggcgcgcggctaacggaatcctctgaagg

SEQ ID NO: 56242 - DNA, 9487 bp, Oryza sativa
tcaaggattctattggccgactacccccaatgacgcgggcgacctggttcggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcaccaagtggcccgaggcttatccggtcatcaagatcgataagcactccgcacttaaattcattaagggcatcacggcccggtttggagtgcctaaccgtattattacggataacggcacccaattcacttgtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaatattctcaaaaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggtcaccatgtactgcgaggttgatcaagatcagcttcgtagagatgacctcgactacttggaagaacgaaggcggcgtgcggccctccgagccgcacgctaccagcagagcctgcggcgctaccatcagcgccacgtccgggcccgatcactctgcgtcgacgacctcgtcttacgccgcgttcaaacgcatgctggattgagcaagctctcaccaatgtgggagggtccgtatcgagtgatcggcgtcccccggccgggctccatacggctggccacgggcgacggcacagagttgcctaacccatggaacatcgagcaccttcgtcgcttctacccctgaggggggggtcgggtgtcaggtttcgggctcgggccaaccccgcaccccccctcgggtgtgcagggttggccgggggctgccacacatgcacattctcatttctctcatttcagtatttcaataaaagcagtttcaatttcctaagggctgtatctgtgccgttttttcctttttgaagaattttgacttgaaatgaggtcactcgtgctcaaccttgccctcgggggctcggttcggtcagctaaaatcgccaaacggggcccagaaccgagccgtgccccggggcgtggtgaactccggggggggaatcggcaaaaacccacaatcgggtcacccataaccctcggtcaccacgttcccggcctggccagtctcgacatgcggatctccccaggcactagccccgacccgcgcttttcgaggactgggacttggacacgggcccttaaatcaagctaagacacaaaaagaggaccacggcacagatcatcctcatctcatccgcatagcaaaataaaattaacacaaagaattttttcatcatttttgattgcagattataagttgatctatacaaaaaacaggcctgaaggccttagaagaaagaaaaagaaagaaattgaagattggcgggggcctgggggctcaatccgatgcgcccgggtcgccggcctcgtcttccacgtcgtctgcaccgctggcatcgccctcctcgtcggagttgggggcgaacgcaagccgaggggccgagccctcgaagctgtggacgatgtggtcggcggcatcccggacctgcgcgcgcgcgctgtcttcagtcccaggtgggaactcgtccagcgccatccacggagagaagttggggtccctggcctggtagctcgccaggacgagctccaccgctccttgggcgaggtccctcgaggatgacttgatggtcttctcgagctcctcagggagctgctggagagccccggccatcttcgagaggcgctgggcaaggcctcccaggttggcggcaggctttattgtctgccctttccagaggcccgcctgccgaccggcgcgatccagacgggagactgcatcccagagcatgccgggccctatctcgcccgccaaacggagggcctcggcttccccggcggatgagtctagcgcgcgctgcatgtcggcgacggtgtgttcggcatctgcgaggcgggcggctaagtcgctttcgcccgcagccgccccgccgatgcgcgccctcgcgtccagctccttttcccgcgcctcgaggtcggcagcccgctgctccagtgcggctctctcggcgcggacggattccaaattgcggcgggcctactccgtcagcgctgcctcacggagggacaggctgtccgccaaccgttgcgcctcggcctcggcctttccgagagctcgctcccgctcggtaagcgcgtcctcgcggaggcggagtgcggactcctcttcggcgcaggcagactcgtgcgccgccagcgttgtctcccgggaggcgacggcggcctcgtggtccgccaggtccttctccgcgacgcaggcgcgctcctccagcgccatggcgcgcgcctcgagggcctcttcacgccgccggagcgccgcttcggtctccgtcgctcgctgctctcgggcagcggcggcatcaaggaccccctgggcggcgtcgagctttttcttcagctccgcctcccagttcccgtgctgaaggcggagggagtcctgcgcctcgttcatcacagtggtggcgatgagggcagccccccgctcctcctccacctctcgagcgatctccgccagtgccgccttgcgggcctcaagatctgagacgtgccggcggtgtgccttgcggcccgcttcaaccatggcctccaccgagtgccgcccctcctcgacacgtgcccatgcggcgtcgagctccgcacgctccgcctgcagggcctccacctgggcatttaacccatccaacaccgcggtatttgcggcggctaaggcctgcagaaggggctctgcgctcagcggggcgacggaaggcgtggggaagggctgccttggagaagatgccgcgcggctcggcccgccaatagacgcgccggccttatcgcgggccacccccggacctgtttggtcctgggcgtcgcccgaaggagtgggcccaagcgacgcacccgcggcctcgtcgcgagccgcccccggacctgtttggtcctgggcgtcgcccgaaggggtggacccaagcgaggcgcccgcggcctcgtcgcgaactgcctcggaagccgccatcgcctcagcctggcgaacccgggcggcctcctcccgagcggcttcttcggcttggcgagcccgggcggcctcctcccgagcggtatcctcagcctggcgagcccgggcggcctcccgggcggcctcttcagcttcccgtaggcggtctgcggcctctcgccggtcagattcccgcctccgtgcctctgcggccgccggatcttcggcctcggactggccggacttgggatggtgggaggaacgcgatgagatatcactgaagcagaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgctggcgcggccccctccgggcgcctgctgctggcgcgcaccgccccgccccctcggggaggagatgggggaggtgttcctcccagcttcctcttcccccgggagtcggtagggcggctgctccccgagcccccgacgcggggcccagaagcacgaccccctccgggggtagattgatcccctcggcggctcccgcctgcgtcgtcatggcccttaggagcctgctcctctgaggccccgaccgccgtcataatggtcaagatggaggcgcgatctggatcgctgcagagggggaggataccgtgggggatgagggacgcctccacggagttgagatttagcacccgttggaccagtatcttgaagtcctcgggagcccaatcccatctgactccctggtgggtccgcatgtagtcttcggacccggtgtactcccaggcgccccgagcgcgccgctggagcggcgcaatccgacgacggaggtagtcgccgtacaccatggccctggtgagcccctgggatcgcaggcccgcgaggcggtcgaggacggcgtcatagccatcccccagatctaccggcgcccgccagctggaggcctgcgccgggggctggctcggaagtcggaggcgcgcttcgtcggcgaggggggtatagaaccagtcgctcttctagtcatcccactttttgcggaggacgcaggggatgtagcggttcaacaccggcccccgcggcaggaaatagcagccgccgaccaccgacggtggcgataccgactgcacggtgaagaaccaccggaacagccgaagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcaaaggggagaaagaagacggacctccccgggtagtctggcgccgggcgtccctcgcccagcatgactatctcacggccggtggcagattccggcataaagcggcgcggcaacccagcctgcttctcgctcacgatgcgggaaggcggcagcacgctaccatcaagcagtgcggagccccgtgccatggcgccggacgaagagaagatggagagcgagcgcgtgtggcgaaagaagggcgcagggaagaaggagttagggcgcaagcggcgaaggcaaggggaatgatggcgaaaggaaggaaacaaatcctatcctcagtgcctttatacccttgccaacgctgtgcccggctcctcgtttctcgcgcccattatttcgccccctcgtttctcgcgcccacgcttccactgatcccattcgcccgcttgcggcgcgtgaggtggatatgcggttgcggcagtcgagatagatcgtatcgtgcgcgcgttaattacgctcgccgaccgaagcgacattaccgtatctccaggcgaagcaaatcggctcgcccagattcattcgccgctcaggtgatgtggcagtcttgaagagaccgcccattattgacagccaaattaccataaccggtgtgcatggtttgagaccgttgggtttctgcccaaccatggagaccggtcccacctgtcaccaggctttaggagtggcgtcacgcccggccgcttcccataagaagggcgatcgccctggcataacgccgggggctactgtcggtaacatgggaccgggagtatcatgactagaggcttgaggcagacgccatcgcccacgtggcctggcaccctcgggggacgtcgggcccgagggtgatgtgtgcgcccacctcttggtctccccgagggggggggtcggaccactcctgcctcgcccccgagggccgaggcgccccgacccctcgcgtttctactccacgtgtatgggttaggtgagcacagcggggctcacctaaccgcatttattgcgcctcggttaagcgtgtcacgccgcacgaagtgcagtgcagtgcactcgattatccggtctgtgaccagtcacagaccggtcaaatcgcgggttaggtggcgacaggcggtctgacgcacgcttcgccccatcccgtcaagacgagagcttctaggcactcgtccccggctggagctagcgtgttacatcccagagatgacacgttagccccgatcgatatatgccaggcttcatcctaaccattacaagcaagatgttgtttgaagaagggcaagcatgcacgttgctaagccgacgcgtggtggacaagaatgaccgatttgtgaccggtctgacactgctcatgtcgtcagcacacagccgccttcccacgacgtgcccgcctcaggcagaagtggaggtaggtgtgtgtcgtcccgtcaggaggatgttcggaggacgaccgtgcaaatctccgtccatttatgaagagaagaaaagtccagtttggaaagagaggggtgcatgtggtatccccttgaagtataaaaggaggacctggcccatagagaaaggggatgatcttttccagattcagaacctagaacgagggagaggttggctcacactttgtagctccttcatacacagatccaccaaaacacaggagtagggtattacgcttctcagcggcctgaacctgtatacatcgcttgtgtttcatgctcttttgggaggtcgcgatcttcccgcatacacggagagcttgagatctcaccctgagcccccggccgaaccggcaaagggggggcctgtgcggtctcccggtgaggagcgccgcgctccgtcagacaccgttaactttttagcacatgtttgaccgctcgtcttattcaaaaacttttgtgaagtatgtaaaactatatgtatgcataaaaatatatttaacaatgaatcaaatgataggaaaagaattaataattatttaaatattcaaaaacttttgtgaaatatgtaaaactatatgtatgcataaaaatatatttaacaatgaatcaaatgatagaaaaagaattaataattatttaattttttttgaataagacgagcggtcaaacatgtgctaaaaagtcaacggtgtcaaataaaacgaaacggagggagtacttaacctctgggtgaatgtgaatttatcaatcttttcctatctaatctaatctgatctaacaacacacgtgtgtgtgtgtgtgtgtgtgtatatatatatatatatatatatatatatatatatatatatatatatattagcaaaaatgcccgtgcgttgcaacgggtgaaaaattctaatgataatatatttttttcatacataatcatgtcaatgacaatgtttgtattttaacgaacgacttgtttttctataaacgattttttttcttgcgcgattttctcaaaccattttttaaaaatggcacatttctttctaacagttttttcctagcatgttctttttgtttttttactgacgacgaaaaccatatttttctcccttttttgcttttcttttctcgtgtgtttttttgcatgttttttctaacaattattttctcgtgcgttttttacttttttttcgaatgttcttttttgtttttttccaatacaggagaatatatgacgaaataaaaaccgtgtaatagatgacaaaaaaaaccgatggatcctatccggctcaagcgtccatcaatttagcgttttttcgacagatttttcagagcaatttgtttttaatagaagatttttttcttgcacggttttttcaaaccattttttagaaatggtgcgttttttcctcgcatgtttttttttaaaacaaatttctgatgaaataaaaccgtgtagtagatgacaaaaaatcgatggatcctatccggctcaagcgtccatcaatttagcttttttttctgacagatttttcagagcgatttattttttaatcgacgatgtttttttcttgcacggtttttttaaaccattttttagaaatggcgtgttttttctgacagttttttcctcccttttttttaagtaatttttttaccgacgatggaaataattattgtcacgcggttttttattttttttacggaagatggaaaacctttttagcgtgttttttttgcgcttttttctaacttttctcacacgtttctttgaactgtttttattgtcatgcattttctctttttaaatagttagattagattagacataacgaagattagaaatcggaatttggttcgcccttttcattttttttctcgcgcgcattatttattttatatgaaccagctttttattttttacgaaccattttttcttcttagagaatcggacgaacttttttagatgttttttgggatttttttcatctttatagcaattagacctttttttttcctttttaaaggaattagatctagcatttttttcaccactttttttttgccttttataggaatcggatctacggtttttttttgccacttaggagaaacggacttttgttgttgttgttgtttttctttctttttctttattttcttttattgtgcggtttttctttttctttttatgcacctttctgtctttattcttccccttttattattttttaatcaaaaacgaccttaataccttatttcaaacttatatggactcaaatgtaaatataaaaattacagggactcaaatgcaaaagtatagatccaaaaattaaaatcatataaaaatggaatgctctcgaccggtaggtttcgtttttgcaaacagatctttaatccggcacatcaattttatttttcgtttttaagggtgatttagatctagagtcgaactttcttttttcctttcttatagcaatcggactttttttttatttttttcgctatttttttttgacggacaggaatcggtcgagtcggactttttttttattatttttggatcggactcttttttccgcccggtttttttccctcgtttttttttcaccagttttttttcgctccgtttatttttgttggatcggacgtttttttctttctcccggtttttttgggatcggactcttttttcgtccggtttttttcgctcggtttttttctcgtggtttttttgacggacgatggaagcacctcttattttttattttttattaagtagtagatatatatatatacacacacacaccttccgttctggttttgggtgagaagaagaaatcggatcggattgaggaatttagggaaacggagtgtgacctcggtggccgtgctgtgctctcgacggtggagtggaattcaattggccggggaagaagagaagatgaagatgatggatagccagcccagttgcccgttaaaaggccggcctgctaaaaagaaggcccacatatgctactagccgggagcccactatcccgttggttagagccacttccacgcaccagatcgaggcaagctgtgatgctgtctccgccgccgccgccgcgctcgctggccgtcctccattccattgcagtggtgccgcccgccacccttctctcagccctcttcgtctccgggcgagcccagctccttcttcgatcaggtgagctcacgcctgcctctgctcttgcctcttcattttcttcttctttaacctctcacctcgtcgtcatccatcgggaaagaacgccgtgggtggcggatgaggcataagcagaaagt

SEQ ID NO: 56243 - DNA, 2194 bp, Oryza sativa
gaagtctaacacaacagcaatactacatgaaaatgctctccccttagccatgcccctcctcatccaaaatccatgtaatcaacttcacctcccacagaattctgttgatctccacctttccaagagggaggagacatatgcatcatatgggtctgcttcttgtgtgagggtgcggtcaacaaaccccttgtcgctttaggctaccctctatacctgcagccagcaaaataaaaaatcctggctcaatgacaactaaatagtagctctcatttctatcatttccctctaatagaattccatagcgaaacaatcaacctaggtgatgtgctatttccatgaaagcacaagccatgatgcagtttttgtttccaccatctgtttgttaggtaatgtattgtaattatagaagaaggcttccattttacagttttaactgggcattgctcataaatctcattcccttcaatgatttatttgcctatatctatctatgtactatgttttatcagctcaccaaaagtgtgtccccacaaatattgtgtcaagtatcttgttaacaccagacaaatattagcatcctgaactggagtatcttgtacacccaatgccatagaaacagggctcccaacagcgatgtcccttgttcttgttaggaaagataaaaacatgtgttttccaattgattagggcacatacatatatacatatgcgtcgatctaataggtttaatattcttatcgattacaacatgcaggtttgctatttgtgaaagcaggcaaggttatgatggttagcattggaacggatcacagggttagggatgaatcagcagaacaaatagttacctggagctgtacgaagataccctgatatgttactgctcatgtaggcatagccaatgccaagggttctttctgcaccaaactcagccacaacttttagcctcttgttcttcatatcaacagcaagcacccaagcatcgtcgtcccattggtcggccttggccatgaagcaaacaatgtcatcagagtgcaagctgagcgttggatgacccacatgaagtctctccaaggttggctgaggtgtgccttggtcatcgaaaagcttaggcagcaactcaaaattcatcttgctgtcatcaacagagatatcggaagcagtgagtttgcagtcctggcgccaaccttggttccagggattggtgtccggtgcagtccaggtggcagcagtccaaccttgagagatgaaggtgccgttgatgatggaacctggcttgacatgaagccgcgtctcgatgaacttgatccgaccttggacaagggcaatgtcacgatgaggccttggagagcctgttaacgagttgttgggactgagcggcggcggcagggggaagtagcggagcttagtggtgtcgcggagaaggtcacagaagagaataccacggtagaggtcgacccagcccatggtgcccgccttccctccaatggtgattgccttggtattgatatgggtaaatgatgtgtcgaccaggccatggagggagattggatggcaggtccaagcatcagcgccggagcagtagatgtggaggtcatactcaaagtatcctgattcgaaggtgttacagagtgcagcaacaatgtaatcaggagaggcgcaacagcgcaggaggccaagctcgtggtcgatgaacctgtcgatgggagggggcgggagcaaggtgagtttcggggttggggtggtggcctggtagacgaagtagtcatggaagctgctcttgaagcggatgttccggcgccccatggcgacgcggatgaggaggaggtcggcctccgcggcgatgatggtgggctcggtggcgaacttcttggagtccaatccagggcagtggacgcatatgtaggagacgcgcggcggaggcgccgtccacgaggatacctcgatggggtggccgctcctggtctcggacatggcggtggtggcgttgcggtggttggccatgaaagcacggatgtcgaggaggacccaaggtgtagtcgccgcagcgccgtgggccggcggctgcagggattcctccatgatcgtcctcttcgaccagtcatctcctccagccatgctgctacgcctacctccgactccgtcgatttccccggaatttaattctacaccttgtgcattagggatccggaggagg

SEQ ID NO: 56244 - DNA, 1185 bp, Oryza sativa
ccctccatattttaatgtatgacgccgttgactttttgtctaacgtttgaccattcgtcttattaaaaaaaatttatgtaattattatttattttattatgagttgattcgtcatcaaatgttctttaagcatgacataaatattttcatatttgcacaaaaattttgaataaaacgaatagtcaaacgttggtcaaaaagtcaacggcgtcatacattaaaatacggagggagtaattcttttcctatcatttgattcattgttaaatatacttatacgtatacatgtagttttacatatttcacaaaaaaaattaaataagacgaacggtcaaacatgtgctaaaaagtcaacggtgtcaaatatttagaaacggagggagttctatgaatctaaacagaatcattgattgcccaacacataacaaatgatgattgcagtctgccgattttagattcttcatttcacattgacagaaaaccaaattgcagcagaaaaataatcggacttaagacgcccaacgctactagggggcacacatgcataaattgtgagcaatttgacaccaccaaggactatacggtttacaacctcgctacattgataagaaacgaacaggggcataaacaagactattcatctgctctacaaaataccagcagtacccctcataaatagacctgataaaacagtagataatctagtcataagttaactgaagatgcaccacacttaacttaaccatgcccctcatccaaaaaacatgtccaagtccaagtccatgttatcctctccatcatccatacttgttccagaattctgttgatctccacctttccaagagggagtagacagatgaaccatacgggtctgcttcttgtgagagggtacggtgaacacaaccccttgtcgttttaggttaccctttatacctgcagccagcaaaatatttagtgaaaaccggctcaattacaactaaatagtagctctcatatctaccctttccctctaaaattccaaagcaaaacaatcaacctaggtgacatgccctttctgtgaaagcacatggtcatgatgcagtttccgtttccaccatctatttgtcatgtaacattttgtgattattgaagaaggcatccattttacagtcgtatatgtactgccattttactgggcattgctca

SEQ ID NO: 56245 - DNA, 749 bp, Oryza sativa
gcttccgcaacccgctgagcatgaacatgagcatgccgatgcccaacgccaacttcacggtgaccaaggccaccatggccgagttcccggcgctcaacggccagagcgtctcctacgccgtcctcatgtatcccccggccaccctcaacccgccgcacacccacccgcgctctgccgagctcctgctcctcgtcgacggcgcgctctccgtcggcttcgtcgacacgaccaacaagctctacacccaggaccttgccgccggcgacatgttcgtcttccccaaggggatggtgcacttccagttcaactccgggaaccagccggccatggcgctctcggcgttcggaagcgccgccgcggggctcgtgtcggtgccggtcaccgtgttcggcacaaacatcgacgacgccgtgctcgccaagtcgttcaagaccgacgtgcctacgatccagaagctcaaggcaggcctaactcctcccaagaaagcctaagccctccccgttggtgttaattattcttgtttttcatcctgctgctgctgctgcttgaaataagagaccttccaggctaccaactactgaagaaggtaaattatgatttgtgtggtgaataattctgaattgtggttgtattgtcttgtctgaagagctttgaaccatgtatctatcagtattaattaaggcgttgtgggaatatatatagaccagttcagttgtaagtgttgagagtttctctgctgtaacggcttt

SEQ ID NO: 56246 - DNA, 1595 bp, Oryza sativa
ggagctggcataatacaatctgacttggaagttaaggatcatgcatgtgccaggcatcgcaaagccttcacttgagtaaatactggatgtttaataaaaatatctcacaagtagagtttagcgtcgaactagtctaatctatttgtaccacagtttacaaaatggcaacatcaagtctaaaaatggagacaaagaatgcaatatcgaatcgacttcacatctaccttgtcagcccccttgaaaccaggttcctgatgctttgcaagacgattttcgtgtgcaacatctcgcgataaacagcacacaacaagctaaaagctattaatagcttcatcgccaaacaaatggcttctaaactgataacagtactagcgaaaactagtaatacgctatcatgctccaccaaatcaagacgtaaaatgacatgtttactagcttctgatgatccagggcaggcacaactcagctgactttggaagaggcttaacacggccgagcccactgagatcacaatgcgtctgagttgacgcagaaataattcttggcataatggaaccgaaaacaccagacaaactgacacagcagtagcaccgtataaggtgcaatttaattgggcaataatcaagatagataccgagataacatcaccttaacaatgtgccaaaaatctcaaaacattcaacattactggggcaaatgaacacccacatatgtatcactgaataaacttaacagaacggcaacatcaggtctataagactagaaaatggataagacaacatcatgtgttcgttgccctggtgtaaatctgttggctgcaatgaaccgacaccatcctgataagccccctatccatcagatccttcatagccctcctagccagggacccattaatctgcaggtaaatatataaaatcttgttacccatactgagcaagatgattaaaattacctagctgtacaacatctaggtataaattacacagaaggctaaaacaacaatgatgacgttaagagttacattgccaaaagagaatatgctatatgttgcacatgcaaggggaaaagagcaagatcaaacttgccatactaataacagtagtttcaggtactaataaaaattcacaaatcaactatatagtttggcgcatggaaaccaaacaaacatgcacagaggcctaacaaatcattactcctttgctcattggcatcactcaaccacacaaaaatgccaaccatgacaccgaataccccaaacagtggtgattctgcatttaactcatggatggaatatcaatatcataacccacaaatttagcacaggagcctaaaattaaccacaaggtccttatcttcctgaattctatcaagtgggctaggctacatgactgtgaaaatatagtgaaaatctgaattggcgcgcataaacaaagaagaaattgagaatgtgagctaggcaaccagcatggcacagtattgttggtggtaatctaaatttatcaatgaattaccctgaggcgctcggagaggacggagggggtgatctgcttgtacttgggcacctcggaagcagcttgtcgtaggtggcctggtcg

SEQ ID NO: 56247 - DNA, 11298 bp, Oryza sativa
aattaagccgctttattatgagtggaacgcatgagcaaatgcatatggcgagcatgcattcctgaaaggcaagattctgcgaccaaagtgtacattctgaattttgtttaggtggatgaaacacatagtatatttcatgggaaggagggaaactggaaaacggtgtgctgctgctaggcctgactctttgggcttggacgcttcttctctctcgcttctgcaaccagagcatataccccaatctgccacgcgtgccggccgttactaatccctcatcactaattgtatgcatgatctactgatgcattgcatctctgttctgttcttgaccagaccgtactctcgttttggagaatgagaggtcaggaattgaagcagctagctagagaaagaggctgcaggggagagtccaaattaaaccaaccaccacgttgttatgtgttgcttgcttggtgctagagtgctagtaatgcactagtccaaattaaattcttcatgtattttaggatgtagtatatgatattattaagtttattgatggtgattttctggatggttgaatgcatctgcaaactgaaagagtggccggtgtgaatgcagtgcttaattggaatccgacagtgggtaatggaggagatgggccagtagggttggtgactgttagacgctagcacatccaggcgattaatacgactactgtcatacgtactgtacatgtcatgctacattatatcgatctgtacattctcttggtcatgcatattacagcgccatatcccatatatcgtacctacgaccaaaattaaactaaacgctctctgaaaaaccaatcaacaaaatacatacaacctcatgttcatgtaggggtataaactataattaatgttcatacaaggagtatcactatcgatcaagctgctgctatgctaggtggaggatggcaatattgcattgatgtcgcccgggttcgttgggccagtggctgctaaccgaatttaattccatcctccgctgctgctgcgccagcccggccagcctcccaagaccaaagtgaacatatggccctgtctagttccttaaaaaacttttcgcaaaaacattatatcaaatctctgtacataggtatagaatattaaatatagataaaaagaaaaactaattgcacagtttatatgtaaatcacgaaatgaatcttttaaacctaattaatccatgattagtcataagtgctacaacaacccacatgtgctaataacggcttaattaggctcaaaagattcttctcgcggtttccatacgagttatgaaattagtttttttcattcgtgtccgaaaaccctttccgacatatgatcaaacatccgatgtgacatctaaaattttcatttcatcaactaaacaggcccatatatgtactggagtacgtgccttttatacagacagactactactagtcactcattttacaacctgcacaatggaaatttaccactcaaaatttttcataggcagactgtacatcattttcgtttctaaccaaaatatatataggtgatcacaaaaatcacaatgataggcaaataggagtaactaactaaaagaagaatctttgcattatattggctctttttcgcggatggaaattgactcagttcatcgcatctggataattcattcatcattcattcattctttgtttgttttttcatgccgacttaactgaccgcacatgcataaaagcctcaggctgcagctagtccatgcctgcactgcatagtgacgacgtctgtattattctctttctttttacctaccctataataggtctccaaattagcacgccctgtcctattgttactgttattgctctcactcctcgcttaattaggcttgacatgtacatgtccaaaacataaaacacatttatcaatcgaaccgacattttggttgcaaatctagtgaacaactaagcaagttatggtgaggcgtcacaatcaactgtaccctgcccttcaaaacaataactaaggctgtgtttttcagcgcaaagtttggattttggttgaaattgaagatgatgtgattgaaaagttgtgtgtgtatgacaggttgatgtgatggaaaaggactgaagtttggatccaaactttagatctaaacacagcctaactgtatatcagtaacagtcctgtcgcgcgccgtttctgaagagatgatatatagatcctctgtgtttaatttgcattcagcatttatcagttttatctaattaattgttgtcttaaaagatgtactaaaattaaactggctagtatttgatgaactctctctttttctatacaagtagcacttgtttttagaggtaagttccttcctagtgttcttcagactagtttaagaggttgagcagcattcatgtttagttgcagcctagctattggaggcaaactaaactaaaagctgaattcgctctcacctgctctactgacgtgcgtatgttccataccgcatctcatgtgccggcagtattttatttatttttaatcactctctcaacaactagtaaaagctaatgtatcctgcacatttgtagagagtaattaaacagcacgcgcgcgtgcgtgcatctatcatgtcagataatgtgccatacaattatctggctgaaagctaaccttaaccattaaagtattttgcagtgtttatttgtttgtttttataacagagataatagtaataaggttttaactggtacgtagtatggttgaatttaaaatattggcgggtgcagcttcggccgttggcatcgcgacgccggtggcgtacaagctgcggcggcgcggcgggcacggcggcgaggtggcgtcgcgcgggatgaacttcgcggtgggcgggtcgggcgtgctggacacgggctacttccagcgcaacatcagctcgcagatcgacctgttccagaagcagctgcgcggctgcggccccaccggcgtcgcgctcgtcgtcgtctccggcaacgactactccgccgtcgtagacaagaacaacggcacaagcgtaagctgcaattgcaatacaaccacaccggccatctcgatctatatatcatatctcctctctgaacatgcatgtatgaacaggaggcggcgatcgcgtacatcccgacggtggtgagggggctgcgggagcaactccggcggctgcgcgacgaggtagggatgaagaaggtggtggtgaccaacctccaccccatgggctgcaccccgtacttcacgcggctgctcaactactccggctgcgacacgctggccaacgccgggtccgaccagcacaacgccgccctccgctccgtcctccacgacctcgaccccgccaacaccaccttcctcctcctcgacctccacacccccttcctcaacctcatcaccgccgccgccgacgacaagttcccggtgcggctgcggccgtgctgcgagacgttcacggcggacggccactgcgggcaggaggacgaagccggcaacaagcagtacacggtgtgcgacgacccggagcggcacttctactgggacgacgtgcaccccacgcaggccgcctgggccgccgtcgcccaagccttcacccccgccatccaccgcttcctctccacctgaacgaacgaatgaatactcaccaaccagctttctcatttccgacgaaattccgcgaaatttcgacgtttctatatggctcggaattaagtttcgattcgaatttcgaaggttaaacagtagatttgatcgaaattcagtagatttgctccttgcacttcttcttcttcttcttcttcgtcttcttgaacaactttttttggggcctatctaatttattattacctttggatgatgatttgttgcaactggatagcagtattactgatttttttttttgagcaaagggcgagagccctccatttccattaatagaaatgaaaaagtatctaccagtctacagaaagcagtaatactgatgccggaatacttcaaccaattaaagaaccctataaaaaaaccccaaaaacattgccttttggaacccataagcaaaaaggacattaagttaatcgtctgaccttctacagatttactgttacacaatcgatcaccaggaggcctccctcgctcgctttctttctactgttacactctgctcgcgttacaactaacgggttgtttggctgaggtctcaccctttgctattaagaagaagatgaacacaaaggctctagcagctacataaatttaatcaaccatgggcaattctcaaaacacatgatagttctatgttgtatgcacttgattgtcctatgcttacccaagggggtgtcagtaataattctccagcaatcccaactgctatgaggcaccattattgttgccttctgttgctgctgctggtggtggtggtggtggtgttggtgtcacgtccatttgctcgacgtttgtctcagcagcctcgtactccgaaaggaggtccatgaattcgtttaacagccgttggaccttgcggttcgtagccatggaaggtagtatatcttcccttaggagtttgtgtttcttcattccctgcagatttaccatacttgagttcacaggctcaaagtggtaaataaacatcacgtccaagaaaacatagaattatcaggccatctatcagacagagagccttacaagaacatcaggatcccatgatggatttttcaaatcagcagatgatgcagcgtcaaccatgcccatcggaggaccaagaaagctctcacaaacttcacgtagacgagattcatctgcctctctgaacgaaacaaagaacaagcaatataatcatttccgcacagcatcatagactgttctcatcagatataaaagaatcacaaactttctcagccaattaaacatatagagctgaggttgcaaaaaagaaatgttgctaagcctcagaaaaggagactctgtagccattgtattgaattgataaacaaactaaccttgccagaaatcttatgtaggataagaggcattggcgatattcctgtggagacttcaaagccaatgaagctgccagctgggtctctaaatgggagcgtgtctgcaccccatcatcggtaaccctgtagtgccaacagtcaaacaagtatacatttagagcaaattctgctatgttagtacactagcatgtcatgattctagtttcaaacgctcataagacaagagcaacaatggaagtgtgcaaacctgctccaaataggctttctagccatgaattttcctatatcgatctgcaacttgcctagctctccaccttgagtagaactaaatgagctagcaaaatttgatgctggaaagcaatcatcagctatccttagccagcatttcaggctggtgtcataaagaaaagcatggcgactggcaagcacaactaagggcgagccacatcttgaaaatttagcagatataacctttactgtacctgtcatataacaaagcaagatcaacttgcaagaacaagccattttggtcaacatcaatttagatgcacaaaagttcagattaacactacatatgaaatatttaccggtatcttttccagctgcctcatctggagatgttaccaaagaagccaaagaatcatgcaaaacgcaagtcctggtatagaggtcccatatgtacatcaaacccctccttgttacaagaagcaatttccaacactcatcacagtctataaaaacagctgctgatcccatcatcatcgctggcattgctcgccttccacattttgtgtaaacctgaacaattagaccagttgattcgagtgtttaggctaccagattgtcagaaaaatgaatgcacatgaaggaataaataaaatcatattccagcaattattgatagattttgtaactattccaaactaaaacatgaaataaatctacaaggaattccactaaagggatattagatacctgcaggcaaccatcttcacagccaactgcccagaaattcgcattaccagccaagacagtcaccttggcagagatgcgatctgaccaaagagtttctgttcctcttgtacatgtaatctcagtttcttttgttgaaaaagcaccaccaagcccaatcatgtctcctgcagaacgttctacaggctttgcttcaaggcggaccggtaaagaatcctcattgtctttcttattgaatacatggatagaaagtgaagagcaagaggccaatgagcctggaactacagatccagactgttctatgctcaaccttccatcactgccagcaccagctgaagctttttggattacaagactctcactaatgttagttcttgcagtaatgccagagcgttccctaactccacaattattacagttaccgctagcactataagatggtcttgttccattctctccaaggatcattcgctgatccagggatgaaaaatccacaccttgattctgagaacggttggacatgtcctggttggaaggaaatccaactgcctctggaataatccttttccggccatcaggacgccggtattctctttgtttcactggactagataaacgaggtgctttatttatgtcatcagcagtggaacctgcagttttcttctcatcttcaggtaaagcttcaggagctttctgatttggaacgcttgtagacgggttaggtgcatctgtagaaactttggggggtgattgaaattgctggacactggaaacctttttgcttgcagattgtttggccgatgcttcttctagcagtaactgagcagggctttcagctatatttgattgcctccctctaacatcgccatatctattcttcttcaattcatccagttcagcatcccttaacctgtatccaagctcctttgcttcaaagtgaaaggtagcaactgaaccatccaaagagcaggcaaaaagtgaatagccatcaggactcctgtcagggaaaaagagcagttgctattgagcttgcacatacacgggatactaattatagaatatgttatatggtcaaattcacataccaagataaatcaaccacactttgagtgaagaaatgcttggcaacaaacaatggccgggcactcgctgtcgtccagacagtaatagttcggtcctgactcccaatagcaataacattatatggttgatgttctttagatgatgcttttgatgctccattggcccatccagctggtgcagcctttgcgtcttggccagaagataaatgcttacggaacattgagtggttaaacttaaccactacaacaggtgcgttatgccccagaaaatcaaaggttgctgaccattcaccccgttcaagcacaggggctgagtgcctaggtttctgaaaaccatgagttgtggttatgaagtggccacagggagaccaagcaagtcgcctaaaaaatgtcgaaccaagctgcaaacacacacacacacatagaaaatatttttcagtaaggaggctttctgcaaacaagatatgtgaaccacagaaatgtaatgaccaagtccaaatacacaacaatataacaaaaacataccgattttgaccaatggccttctgtcctgtgagcaagactccagtcactcgtacgccatatgataacagtcttgtcatctgattggcttgcgatgaaagaaccgataggatcccatgtaacgcctttaactaaactggaatgccctcgcaagacagcagtgcatatgccattggccatgctccatatgtgaacagtattatccaaactgccgctagccaatgtcgagtcatcaggggaccaattaaggtcaacctactttacacataagaaatataactgtgttcaacaatgaatcgataaggatcatgacagttttagtaagagatctaagtaacaggtgacagattaaaatctaattatgttaagcatgacatgactgagattttggcagataattaccacatcggcagtatgccctcttaaggtcataacaaccttccagttttctacatctggaggttctccacttccaaattcagatgttccagtgccagcttttctttcatgaatttggataacttgatcgtccgatcctgaagcaagatagcggccatgatgggcccatctcacacagtttactgttccaaaatggtctcgaattgtagccagcaacctttggctggaatcatcactgtcattgtctttggccactgatttcatgctccatatgcgaatctattgtgagaacaaaaatgggatattagcaaagagcaggctgcgggttcctcaatgatggcttgataacaaattaccagcttccacactgacgagcccagacactaaaaccactaaagcactgatgcaaagaattccctctaacataattatgaatatagtgaactatccttgatacatcgaaatgtaacggtgctgcctaaattccctaccttgtacaggtcaactctgagaaggtcaatttatcacggggaaaaatagcttgacagtaaaccagcaaaattttacacttgacgagagttataaaaaaaaaaaatcttaagtcaccttctggtcgccgccgccggtggcgaagcggatgccgcccggctggatgtcgatagagaagatctgcaggccctcgtggcgaatccagctcggcttctccgtaatcatctcctcctctaggtggcttgccgctcgtcactgccgccgaaccgcagggcccatgccccgagcaaaggacccaaaaccctagaaatcgcgcggccgcccgcgggaaccctaggccgcctcgggacggctcctggtaggggggaggaaggttcgagaagcttcgggagggagggggcggggggggggtggggcgaccgatccggcggcgcccggcggcggagcgaagaacacggcgaggagggggatgaacccaaccgctcgtgttccttcctgagagaaaacgaaatcgaatcgaatcgaatcgaactcgaactcgaactcaaacgaaactgaaacgaaatttaaataaaaatctcaaaaaaacagaaacgaaaaggggaaaggaaaagaaagattcgagagcagcggcccagatttcatcccccttttgtctcttcgtttgcctgctttgagattcgtgccggtttaattcgttttaattttactgaattgctcctactggagtagtactacgttgttgttgtgttgtgcctgcaactgcaactctgcagccaatgtgcaagtctggttagtgtcggtcagtcctgcacctttgttgccacttgaaacaatttgagttcaaaattctgaaacttgcttgtcagctttatgaaatcaagcgtacaggcagcctagcagagtggtcacagcgtttacgtgcgattcatagagtgctggaagaagaagagccagcagcaagcaattggtttgtttgtttcttactcatccaactggaagagacacattatccactcatccaacttcgtttgaacctggagtagcattcagaattctcaggtctcaaactgacgactcttcaaatcaaccgcaaatattttagattttgagatagtagttgcagcagtagtagtagtagaaaacaaaaattcagtagagatttgttgggacttaggaggaaggagtgaaactgtgggcggcgaaactgataaacagtcggcaacagagtcagagagacaagtcagaaaggcgtttcttttcatttcgttttctttagcgggagaagcactcacagcttgggcctcattatcatatgggctcaaattttacatttcggcccatgtttgcgtgggccaaattatgcaccagcccaattccaagtaagtaaccaaattgggtaaacgaggtttgcgttattctgataagtgacaaaattgttcttcggatgctcaactgaagcatttttcactcaataaccaatcaaggaaatccaggattatgctgtgacaaacgtatatacgtgtacttacgacagaagaaataacacagatcatacaggcagcaacaagagtatggatcgatgttatcgaccaagagcaatcttaattaataataagagaaatgtttaacaagatgacttgatttgtttcaacaataaataaaatacctcaccaccactagcagcagaagcttataaatcgattctgtgatgaattataagcataacttaacacgtacgtacggtacggtgatcaatcaataatgttggatggatggatggatcgagtatacaatcagctagctagctagcttcttcattgtaagcagcagcagccaggtagaagaagaacaataatcttacgtatgatggatggatggaatggatcacttgttgaggacgtacttcatgacgccggggatgtggatcctgtagaagtagtcgtcccagtcgatgttcttggggtcgaggttgaagagggcggcggcggcggacgacggcggcgtggccatggacagccgaagcttctccatgttgaggtcgtcgaagcaggccttgaagagggcgaaggggccgtagaggtcgacgagctgcatgacgaaggagtacttgcgggagaggtcggcgtagcggcgggcgaagaggaggccgaagcagaggagggagaggaggcggaggagctggagggggagcgcgtaggccaccgccatgaacgccctgaaggaggcgatggtgcggaagaagtagacgggccgcgtgcgcaccgccaccccgtccttccccaccctagggttctccaggaagtagcgccaccccgtccggtacagcaccgcgtacgccgccgggtgccgcatcgacgacgtcacgtggtacaccgccatctccgacgatgaccccctcgagtgcgccaccatcgccgccatcatcgcgttcaccaccaggtcaccaggcacctgcaatatgtatcagcgtcagagatcgatcgtcagagatgttgaaggatgaattgaagctatggatacttactacgtccatgatgaggtcgaggtcggcgaggaagcaggagaggctctgcttggcgtagccgatgatgatggcgtcgatggtgcgggtgccctcgatccagccggggagagggtccctgtggacgctggtgatgatgctggggcgggcgatcaccacggggatcccgtggcggcggccggcgccggcgaccagctgctcctgaagcatcatctcccccatggccttggtgaacacgtaggtgttgggccacccgaagtggcgcgccctggctaaacccagatccttca

SEQ ID NO: 56248 - DNA, 1512 bp, Oryza sativa
caatttcatatatttttctcactagcttagcttaacttgcatgttaatttgtcgagtgtccgttctaatctcatcgatctcagcttacctgtggagacatggaggaacacctcgagattggcacacttcttggcaagctggcacaggtacttcacccccatcacgttcacatccagagccacgtcgtacctgaacatcacatatatatggattgatcgatcgatcgaccattcatgttcatgtctgaataattttcagatcaaacaacgaccgacctttcgtagaagttggtggtggcagctccattgacgatgatgttaaggtccttggcgagctcttgcaaggtggattcctcgaggcccaggttctgatgcatcatgtctgcagccaatggaactaccttttcatcgatgaaagactgaaaccccttgccatgctgctccttcagaagcccaaacagctccttccctatcacctgcaaccagtactccatcactatgcatatgcatgcctgtagtatacttataactacactagttttcttcagctaattatattactcttcaggcatatatatgattaattacacacacaagcaagaaagcaatcaaattaattagagaggcaaagcaattaagaggatatcacttgatgctctcatatgggccaagctgcctgcagaggtttaataacgatggaggcatgcatgtctcttggatttctcataggattcatttggtacaagtatcaaacatgcatcctcctaaggacacaaaatgaatatgacactactctggacaaaactactacaagtaaaaacctgcagtaatataatgcaattttacagcatttcactggaggacctaccgagtaaacatactgccctggccttctttttggggggtggggttggggggtctaaaatttgtagtacaaatgtactgaaaagaataataatgaatttatatttctgtccatcacattcagaaaagagtcctgctgctacggcggcaccatgttttcttctgaccacaatatagccttttggttctgtattacctgtaggctacagtagactgaattaactgcatgcatgatttcagccacaaatactacacccttcgttcgggaaaaaaaaaactactactacattgggcaggtgttccaattactatccagtaaattgtagtggaagttcagaacacagcaaattagacacatgtatcagcaaattaggctcaatttttttcttctagtcaacaattaataattcggtaatactaccatagatcaatcctttagttaacaacgtctacataacacttgattatacttcaagtacgtactccacttaaatttttagacttatatagcttgctcttattaatcttgtagcaagctccggtgagcatatgcactggtacatgtctgaaccgtgtttcccagccagaattacagatgcctgcatctgctccacattgaatttgggtctgcactgcacatcgcaagagg

SEQ ID NO: 56249 - DNA, 1479 bp, Oryza sativa
tcaagatacatgcaattatgttaagtcaaccataacacaagtatgactaaaatgctaagattgctatagaaaatgctcttttatttggcaatgggatagaaattcctgaaatttcaatttttatttgcatgtacctgctccaatcttctccttcaaaatcaattcgttccatggaatgatcagatcatccacagcaagtgagagatcactgactgtacttcgtaagtactgattcccctctattaatttaaactctttctttttctcagctttcaagttggaggaagtaataagcggtaaaacttctcggggagcctctggcagaatagcatctgagcttacagctgcttgacctacataaaaaaaatgactcaagacaaacacacacacacacacacacacacacacatatcgaagtatagtggtcatgcaactgtttatatctttggactttctagcctaggcagcaaagtgataattttggagtacatactttgttgtgccattatatggatataagctggttcagaaaagaagatatatttaataatagtcaacaaaaggaaacagtttgttcacgaatcctagtagattgtcatgagctatattaccttttactggcacccagctgctcataatgtcatcccttgtgtcatgctttctagtagaatacggttggtccatagcaactgccgcattactattagcacctgaaacataagagatgtggggtctgtgtcacacctgatagactgcatagacctaactatcctagatgacaatcctcttttcggcctataacgaattaccaactacttcatggaaaattatatatgtgatgaagcactatttttttttttgcgggggtgatgaagcactattgacacttaaacagtgaagagataaactcagaaaaaagaagtgataaaagtaatgaagttaaaaacctgtggaagcttcgttaaataagagattgagagagtgacaatctgagaaatactgcttggcaaccgagctgaaatttgatgtgatctccaatgacctaaattttggaggccggagaggtgagggcactgatagtgagtagggtccattgacaaacgaatcaggatcagataattggcctggatccccaattagatcaaccaaatactccctgccaaaatgaaaatataaagaaagatttacaacatacaccaagtcaatatcctagcaaccaatcagcattacaaaaattacaggttgatatggcaaatattccatgtggcagcaaagcataagttcatgggttatatttacaagaacactttggttaccatgtgacagtaagatcacctgggtagagaaatgctggtgtctcaaaactaggtaatagacaaggtattaaaaggataatcattcacatatcttcacaactcacaaggcatgtacctttcaagcccaaagcgtacgaggcaggaggtggcatcatcacttttg

SEQ ID NO: 56250 - DNA, 1775 bp, Oryza sativa
atcaagctatgtgtgatggtgtgtaaacaaatactagaaatagatgggagtggtgaagagatgaggtgatcacccagaagcgatgcgagagggagtcggcagaaggcgtcgggggtgggagcgggaagggcccggcggtggcggtggcagagtggccggggtcgaggaaggcggggtcggcggcggaggcggcgtcggcgcagaggcggagcgcgagggcgagctggagctggtacgtctcctcggcctgctgcgcccagctcttgcagggggagcccccgggggccccggcggcgggggcggcggcggaagggaggtggaaggggaagtcgctggaggcggagagggagctgccggcgccgtagctgctgccgctggactggcgctggagcacggcggcgtcgtcggggaactgggagaggagggagtaggaggtggtgcggcggccggtgacggcggggaggtccatggcggcggcgaaaccctagccgtggtggtgataggtaattttggtgggaaatgcgtcgggtcgggtagggagggagagaggctggccgatggtgtggtgtggctgatcgtgatcgcatcggtggtgcggagccccgtaaagtgaggagaggtgaaagccggcgcgcgcggtcgctgtttgtctcgaatcgaatcgaatcggatcgtgtctcgctcggtcggatccctcccacaaagacgtacggctgcggtgcggtcgccttgcaggaggcagggaggaacgggtgcgatcactcgctgactctcttccaggttgcaatccatcttaggccctgtttatagtttttttttaaaaaaaaaattcactctgtcacatcgaatgtttgacacatatatagagtattaaatatagataaaaaataattacataaattacgtgtaaattacgagacgaatattttaagtctaattacgccatgatttgataatgtggtactagagtaatcatttgctaataacggattaattaggcttaataaattcatctcgtaatttacaggtggaatttgtaatttgttttgttattagtctacgtttaatactttaaatgtgtgcccatatatccgatgtgacacgtaaaaacttttcacccctgaactaaacaggtccttatatgaatttgacacatatattgttttctagtgaagttacttcctagcatttctctatagcaaagttggatagaattgaagtattctatagtgatcctaaactattttgctacctaatacacgatttgattgaatattttctagtacaataaatttaaacaaagagcaaggagtgtccaatcatataaactaggtagtaacattttcgataaatgaggtgtttgtttaattttgaagtaccaggttgagagacacctttttaatataaacatccaatcacataagtacaatgagtaatccaaggcacaatttttaacaatttgaccctttacaaaaacttattacaagaataaaccgtgtcaaaaacttatttaaaaaatgaaccacgaactcagtgccatcggaagtggcgttgagatccaacatctcagcgccactatttttggtgctaacctccatccgaggtatcataagctagccacatcatcaagggtcagcgccactctcattggcgccgaccttttcaaagcctaaaaggctctattggtgattcctacttgaaatgtactactagtgtagtggttagcttcattggtttttagcactaggtcttgggttcaaagccttgaactagca

SEQ ID NO: 56251 - DNA, 1745 bp, Oryza sativa
aagttacacgcatgggttcgaacccgagacctttgcttttgaaggaaaccacctcaaccaccgagctatcataaagggaggttaaaatttcaacctatacagaggtcaccaccgagctatcataaagggaggttaacatttcaacctatacagaggtcaacgccaatgagagtggcgctgacctttgatgatgtggctaacttatgacacctcggactgagtttagcgccaaaattggtggcgctgaaatgttagatctcagcgccagttcatttttgaaataaatttttgacacggtttattcttataataaatttttgtaaagagtcaaactgtcaaaatttgtgaatccaaggagtgtttcagacacgttcactgcaatcgcaccgcaccgcaccgcatcccgcatcccgcagcaggccagcagccgatcgcgagtgtctagtagtactactactcggcaccgagagctgcattcccgagctccaggttccagcaaagtagggtttagggtccttaggtttaggaggaggaggaggaggcggcggcggtgagaaggagagtgggatatggacggcgacggcgacgacggcggcgactggaccaaggtcacatataaaagtaccccaccgtcctctgcctcgagtagtgacagcgggggacgcggccgcgggcgcgggcgcggcggccgcggccgcgggcgccgtggcggcgggcccgggccccggtccggcaggaatggcggcggctgggacaagcgtggcaagaatagcagcggcagcgaccacgagagtgtcggaagtggaacccccccctgcaactccgtcgagagcttcgacacctgtaccctcccctgtgccttccccgtcatctacgttccctgatttcgcggaggaatacatccgtcactccttcctggttaggcttacccaatcttcggatgccagggtggccgagaggttcatgcagtttctggtcaagtatgttcttttctcatttaccttctttgcgaatctatccatatgatgtatatttgacttaatatttctatttctatagctacactgcccccggcgatcaactcccattttacccaacagaagctagagcccttctgcaaaggaaaaactctgattgtcatgagttgttggtgcacttcgaccacctgagagagatggacaaaatactcgccttccacatgtgcaacaaccagaacaggtaaatacatttatatctactatgcactgtgatagtgtggcctcttgagtttgccttgctgaatcgatttgtggatcacgcttaccttgttctattggaggtagcaagtcatcaaggccgaatcgtttaggtttttgttctttttttaaaaaaaaacatttgtatttgatgcttttggtgctctcatgattgggattaatttgggttgcgcgggatttatttatatggcttgtgcatgtcagatttaacagatgatttagctatagttgatgtgtatactggtctgatatggatggtttagagttagctttggtgtgctgataatgtacatttagcgtagcttcttcatatttagctctgattttatttggatctgatattagtatgagggctgccattaatattatgtgtagagtagcatgggtgattttgttttagtggtgctggagtagatttttatgaggccatgacgtgtggttagaagtttttggacactttttcttgtgacccatgatggctgaaggggg

SEQ ID NO: 56252 - DNA, 1745 bp, Oryza sativa
ccggggactgtgttgttgtttctctccctttcttcgatgtgtctgttgtgaattttacttctctctgattgtttactgcttcttaggatattctgcacttatgagattatgtatcagtcacagattaaagttagtaggaaaaaaattagagcttggattattgtatgggaagtgtctgaactagtcagtgcaactatagtctttatattgtgagctaaatttctctaggttatgtagattttgggaaacataggcatataagatttcaagaggtatctatatcaacattgagcatataatatccgaacataactgcataagcatcatatattgatatttatgctttaaatttgttcttgtgagaagatttctggttgagttcacgtgatgtagtcttgatcacgggattgttttgcttttctgagaagctttcttgtctctctctgatgttgggcttttatttgcagtctattaggctcagcggtctgaaaagtgtttgggcttgtcaacatggttgagatgttttttgggctctgtatggacttcttttgggttttggttgtttgttgggcttgtttttaactagtctttcatgattgattgtctatatttgtgggctgtttaatgtgctgcagtacaattatatttgggcctgagattatatttgggtttttcaactagtcttttcttattgctcacatgatctctctctttcaggctagctcccatactatcgtgtgttgcatcacagttccttctgaacatctcccttcaagatgacgtctcagaagaaactcgcgaggagaaagtgataaagcacaagccaacgattgaatctaaagtgatactcagatttatcggcatgccaaattacaggtactccctccgtcgcaaaatataacaacttctagcactcagaatttgtcctaaaatataacaacttctccactaacattctcttcccaaccaatcacaactctccaccaatccattcacttttcccacctacctccatttctcgaccaatcacaacatcttcccatttaattctacctactttcttaataattgtgtccaaccctaaaacttcttatattttgggatagaggtagtaactgattaatatcatttagtgtccattaaaaggaatatatatttttcaaataaatgtatttatattgaattcacttgcaggattaccactctgaaagaattcctggtgaaaaatcaggatgcacttgttgaaaaagtgaggctcttttcaaaggataatgtgctggtaccagcaaaacttggaagctcattattccaatgttgcatcttgcacctcattgcaaaccataagatgggagttagctggaacggagaatttgagctaactgattgggaaatatctgatgatatggtatctctaaaaaaggttcaccatgggcctttacctgatgactcaaaagttgcagatcttgagaagctggtggatttattggctccgttctttttgaagaagggctctcccttattcttcaaacaattgaaggacgatgtgacccttacatctagaacattggtcagtgctagtgattgggaatggttctgggattatcttggctcacatgtgttctatatgcctccagtcgctcgactgcatcttatcaaagacctctttgtggctatcaaaacattcaaattgacttgggtgaaacctttctccactgtacttctagattttactgaatttggtgatt

SEQ ID NO: 56253 - DNA, 1904 bp, Oryza sativa
gaggagaatattactgatattgttgacgctgagctctttgcatccaacagttaccaagattttctcccacaatttctgcagcgtgtttcttcagcctgtctaatgcagggcaagtaagttctgtttttgtgtgtgtaccagtattcatctgaacttgtttatcaacaagttatatgtaatttttgtaggtttaaatcatcttgggatgccttcaagggttccggtgagactaatttaaatatttttgttctcttttgaacaagctgcattatattgcttctagattattataaataacactaacatgttagtttatgttcttgctacaattgagtaatctcaggtcgatgtgatatttcaggcaacgtcaacctggctgcataggttgtgatgacaaatcgactactaagaactgaggaagtgattgatggaaaaagaaactaaattgctcatgatactttttttggccatagtgagatgaagtgcttttagcaatgaaccttgttacattttttggatgtaggattgatagatctcttgtggcttatgtcagactcaacatgtttagaatgataattgattttcacacttgacagtgacgactatggcttacatgttcagactggcaattgatctggccagatatgtcatggtttatatagaagagttaacatgttcatgttgacaaatgatgcagccattaggcagttgacgatggaggtctcacttggtataacaagagagttggatgattgctgtaggcccaagcttccctgtgtagtatgctcttttggctgttgataagtcgggtactggatcgaaagctgaaaatcccagcatgcaaagaccttgttatgatccttctgaaaagttggtccttcgtactttgtggatattaggaatagttcaagctgataccacctccgtatattatagggcatttttcttttggaaatatgaatatattaatatagtttttttttagagaaaccgagagatttatattaccaaaccagtagaatcactaggtaccagccgttccagaccaggtgggcaggcgggcagcctgcccaggaagacacggtctggagattaaagccatacgcggcaagctcatgcgccaccttatcaatactagatcttggggcgcgcctttgcgcgccgcctgaacgtgcagcgaagcaatcaagcaggaaacagtagtgacgctatgaacgcgggcatagagcattatataaacacttataaacaggtgcatcagcacaacctagcagctagcacacaagtgttcatacaggtattttactggtctaatagtaataagtacatatatatatagatggtgcttgacatttgtaggacagcacaaactacatgataagcacgtaaggtgcagaactaattagcatagtaatagtgctaggggtggaaagcggtccatgtccattgtgatcaccgtgtttactggtaacaaaaggatgcatctaacataaccatgagtattgttatgttgtttagagaacatcgacattagcttgcaggcaagttgttttatagaagtggaagatgcagactgattcgagatatatgtcattgtttggctgcgaagtctgcccatcctttcatcaagttgcagcgaccgtctggtgacgtggaaaatcatgttggttgaaatacctcctgctacttgaactttaatgttgatgggatagctatacttcagtgttggaggtgtctggtacccctgcatttaatagttgattagtaatatatatatttcattatcacatccacccaaaatcccttatatttatctagttgtattgacaatgataaaaaaaaataataattactaccgcatagtaatcaaatatggaaggtaaaatgaaacagattagtaaaga

SEQ ID NO: 56254 - DNA, 1357 bp, Oryza sativa
agcactgactatttgtgttcatatgaaaaaactataattgatttgaagacatggaccagctgctggtcataggatgatcactctgtatccttgcctaacatgtgctgaaaatgattaggatagcaaaatctgcataataaaaaaattacttaaggggaaattagtatgttgtgtagccagaagcaaagattatctattaaacaacgctaaaattcaagctagctagagtggcgtgccttgagaaaccattgcatcaataacgataacaatggcatgcaagaaatggttagattgcatcagaataggcagatgtaccataattagaccgataaatttgagaaaataattccgtagatgataactatagatgggagaaaccatggtaacgtgcaggctaaaatatattgagtaggaaatctagcatccatatacaaataatattggcatatcggatagaacctattgcaaataccggaattgcgacatcaaacgtcgacagagctgataaagcaccagaaccagatggcttcactggggcattctttaaagtttgttgggaaatcatcaaggaggacatcccactggtgttcaactccatcttcaatcttaggtgtgcgcacctcaacctaatcaactcagcgaacattgtcctaatcccaaaaaaggatggggccgagagtgtttcgaactacagaccgattagcctgatccatagcattgccaagatcttctcaaagttgcttgcgttgcgtcttaggccccacatgcatgccttgatctcggtcaaccaaagtgctttcataaaagggagaagtatccatgacaacttccttttcgtgcggaacatggccagaagatatcatcgcttgagacgggcaatgttgcttttcaagcttgacataacgaaggctttcgactcggtgtgttgggattacctcctggccttgctgcagcaaaggggcttcccgacgaggtgggtggattggctaggggctctgctatccacttccacctcccaagtcctcctcaatggctcgccggggcaacgaatcaagcatggaagaggacttcggcaaggggaccccctctcgccgcttctcttcattttggctctacagcgtattctctccaaggcaatagagctaggctcaatctcaaaacttcggggaagaacgactcgagtgcggatctcgatgtatgcagatgatgctgtcatcttcattaatcccacctgaggcgatgtcacggctttcgcggacatcctacatcgtttcggcacagccactggacttgtcaccaaccttcaaaaatcacaggtcgtggccatcagatgtgacagcatagacctgggctgcag

SEQ ID NO: 56255 - DNA, 910 bp, Oryza sativa
caaattccattcttgccttatcatccaaaatagagtttggacatctgaccgccttgcgacaagaggctggcaaaataatggacattgccctctctgtcgttctgaacttgagacaggaatacaccttgtcggcaggtgcagatacacgaagagaatctggagcctagttgcttcttggacgggttatcagcaattggagcccactgagtgggaggaagcacggtcagtccaacattggtgggggagtttagcaaatacacccggcgtcccaaaaaagggccttcgatccctcattctgctagtcgtttgggaaatctggaaggagaggaacagatagatcttcgaccacaaagagatggcaaaaggcttcctcctatcaagaatcaaggatgaggctagtctttgggctctagcgggagctaaaagattgtgcgatctagtcccacattttgtatagtgtatagctcatagttctctttctttacccttaggggttgtattttctcctgctctattcaatgaaaaggcacacctgtgctgttttctgttaaaaaaaacaaatataataatgcaaagacccatggtatattaatataacttgctcaaaatgcaataaacaacacataaaattcttctagtgtcgtcgatctaactaacgagcttaagaagcatggtatatcagtatatatagttctttgtgcaaatgatccatgaattttaaagactaaacaagagcaaattggtttaagagtataaatatcaaaggtcaaaatcactatacaacatgctttagtggactttggctttggaggagagggaagcaaacagagaaagacagacacaaccttacctcacgtcatagaattttatgtctcatgcgaactacccgatgatctactgcaccctcata

SEQ ID NO: 56256 - DNA, 3469 bp, Oryza sativa
ccagatcccctagagttagactacaactctaccaggtggagttgtcatgatccatgacattccgtatacttcaagggttgggattaagccgccttaatttttactacataaaaatcagtaactaaacattcaataaatagacttgcatcaacattgtcaccagataatttctgtagaattatagaattaatacataaatttcatgcttcatctattgtataaaaatcatacattggtatcgttcacttttgcatgtatgggaaagcactatattggcatacaatgccgcataggattgatcgactgtatgtgttgcttaaaaacaaaaagttgttgtgttaatttgtttagaacttaatcaaatcactattacaaaggaaaaccttaaaaataaaattctccgaacacttaaccattaatttaaggataatttattaagtgaaattgacgaggcatgatctcaaccgtatagaaataacggatggcatagatttagccaactccactcgatacatttgtacccaactctaggggatccagaccccaatatcacgatgacccctttgaatcatgttctacacattgtagttccatttactgctgattgcgacaaataagcagaatcctatattttaaatacttcttctgtgctaacttagattcaatatgcaccttccatatcaagtctcttataagatgcatatgcctaagttagaaaaggccaaaggagtccagagaatcctagctagcgttaggattagtttagacaactgtccttatcagaaccaaatgtaattaactacacaagaagagtgtctatacttgtattggtacttaattttgatatcacagagaatacataaatactgttttcagctaatcaaacatcatgtacctgtcaataaaataattccaaatttggtcacctttggcatgtaaagatgagtgatttctcctaagacttcaaaatacctgtgaataaattactctagccgttggttttggagaagccgtcgtctacgtacgtctgctcctgctcgtatgccgccaccgacgtggggggcgaggcgagcgccagcggcggtgccgacttgggtgacctgggaggggagttgtgactgctgcggattcacggaggattgcaaggccccatatatcgctggcatgcgggcgccgtacgagaggatcgaggtgggtctgcgggctctgcacggacgccatcgacgacgagcttggctgcacctcttcgcccatttcgccggcggaggcgctcgaccgcgcgccgcgccttcatctgcggcgtcggatgagtctccaccgcgccactgttggcggccaagagcgcggacgggattgatattcgtcgtctttcttctcttgctccgccgtaggctcgctggccccgttaccgggaggcgtcgagaagggatcgattggaaggggaagatatgaggcatgaggtcaaccctttgggatccataccgccaaccatcgctctacgtcgcgccttccccatcacctcgtcaatcggtgacccccgtccccttcgcgctctccccgtcgcccattcagatcccactcgcgcgcttcgccatcgatcgctgaatcctccccggcccgacgacaggaagcatcgccgcgtctagcccgaagaccggccgtcgaccactcaacagccggcccgtgtctgcatgcagccgtgcaccgagcccacgcagttcccaattgccaccaccacatctcaggccacttggacaacaacatcgagcgccacctcctcggttcacggtaaaatccattttccccatcctcctttctattcctcctatctaatgatattttgaggtttttttttctcctcatctccattatgggtacatctctgtgaagctataaaatacagagagattagcaacactaatatgcatgcctttgtcttttgtaaactgtcaggattaataaatagtatatgtcttagtatagttctgaatttatacctgagactgtcaaaaacagggcacggctatgccctatgtggttaacttatatggatcagtccatgtatgtgcccaattgtataacatatagcttgttatatttgtcagttgataaatatatgaatatatgtatcatatataccatttaatgtcatttttcacttaaatccattgttaactatcaacaccagtattttcttttaatcctctacatgcctatgattttccatctaattccttctccatatgtaacaacagtcattatatagaatatactcatgaatgatttgttgcactctgttgatgtaggaaactgtaataatgatacctggaatcatggttattgacaatataaatctcacttaacttaaatttgaagtcccataaaatacacattaagatttagacaaaatttgcattgtaccgaatgagtctattaaaaatcgcaacataccagaaatgtctacttgaatgttgtgcagaatatgtggttcagattgaaaaatggatgtttctttggtaggccatacagcatccatgatgagcaattgggtggtacctgggtaattcaaatgtcagttctatcctaactttttttcgcacaaagataaattgctatacaagcttgttgacaatcaatattgctacatctcaccattagggcagatattcataatttctgcagcgcagaactggtgacaatttggttattagttatctttatctcgcatttcagttttccatagaattacaaaactggtgatttctcattggtgctttaaaagttgcggcactggtttatcacagagaaggtgtgattgttgctctcaagaggagtaagttcgctgggttgatggttcttttttttgttgttttgagtttccctagtctttatacgagtgtacattccagttttcaatgctgaggtgggctatccctagagtttggtttattagaatatccgtgagctgtctcggtttactctcttgttttgaagcggagattgaaacctttcgttatcaaaactgagatatgtgttgtctatagaacatcagggctatatagtacaagttttctaactatggatgcactaaaatgttggatcaactgattatttttgtttctgttcatccataagtcccatagaaactgacattgtttcactttatattttcaaatgtgctttgtaaaagttttgacccatgtgcagcaaaattcagggacattacctccgcaacgctagacaagcccctgtggttgctcatgaagatggtctcctcgttcggtgtttcccgtcactccatcccccgtctctcctaggctccaacgtgcggtgaagcaccctgtgcccctgtcctacctcacgacatagaaacaacgggtgctccaccccaccgctcatccttcctccatgaatggcagcggattacaaggatacagtacagaggatggagttgccatgggggtgcagg

SEQ ID NO: 56257 - DNA, 2104 bp, Oryza sativa
gtgccaaacacaggggcagaagcagtagcaacagaaacagctcgaatgatgagattgaggtggattagctggaaatctggtgcttaacagaagctcaaatgaaatgatgccacaaaagtgggtcagcgtgaggggtgatccgcagcagcaactgcaatgatgctgtcgcggccatgacatgtaggtggattagtgtgaagttgacaacctgacgcgctgcacaagtaaattttggtcaaatgtttgtgttcatccctcagtcaccattaatcgtggataaggtgcttacacagaataaattccaagtccagctctggccttgtcaaccgatcatcctcgcaatcgagatcttcgggggtctgatatttgtatttttggttcaatcgaagggaaatgatctttctgttcatagaaggccagcttgtatgttaaaaaggagtgtattgtttcattacgagggaaagcaataggtgacgctgccattgagttactgttgttttttggcaaacttgtttcatcttccgaggactagagattttgtacctaaaaagaactgataatagaacatcatggaggcagaattaaactagttacttatggcttgcttgcttgatgtgggagttcttcattgtagttcgatgttccttcctccttgccattgtgatgcgtaaaattgttttgtcgtcggaagttgttaattcggcagatgatagatctgagtattatataattctgtaattaattgtgaaactgtaggcatcagtaataagcgattccattcccacctgatagatcctggtgaatagctcaatgatttgcctctcatggattcctggtacaagtcaatgttacgaaagaggccatttggattaataaatgtcccttcagtcatgacttatgttactaatcacttgatgaaacaatgcggtcaagtcgagttgcttgttaatgtggtagcttgatgcacgttactccattgtaatactagtacattttagcatgtctgatgcttccgttttgcgtaacagcaatggttgggcttaactaagctaatgcccagtgggagaagacagcagccgaccgccccaccctggtctagagtattagcggaatactaacttgattatataaataaattcaatttctttttcaaaaaataaacacaataaatggcttaaaacaagtaatgcaatggtcaatggaaaagaacacttcttaatagaacttttttttaaagagtgaagtaaataagctgtttcaacaagccgataaataacctgaaaagaaaatggctcatttcaacagtcgaacgccacctaccgcttatggagtttgtggttgcagatggttccccttgctacctctgtcggtcagccccaaccaccaaaccaaccacagccatattcccatcctatcaacatcaaccttacggagtacgtgctgccatggatgcatgtttgtttctcccagtactcaccaaactgtcttctatgttctatctgtaccatctacagtactatgtgtgtactcaaagtaatggcatgccatatcgatcagtgaattcattcattttttttttctcagcaacaagagagccaaacatttgtgagcagacaagatcacaggacagcagaaatgtggtggttgttttgattgttttaggcagctcttccattccaagatgtaaaattcgacttactgagaacatcatcatgatgtaaatccgcacccgcgaccgcaatcaaacattaggaggtcttcctcccctctctccaattttggtcacaaaaatttcaaaggaaaacaagaagaagaaagaagcaaattaaccaacaaaaatttgagcatttcttgagataactgtattcaactaccaataacagcagcagcatcagtcttgttgatcaatcagctgctgctggtgtcgccggcggtttggccggaggaggaatactcccagggcgtcatgtccatggggtagctgccgagcacccggaggaaggaggtgaactcctgtatctccgacagcgcgttctgcgccctgacctccgccatggacgcctggaagtcgatgtagaacatgtactcgaagtgcttggccgtg

SEQ ID NO: 56258 - DNA, 2625 bp, Oryza sativa
aaacaatcactgaccagtgatcgatacaacaatacgtttcccatctctacggtctacgcccacgtttcacatcttgtctaatattagctccgtttctaaatatttaataccgttgattttttaagcacatatttaaccgtttatctattcaaaatattttatgacatatgtaaaactatatgtatatatataagtatatttaacaatgaattaaatgataaaaaaaattaataattacttaatttttttaataagacgaacaatcaaacatatttaaaaaagtcaacgacgtcgaatatttaagaaaacgaagggagtactagctagctttagagcaagtataatagtaggctataagctggctaaatgctgaggtgtaagagagaagagaggagaagcgagcttgacggagcgcggcgctcctcaccgggagaccgcacaggcccccctttgccggttcggccgggggctcagggtgagatctcaagctctccgtgtatgcgggaagatcgcgacctcccaaaagagcatgaaacacaagcgatgtatacaggttcaggccgctgagaagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaaggggataccacatgcacccctctctttccaaactggacttttcttctcttcataaatggacggagatttgcacggtcgtcctccgaacatcctcctgacgggacgacacacacctacctccacttctgcctgaggcgggcacgtcgtgggaaggcggctgtgtgctgacgacatgagcagtgtcagaccggtcacaaatcggtcattcttgtccaccacgcgtcggcttagcaacgtgcatgcttgcccttcttcaaacaacatcttgcttgtaatggttaggatgaagcctggcatatatcgatcggggctaacgtgtcatctctgggatgtaacacgctagctccagccggagacgagtgcctagaagctctcgtcttgacgggatggggcgaagcgtgcgtcagaccgcctgtcgccacctaacccgcgatttgaccggtctgtgactggtcacagaccggataatcgagtgcactgcactgcacttcgtgcggcgtgacacgcttaaccgaggcgcaataaatgcggttaggtgagccccgctgtgctcacctaacccatacacgtggagtagaaacgcgaggggtcggggcgcctcggccctcgggggcgaggcaagagtggtccaaccccccccctcggggagaccaagaggtgggcgcacacatcaccctcgggcccgacgtcccccgagggtgccaggccacgtgggcgatggtgtctgcctcaagcctctagtcatgatactcccggtcccatgtcaccgacagagctgtaaacttacagtcagcttggacacaataaccaagaaactctatgagagatacaagtaggcactgtattaactataaagagctaactattatatgggtaggctgagagaagactataaaaaaccttatagccaacctgttggctgtattattagccttgctcttattgcatgggctcttcctgcaccgtctccatcaccgtgaactactccttgctccgttcttcttcttcttccatttttttactttgggtagtgcaattcaaacattaagtgatgggtgtagtatatatgatcgatttaattcagtgggacgacacgtgtgtttgctttcttgcttttcgagttttcggtcaaacctagctaggagttacttcctccgttcccaaaaaaaaacaatctaagtgtggatagaacattacctagaacacaaatctggacatcacaacgaatatggatattctgatgtccagatttgttatcctaggtggtgttctatcctcaccaatgtttttttttggacggagggagtaacccctacgtatggaattagtcttagcttttattgaggacaagaattagtctttgtgtttgaatctcctgaaaatgaagatgaagataaatattaagtgtttcacgtaaaatgaggtggtaataacatgtgattaattaagttttaattattacaaacttcaaaaatggattaatatgatattttagaacaactttcatatagaaagttttcgcacgaaacacatcgtttagcagtttaaaaagcgtgtcacgataatccaaattttatcctctcttagtaggagaaacgatcagggctacatgtcccctaaaattacttgtagcaaggtcctatttgattaaagcaatgtcagaggaattttaaggatttcattcctatgaaactatttttctagacaaccctttaaataaaggaatggacacaattaaatcctatgaaatttttatataatatgcctcatgccatataagtttaggagaaaatctaacatgaggtagaatgtcatggaaatttttctttaatgttttttatcctcctatagttctcacgtttttcccgcggtttaatcaaaatattatttctatgcttcgtaattattta

SEQ ID NO: 56259 - DNA, 1161 bp, Oryza sativa
tatgactaatactcaagctaaaattttcatgattattaatatagacctaattataaatgcttgaattttagcttttcaccaaaacttggtgagcattaataaccagcctatgccatatatctttctcgaacccttgaggagatgtatttcctacctcaaatgtgtgtgacattatattgaagatcctttgtcttttaaataatttgtacacgtgaaaggttaaaaatatatttacatgtaattatttttcattaaaaaaatctaattaacaatattttgatatgtcttgttttagaacgaatgatttcttttaatacttgattttacgcttatcgcttgcagccaaaaattggccttttaatttgacttgttttcgatgttttcaagtgtatttatttttcagcattagctttcatgtcataagaacacatatataaaaaatttacctataaatatttttcggtgaaaatgttactgctcataattaattaatgagccttcaaaagaaaacggtgtgcttacatttcatagaaacattttcttgtcaaatattgtcacaagtatagttagctttttaacaccacagaaactatggaaccatacttatggcatcgaagtttgacaagttcacggagccaaccaaacatgctccgttccggctgtaaaaccaagatagcgagaaaccgcgaggagcagacgagcagtctacacgctttgtcctctctgttttttttttttggcctggatcttctacgccctttcaggatctcgtgctccacttcttcttcctactgaactaactgctcttcttgtactctctctctctcgcctccaattcaccgacgtctctttggcttttgctgttgaactttatgcagcacatacatacatgcatactggtcgcctactagctagtatggttgcggagccacagtctctgccatgcctgcaaatttgtggtgttcaaagatcacaaagggatcaaaagattcaatacaattgtacccaaagaaggatcccgagacccctaccaacggaaaagctgcattaatctgcataccagtatgaaagtttaggtccattctttttcccctagctttgccggtgtacaaacagggagatgaacgtactgtccaaccatctttcatgttccaagcttaa

SEQ ID NO: 56260 - DNA, 9190 bp, Oryza sativa
catctcgaagactgtgtcgagatccaaaaatgcttatattttgggatggagggagtattgtttaattttcttatatagtcatattgtatatataggtgatggactcaataaatatatttgggtcagatcttcatgggccaagcctaaaggtttttcaacacttttgtccggttgagtgatacttatcggcctcaataaatatattgtttcctagtgaagctactttctagaatttctctatagtggaggtgaattttcatcccacgaggggacatccccctcgttgtttgcatgtcatcttggcattcgccgccgccgccgctttctcttgccgacggagtggccatggacaggaggaaacagggtggcgtacatgatgcccatttgcgccatgatctgatcgcctcctggttttcaagcagcagacgactggatttatctcgaaaatgctttacaacggacgttcgatacgacgcaaaaaaatcggacataccaccgagtggaggcgtcaaccactcattcttctctctttctatcccctcaataccgtagcactgtatctcactcgtgtcttcccccttcttcgccggacgcacgcctcccctcctcctcctcctcctccacatccggccatcgccgcctcccatcatcctcctcctctagccgccgcacctcccccctccccctctccttcggccgacgccgccttccctcctcctcctcctccggacgccgcgccacccctcctcctactccggctgccactcctcttttcccattggcggcggcgctcccttcggctgggcgtggccggcgagcttccgtcctcttcgctggatggggtggcacgtgtagggcgacgagcttggggggcgtatctcgcggcgttggctctccccccaccggcgtcccctccctgcaaatcgaggcgcagggcgacgtgatcccctgcggcggcgcaaatcggctgcagccggcgcggggcctatctcgctctccagatccggccagacgcagagcggtggtggtggcagcgggggtgttcgctcgccgaagccatgccgcgcgaggacggcggccggagttgagggtggtggccggagttgaagacacgaaggtgggtttagttttgtgattcactttgttgtatttaaggtgttttattttgttttgattcgatattgcatatattgattttacatgttgcaatcgatatgttttgattgaatttggttgaaacactttcgtctatgcgatgaaacatttttctctggttgatgaaacatgtgaacatttttcaatgaaacattttgcaacaaccgtatgatgtttcagctttttatattttttgttgcactttattgtattaaggtgtttcattccattttgactttgatgtttgcatgaatttgatttcttggtgttacaatgcgccagtccatattgttgaatattgcatttagttgaaacaatcttcctcaaacgctgaaacatttttctctgggagtgaaacatctgaaacattttcattgaaacatttttttctgagggatgaaacatgtgaaacattcctcgataacatggtgcaacatcgtccggcgatttgcaccagatcggacatccgatccatagcagcctccggtttatctgctatctatctgcacatgtacaataaatagaagagaagagcttcaatcgcaatcggaatcggaatcgagtccgagccttacggcgtaccggagtgaggaagagaaaggggaagtggcggcttctatctctactgcggtcttaattgattgatgcatgggcctctgttccagcccatacacccgacctgctgagatacaaaggaataagctcatttgaagtacctggatgtggattttcttccctcgatgggacgtcccctcgttgtttgcatgtcatctaaatagttattaaaaaatttgaaaaaaattgatatatttcaaattaatctatgttaccaaattgtttttcatattttttttatgtctatttaggtgacatgcacgaaatgagaggatatcccatatattccctcgagtgatgatttcactttccggaagtaccttaacttctacagtgagaggaggaaaaagaacaaaatcgaacaaagctgcaaagtttgacagattaattaaagaatcatcattactgcgatgcgaccattagcgttgagtattacatctctctagccagcgtcgccgatcatcaccggcggtagcactggacgtgcaggaagaatcctccgggaggatggcccttgctggccatcacctcgtgtgctacaagtgctacagtaatctacatttactaatgacggattgattataatcttttgtgtatgtttttctattataaactcttctattataaaattttaatgtgtttctgtaaaaaaaaatccgtatttttttccatcgtcgtgtcggtttatttcccacacgacgcaaccgcgctcactcagccaatctacgcattcgcttacagatacacgcgcgcccagctgaccatctgccccttaggctcttggctgccgcagctggacaatggccatgcctcacctgagccaaatggtctaatgggtttttcttttttttattattctctgttttcacctactcactttgatatatcttggtataaataaactggatgagatattatacaatatgtatggtaaatcccataactttatcaagccatgcatttttcatgtgacgtttgtggtgtgtattttttttccactgaaccacttttagctactccctccgtctcaaaatataagcatttttagcatagtgccaagtcaaccatttttaattttgactattgaaaggaaaaaaataaaaaaatatcaataatgtaaaattgatgttactagatttataattaatcaaactattataatatgcaactctttttatttataacattttatttttatagatattattggtcaaaataacatctcaaagaccgtgtcgagatccaaaaaatgcttatattttgggatagatgggatggaaggagtattgtttaattttctttcactgattcacctattgcatatgtaatacttctttttaagaaaatagctggcacatatttttcttaattatttttcttttttgttttccttaatttttggtgcatcttacgtttgtcgtcggcacatcccctcttatcatcgtaatattttctctcttttctcgctctgtccataagtcttgtatcagttttcttccagagttcttgtggacaacacatgaaaagagatgtcctgtacataaaaattacaactatgcctataaaagcccaagcattatgggcaagaatatgtagtacattttgattttctatactcactgtgatgatgcaaaaattgatttccctttggacttaattttggaattcaggagagagtgccatgtccccgcaaaaaaaaaaagaaaggagagagtgccatggaaatggtgtccagtgttgctcaatgctgatagtgttctttcaacggcaaaatgtattgtgtctttttgccagaggtcgacgaaaaccatgaggccaggagattggtgagtgaggttgatgacgttggttgtgcgatggtcgaagtaggagagacctagcaatggtggcactgttgccccaaggttgaagtgggtggtggtccattgctaggtgtgggagttgtagaggtggagctcgtattcccctggtggcctaaacctgttgacagaaagcgcggtgacgatgtagcgttgtttgttgctgatgaggggttcgttaatgtcctgaggttcagggatgtagtgcaggatggagacctcgtggttagtgaaggtgatcatagggccgggatgggtgatgcgcgtgagagacggcgggatatcatcagcaatggaggccgcctatttattgtatgtgtagcagatagatagcagataaatccagtaggctgctagctacttgaaagccaggaggcgatcagatcatggcgcaaatgggcatcatgtacacctccctgtatcctcctgtccacggccgctccctcggcaagagaaagcggcggcggcggcggatgccaagatgggtactcctcgacaagctcgcctacttctctgacgccgacgtccgcaacgccaccaccgacctccaaaacaagggagggccatgaaatccaggtcaccttgtgcaccgccgcttgcccgccgctcgtctcctacgtgtgcgtccactctcccaccctcaaccctaaaaccaattacttcgccatggagccccagatcatcgccgcacacgatgacctcctcctcatccgcctcatcctcggcataggtaacaggttcaccgatccctcgccgactacttcgtcgaagtaacagagcttcaatcgcaatcggaatcggaatcgagtcggacggcgtccgaaaggggaagtggcgggcttctctctaccgcggccttaattgatgcatgggcctctattccagcccatacatccggcctgctaagatacaaaggaaataagttcatctcaagtcccttaacaaagttgcaaagtttgatactagattaattaaagaatcatcattactgcgatgcgaatgcgaccatcacacaccattgacatctctctaaccagcgccgccgatcatcaccggcggtagcattggacgtgcaggaagaatcctccgggaggatggcccttgctggccatcacctcgtccatccacaccctcccgccgtctccgtctccgtctccgtcgcgcgccttcaccatgaactgcgccccgccgccgccgccgccggcgaaccaccagtcgtgcacgtcccacatcacctccaccaccgcgccgtccccgagcaccgccgtcctgttcccccggaagttccacttcacccgccgcgcctccaccaccttcttcccgtcgatgctcaccgccacctccccgtcccgagtcccccactcctccccgcggcacaccaccgccacctcgtgctccgccccgtcagcccggaacctgcaccgcgtgctgtgcgccaccgccgccgccgccatcgccgccggggaagccggcgccgcgcggagctgctcccgccggcttagcaacgcgcgccgcggcgcagcggcgaagcggcgtgcgagctcccgcgccgcctcgcccccgcccaggaggaccgcgagctccccgtcggcgacgacggcgaggtagtagtcgcgcgtcggctccggggacgacgacccggcggcggggtacttggcgtccgtggtgtcccagtagatggccaccaccgtgccggcctcggtgacgaacgaccgggtcccgcgcttcttgtgcaggaactgcggcgagctcgccagcgcgacggccgaccggcgaggcgtcgctgctgaagctgaaccagcagcgggcgagggggacgaccgggaggcctcgtcgacggcgacggcgaggccagtagcaccgccgggcgcggcaccggcgacggtcctggtccacatgaccctgacgaggatctccttgcgcgaagacaaggcggccttgtagacggtcgccgtggccgcctgcagcgagcggtcgagcgcggcgcccgccccggccgcggcagctgaggccgcgaggctgacggcgccgtcgccgaagcaggagaagtctcgcattgctgccagctcgacggcgacagcgagctcaattcggagagatcgatggatggatggtcacaatgggaagggagtctgcagcagcatgtgcagcgcaagaatgttgatcctagtacttgctactagtaaagaagaagaagaagagaagaaaagagggcaaatttaatggcaaaggctcatcttttgggcggatttgtgtgacttggtgattttggatgtttctgccatgattatgcccatgcatcagcatcaccgtgtttcttctctttatttttacctttctttttcaggtgaagttgcaattgcaaatgcaaatgcaattgaagtcgatcggggtagaagagcagatacaaggtatggttggttgggggagaaggcatttaaggtgagcatgtgtgtgcaatttgaccagataaccactactaccatccgacccgctgttgctagtcatctgcgtcgtggcagccaggaacctctttttcttccttgcaaaaaaaaaaacaaaaaacaaaaggatggctttccacttgattaatcaagataattgtttgcatcaaaacgtttattaagttttgcaataaacagaagaacaagtacaacaagggaaactcgactgtcatgtcatgatgattatcttaggatcaaatggccacgatcgatcgtgtgaatggaccacgcaatgcaaggaatggaacagattgaactggagcaagtactcctgctatctgaaaactgaaggggcatccatccatccatcatgggcatcacgaagtgagccaggtgtcgatgggtacagttgcaggtcacaggtgtaggcaggctgatggatgctgcattcggacacgcatgtcgcatgcaagagccgacctgttcctaattaacctgtacattcttatcatggatgttacatcatactcttatcatggttgagtatatgcttgcttgcctgatcaattcttatcatggatgtttcatcatacattttatccatgtatgtaagatcacactactctttgtaaatggatgtagtagtagtagtatttggttgaccgggtctgaccgggatgaaaatggaaattgaccgaagagagaagtaattactggtcgagggaggagagagtcaagcacgaagcagacgtcgatatggtcattagtgatcgtcgacgacgatgatcctttagtccactgcagttttaattgttttggcctaacacaaataaatggtgataggagagtccaggtctgacgtgttcatgcacgcgatacaatgccggtggtattgcagccccgtagactacttcacacttggacatactcgtgcctactcctacacaaacatggtcgtcattgcagtgccgcggttatctcctcgtcgtcgtcctccattaatatttaatcatagtaatcagtgacgtgaataaagtataagtgatgtgatcaatagtccagagaaatatacagtatttgtcaagaaaaaagaggaccaagagtaaagtattaagctaaattaagcataactaagtatgtaatgtgttgtttttacgaatttttgggtggggaacccctatgtctactagtgatagtaactaacttttaaatttaaagaagtgcttgtttaaatttgtagtttaaaattattatatttcgtgactggtggtggagtataaagcagcatatgcatgcgttctgatgcaaagttgagtcctcccttgaaagactgaatgaagccaatggcatttacttggactgaagaagcatcagagcacccgcaatggtaaagtaaggtgctctctataaaacatgtacatctcagcaatagactcgattaatagtaaaccaccttaatagtatgtctacattggtatctatagctctctcatacattgcctcgtttttctctatagactatctctaaattagtagatagctttgctctctctcttcatttaatacctttcaagtagaaaaatatactgacatagatctcttgtagagagcctatagataaccattgtgggtgccctcagagatttcagtactaactctacagtagtacagtggagtcaatgaatggtcatctccgttcccttggaagtgatcaatcaattcaattattcgatgcagatatataaatgtttacatagagtcatagacgtagagacacgggatggactatgacactgttacgctgtaatgctaaacaatctctatctttgacactgatgaccattattgaacaattattatggatcgagtactagcttaattacctgacagttaattagctaggggaagaggagtatacactacagttagaatggaatggaagttaattaggagtagtagcttgatcatttgggcaacataattaacttgatggcaacggttggctcgattcgtaatactcaagttgcgacggccggaaacgtggaatagtggaaagagatggtagcaaagcagccatggcggcggtggcggtagcgcgcatctgatcttatcaagatgcaaacaaagagcagtgcccgcgaaacagcttgcatatatctctcccaaaaacatcagatatatcagaatcagcagctgccgctgcatgccggcttccaaaacacctgctacaattcttcatacctcttcttcatctctccaccaaaacccttttttaccctacacagttccgaagtgcctcagtcagaaaatgaaaggaattagtttttttttctatggaccaaaggaactagcttcttttaagcatagttacgttcttatttttttctagttgattgtccatgcttttcacttgtactagtactccaatactacttactccgttttatattataagactttttaatattgtttatattcatatatatgttaatgaatttagacatctataaagtcttataattttaaacggagggagtactgtacattcatgaaggttcttgtgttaattactggctggcttgcatctgcacgctcgtatgataagatcgagtaacctgatcgatctttgacagcatacaagaacgtttagttatgtgatgtcggtgtccgtgtggtgccagatgtgaatcggtgaacagattagggagaggaattacaaaactacagtgattcttccaaaaataaaaattaggaaaaaaaatctactagtactactggactgcaataccattaattaggtgtctatctccttcgtctaactagtccatgagtttgttctagctcctccgcacggcaacaagccagtagcagctcagctggcctctagcagccccatcgcttggctgataacggaaaattgcgaaatgagatatttacaaataaaaaataatccatgaatgaactattatatactgttcgtaatgatctaaaagaaaaaaactaaaaaataagctacgatgaactaaaatcaactctaaatatatatttcttttaaaaaaaaaataaattttggctaataagtataagtataaatgaaaagataagcatatggaaatt

SEQ ID NO: 56261 - DNA, 4471 bp, Oryza sativa
  unsure (1)..(4471): unsure at all n locations
ccgtcgttcccttaaatgtgcagtcaccgacgggtgggacccgctcgctcgtgctggcccacatatcagtgtatgcacatagagtgggtgggaatctccatccgtttgggaacacacaacacaacaactaccacccccactccgctccttccttccttcccgcatttggatttacccccaaatcttctccaagtccaatcgacctcatttcattcgattcatcgatcgctcggcgcggcttagggtttttggcggcagcgatggcgtcggagaagcacttcaagtacgtcatcctcggcggcggcgtcgcagcggtctgtgccctctctcttttttcgcttgcgcctcccaaatttgcaaatcaccttccttccgtccttctcgccctgccgccctgggaggggagtaggctgcgggagttcactgcaagatcgatgtgggattcattcgcttggatccttttatttgatcttggtctgttccggatctcgtcgaaagtacggtttttcctgttcctaatttctctctgaatattttgcagggatatgcggcacgggagttcgccaagcagggtgttaagccaggggagctcgccatcatctccaaggaggccgtatgctctctttctctctcacacacatacgcgcgcgcgcgggttgacacacaaaatgctctcttctgctctctctctttcaataggttgttcaggtgctccatatccataactgtagtacaccttcaatcgagttaagatgtctagtatgccagttttttgttatccacaaagcataacaatggcaaatgagttgtgcttatgcaatagttgcatacatcagtatgttagtggcaggcctcaactattatttgtttgctaattactgaatccacatgtttgtactaaatcttctgttgcctaggtacttttacttactggaaccatacctgttcttgttgtaagccacttgtttaagcatgtcgcaattaaccaaccttcaatctattgctggaattttgcctacaacaatgctttgctaaaaagaaaaactttgtattatggaagttgcttctgagggccaaaagaaacaattcttgtaaagccattttggcacagcaagaaatagtcctaatttgccctttgcaagttctgtcattctgtcaatttttacttgcttgttcaccaacacagcattgtgtttcttatcaaaagttctctttcaggtggctccttatgagcgccctgctctcagcaagggatacctctttcctcagagtaagtccttaacttaccgtgttctgccttttcgtgtctgacctgtgccagctctatgtcacatgtggattgatcaatttgtacgatcaaagtaacaccatttgcattctctgcgaatagatgctgcaagactcccaggatttcatgtgtgtgtcggcagtggaggagagaggcttttgcccgaatggtactcagagaaaggtattgactgccattttgctttctgcaccatatcatcttttaatgatttatttgtcattgttgaggttaattaccatcaatttgaaattcttatttttgctcaccttagtggaaatacgtcatgtaatgatttttttttattctaagcatactcctgaatcatgattgcatctgttggcaggcattgagttgatcctgagcactgaaattgtcaaagctgatcttgcctccaagactttgactagtgcagttggagcaacctttacatatgagattttgatcattgcaactggctcctcagtatgttgtgaactgtgaaatttgtttaatatcggctcattgctgtcattactatcacttgttatttacatgctctttttttatccgcttgtcaggtcatcaagctatcagattttggtactcaaggagctgattccaacaacattttatatctaagggaagtagatgatgctgacaagctggttgcagctatccaagcaaagaagggtggaaaggcagttattgtaggaggaggttacattggtctagaacttagtgctgcattgaagatcaatgattttgatgtcacgatggtgtttcctgaaccttggtgcagtaagtgtcaccactcatattttcgctaaccactgttcaactacctactacgcatcagatgaaaagaatcagttttgcccatacgattgacatgcagttatgatgtgaaacgaacttatagtggaaactttcgtgatgatgggaatctgacattgtaaaatatcttcttgtantgcctcatctcttcactgctgatatcgcggctttctatgagagttactacactaacaaaggagttaagatcgtgaagggtacagtagctgttggttttgatgctgatgctaatggtgatgtatgtacatcttccaaatccaaaatagctctgtagctctcagtgtgaatgcaaatgactgtctgctttccatcggttccctatttactaggtcacagcagttaacctgaagaatggcagtgtgcttgaagctgatattgttgttgttggtgttgggggcagaccgctgactactctctttaaaggtcaagttgctgaggagaaaggtggaattaaggttagtttgcttttaacctgtaggcttgaccacagaaggtgctagggatgtttctatcaaagaaacagtgtgtaaacaactggacgtttctttatcaaaaaacagcagctgtgcatttgctatttttcttttttgtgcaagcaactcgtttatagcatttggcccatcttgattgcattccttgaaacaattgagcatgtgcattattgtttataccttaatatctggcacgcccaaaattgtatgcagaccgatgctttctttgaaacaagtgttcctggagtctatgctgtcggtgatgtggccaccttccccatgaagatgtacaatgagttgaggagagtggaacatgttgaccatgctaggaagtctgcagagcaggctgtaaaggtgaggccattccacttgtgtttctctgaaatacagtagttgtgacgactaacaccacatagtggcctgcacttggatctgacttgatagtgatctgagttaagcaattattgaattgctcggaaaaccaccaaatgcttggtgttcatgagtatccctgattagcatggtagaatttgatcactgaaaaattctttgcactgtcattcaataatgatttgaatatattgcatgcaagaataacgttaaactggacgatgtaatgtattgtcacatggaatagaatgatctaatgcatagtcatctgataatgtattatgaaatattgaaattgcactaaagaatagtgcaaactttgtgttaatttctttgagttgtctttgcgagcagtgaaatgtcaaaaccttggagttaccaaaccacttggaatccaaaaacttcgcttgtgttgattctgattaccaacaggcaacagttgtggctacttaactcggaatagggttatcatatcttagcttgaaccctgcatctttgtttcaggcaatcaagggaaaagagtccggcgagtccgttgtggagtatgactatctgccatacttctactcccggtcattcgacctgggatggcaattctacggcgacaacgttggcgacaccatcctgttcggagacagtgacccgacctctgccaagcccaagttcgggtcctactggatcaaggacggcaaggtgttgggtgccttcctggagggtgggtcacctgatgagaacaaggccattgccaaggtcgcgaaaactcagccgcccgttgccaacatagaggagctcaagaaggaaggcctccagttcgccagcaaaatatgagatttttgtagttttgatgtacatttccacatggtactccccctattggttttctgattgtgatgcgtctgtactctgtactcctcttaaatatgggcacttgctatagctgctgagatttgaataaagaagttttctactacagcctttgcctttcacggttcaaagctactggtattgttttgtggaatggcggcggctgctgggctctcgcccaggcttgttgttacgccggggaggagaagccacagccatggacggcggcggatgtgctgcgccgcggcggcggcggcgcagggggagaggaagacgacggtgaggagcaaggagggagacgcggtggagttgtgccgggtggtgaacggcatgtggcaggtgagtggcccgtcgtggggccgctacgagacgcccgccgccgtggacgccatgctccggtacgccgacggcggcctctccaccttcgacatggctgacatttgtaagcctctcctcccgccgcattctggatacctcgcaggaaactgacacgtggggcccactcgtagtgacacgtactgtagctgcgtgaaatttaccccgtccgtgccgcgacaaatcgaagccagtaacgccttatctccct

SEQ ID NO: 56262 - DNA, 3693 bp, Oryza sativa
cggcgcctcctgtcccgcgccgcggcgtggtgcgtcccgcgaggtgctccgggggcggcggcgcggcggcggtggagacggccgcgtcgggggcgaaggtttgtacggtgagcaaccgcggggactccctggcgatatgccgggtgctcaacggcatgtggcagaccagcggcgggtggggccgcatcgaccgcgacgccgcggtggacgccatgctcgcctacgctgacgccggcctctccaccttcgacatggccgaccactgtatcaatctgcccctctttacctctaatcactctaaaccctatcgtcggcatttgtgcgaacacgtagcgtgcgtaacattgttgctggtactatgcatctactaggtgctatgcatctgttggtggcacttagttgttgctcaattgatgcccataagctgtacacctgtcccacggttatgagttgatgctattcgattgaaatcgggaaatggttttgtttcactttgaaaaaaagtttgcttcaaaaaaaaaaagttcatgtctctagctatgttcagttcagaaaaggttcatgtttcattgacgtatttagctgcacggcgtagcaagtgtaaatatatgagagttgacactaataagaataaatcaatctttctcctaatatttaatctaggagcactgagcatggtatcaacttgattttaaggcatggttactgttttggcagatggaccagcagaggatttgtatggccttttcatcaatagagttcggcgtgagcggccacctgagttgcttgaagaaatcaaggggtgagagcgatttaccatggtctttatgccactcggaggtgtgtatagctgtttttccgctgcttctaattgttattttattaatctccgcaggctaacaaagtgggtaccacctccggttaaaatgaccagaagttatgttgaggataatattaacagatctcgaaagagaatggatgtttctgccttggacatgctgcagttccattggtatgtttctgtggatttgtgtgctacttattagttatagtaacatttggatgccatttggtttattgctcagttttattacatttactgctaatcgcaaattaactacattcttagaatgttgaactgttttgttgctaaacaataaggaacctcctgtctcaagtgacttttatatcacagttcttgtacgtttgcacaatcaagtttctggtgatctatcatccagaaaagattgtgtccttccattgaccattgctcttagcttcgtagttatgctgcagtagagaccagtttagagtactacagatttttagttttgagtgtactgtggaaagtcctaaacttgagaggtgttatgataaaaacctgcggtatgtgtaatcagtcgaggaaatgcagcaatgttttatactataactactgccataatttgtaattcagctgaccttttatcataatataggtgggattatgcaaaccctggatatctggatgcactaaaacacatcacagacctaaaggaggaaggtagtattttgaacttggatcagatttttagtctacttatgtgtttcctttcgcatgtcatggtttttcagtactgacggattctcgcttcatgccttgttttgttatgtacaatgtgaaggtaagataaagacagtagctctgacaaacttcgatacagacaggctgcagataattctagaaaatggtatcccaattgtcagcaaccaggtatattttcacctaacccttatggtatatttgccttttatttgtgttaactatcatatggtccactcaatgaagtgagggatgttgtaattgccaggttcaacattctattgttgacatgcgtccgcagcgaagaatggcagaactttgccagcttactggagtaaaacttataacgtctactcctaaccccatgtcccctctccctgttttggcataacacatagttttaatgcagtattactgatgcaggtatggcacagttatgggtggtctgctgtctgagaagtttcttgacaccaatgtatctataccttttgctggacctcctctgaataccccatctttgcagaagtataagcgggtgagcattttgtatatcctatgtttgaacgagttacctccttcccaattcttgctattctcattgttgaagctgtgacagatggtggatgcctggggtggctggagcctgttccaggctttgcttcagacgttgaagaaagtatcattgaagcatggtgtttctatatcaactgttgctgtgagatacatactgaaccaggtatacatccattcaatttatcttgagatttgtctttttcttatatatatataaaatagtatcagtgaagcatttgccataactaacatgtgacctttgtcattttggttgtttatgggaatagacatctgttgcgggttcaatggtgggtgtgagactgggactctctgaacacataaaagacaccaacgccatcttctcgcttgaattagatgaagaggacatgaacagcatcactgaagcatcgaataagggaagaaatcttatggatataataggcgattgtggagacgaatacagagcataattgtgcagagagataaagagagagagaggcagagggggtagaccaatgaggcgtgtgcctgccagttttctggagttctgaaatctgatctgttttgtcatgaacgtagtgtgcagcagctatctgatcttccagtatactactactccagatcagtgtgtaaaccaacctcccaaaagaaagtggcattttataagaactgtacatacacaagacagattataatttgatatgcccattaatacggattcgatttgcgcagttagccaattaaggagtgtcgcatatgctttggttggtcatgtccagggggaggcactgcactatttcatcagcaatcatccacggaaagtggtggtgacagaccgactggcagaatcgtgccctcaccgaaagccacaatataatgcggtttgcggccaggaacagaatcttcgttcccagcataccatatcccgatcatgtaggcaaggtaccctccttgccttgcctagctgctcccatccaccatgatttgtacttttccttcatccttaccgtttatataaataataaaaaaaacggcatatattaatcagataaccaccaaatttcatgccaaataggctcctctaagatgtcacgtaaaactgccatggactgatgggcgcatacaaaatccatatcctttttctcccatattataactcaatctcatccttattagtctttgctccataaacagtcatactgaaaaaaaagggcgcataatatgatcgttcccggtaagattatacaatgtttcacaatataacaccagactgccagcatatatagtcttccaaacgtaatatcttcttgctccaaagctttctgaatattgtattgtaatacatcttgtattcccacaacaaaatcaatattgcaatacattttgtattgggaagttatttatgttttgccttgcattatgataggatctttttttttaaaaaaaaacttatggatggtaactaatttgttcgtctgtatcactgtatggtacaaatgattaagaactaaacattgccaaccagagctttatgacct

SEQ ID NO: 56263 - DNA, 1808 bp, Oryza sativa
attcctgcagccccgctgaaattagtaaacatttcataaccgatcactgccgttagagagctttacgaccggaataacttcttgcccaaaagctttttcatattgttatgttttatcatcgggatataattatgttccaagtggcattacgatggttcttttctacctatagacaacttttttttttcatttgcattggcaaaatcctattaaagttagcaaataatactcactctgtttcatattagtataggatgttttgaatctttttctagttaaactttttaaagtataagtttgaccaactttacagaaaagcataagaacattttcaacgcaaattaaatgtaatatcaaaatacatatatttaatattaaagtttgccttatagaaaaaaaagataaaaacatcttataatatggataaaacggaggtggtacatatgatcccaaaaatgatggaaccaaacaatcatatgagacacacaggtccatcacatgagacacaatggcaaagcctgttccaacctgcggagccgtacacgtgtaccacaggccgtggaatcaaccatcctgaaaaagaagagaaaggaaaaaggaaagcgagagggaataatgtaagaaaaaaaagaaaaaaaaagctttggaatgaggaggaggagtggcgtgatccgctccaccaccggcgtcgcctcgccgtggcctcttcctcttcctcttcctccgcgtataaatagattcccctcttggggccttgcctttcgctgtcagcctcagccaaactcttctcttctcttctgcctacttcccacgccacccccaccctcgccgccgattccgattccgattgcgctcgcccatggcggccgccgctctccgcgaccagctcaccgctctcctctcctccatgttctcccaggtgaccacctaccttctccctctcctctcctctcctcttcgccagacctactgcttacggttgcttgcttccaattctagctctaattaatcggtgctctcgtcgcgatctagggtttggtggacgagcagttccagcagctgcagatgctgcaggacgaggggggcaccccgggcttcgtctccgaggtcgtcaccctcttctgcgacgacgccgacaggatcatcaacgagatcgccaccctgctgtgcgtgcccccccccctgttctttcttgcctaattcgatttctccctcgtgctgccgtgctgttaccatgggattgagtttttcccccctccagcttccacccatgtgtttgatcggtttgattttttttttttaacatttgtgcagggagcaacccgtcgtcaacttcgataaggtcgacgcctacgttcatcagctcaaaggcagcagcgccaggtgatcatccccttctacttctactctacatttggtttctttctgtacaccatttgtctgatgatgcatatcttgcctgcctgtggtttgtgtatcaaatgttcaattgacatgaagttcctgcggtgcccttttttcatgtgtaaagtagcagcataacaaaccttttgtttcgcaaacaattgtggtacaaaaccgtcttattgtttgcaaccatcatactggtagggataagtggtatcccactgctcgagccaactgttgttaagcgaacaatggtatgcgtgatagataatggctctattggtctatggctatggcatttcaactaaaattatttttgctaatcatggcaaatgatttcaatttttcattttctggtgtcttttcatatatattacaaaaaacaatagggctgcaggaat

SEQ ID NO: 56264 - DNA, 2955 bp, Oryza sativa
ttcagcagcattggccaacctcactatttcccaatgaacagaacaatcattcctccccatggtgacatcggctagcctaaaaggcgaggttttgacaccatcgtcatcttggcagcctggtcaatctgaaaggattggaacaatcggatgttcaacggcaagagcaagaccatgcgggaagtgacggagcttgcggacatggaagccgcgctctgacgcgaggcaggaggagtgcccatttaagtggcggtcatctatgaagttgcgagagattggccttaggaaaccaagctcttttttccttttctttgcatgtacatagttgttgaacctatgtggaacatctaaatcctgatattaatacaaaagacacgcattttgtgtattcatgaaaataaatgagagaaacacgtaccgatgaacatagattttgagttttgtgtcacttaaactagggattggcccgtccagctttgtgcggagctagataattcacgttgttaatataaaaatatgtttttttttgagaaatcacaggaggggagagcttccccacctgaatcttccattgagaagagtgaacatgggagtacatcattacaagggccgatcacagccagcgttgtgccactaagaatggtgagaagaaagggggcgggagagagtagctttccaagcttggattacaattcaatcgccgcgcttaagtcttttagcccacaaatatgaaatttaatttttattagtattattacatgtagaagtatatttggatttcatatataactcttagcttctatttctataaggtatggatttcatatacaactcttggattctatgtctacatgcttagatttcatataaaaatattaacttttatttctactagcaaaatacccgtgcattgcaacgggttaagaaagaaaaaagagaaaatttaccattgtcaagcactttgccatgcattttttctaatgaaaaaaaaatctagattacccctaaactatcatggtcagccccctgaacacgaataccagacatttttcaccctcaactatttaaaacggacaaataacccatccttgtccatattcaatatccggaataattttggccctatgtggcattgcagtcagcattttttttctaaaagataggtgggccccacctatcatacttttccctttcccctttctctatctttttctctctctccccctccctgccatagctgaagcttgcgacgacgttagtggctgcccctatcaggcctcgtcctcctcacagcaaacacactgccgcggtgctgcttgcccacacagaaggagccccgatagcatcctacgtaccgtctcgtcgaggtgtaggccgaggaagagaagcgtgacagcggctgcctccttgagtttgagatctgcaggctccttgcggcggaggccgaggaggagatgagatttgcggctttctcaagagcgagatgccagcacgagtgcgagatgcgacaacgacagtctaggctgagaaggtggtggcggcttcttcgcagctgttgtccgtgtgtcatgctaggagacgacgacgagctcatcaccgccttcatgcaagctccagctccgccaccattgccccctccttcgtgcgagctccggctccgtcaccactgtcgtcaccttcacgtgagatctagctctctcgcctccacgctccctgaggcaagagacaatgtggtgttacactaaatatttgctaataacggattaataaggcttaataaattcgtctcgcagtttacagacatattttgtaattagttttttaatagactatatttaatactttaaatgtgtttctgtatatccgatgtgacatgacaagaaaatttcacccctagatttaaatgcagccaaaatacatcctttttaagctgaactagatattttgcgtgtgccatcacccatggtcctccgtactatcttttttgtccttttcttttggtacggcggttataaatgaatattgcacctttcttatccacactcatactatatcggcatgttttatatacgattccttatatcaggatggcttagctattggtatttgtaaaatagtgaaatatgatttaaataagccggcatgatgtgaaattgttgtattattttttacccgctgcaacacactggcacctaactattatttttaaacacaaaaaactatttatatttgtagagcgatgaactataagataatgccagcgagcaattaacaagaacaagacagaaatcaactaacaagtagcaacttctcattggttgtaataactagcgtggcatacaaagagtttcagatgcctcttcagagtgaaggcaacgcttcccacgcatcccagtcatagaaagtttcagacgcctccgaagattgaagttgaaggcaccgcatcgcagccatagaaagtttgagccgcctccgaagactgaaggcaccgcatcccagcaagagaaacggagtgtcagcacaagttttaattgaccacatatgctcacggcaaaaactaaaagcgattctcattgtgggtggaatgccttctgcaccgttgatcctttggatccagggtcccaaaaaaatagctaatatcctcgtcatcccagatgcaagtctgatgttggcctgcagcttttccccggctcctgcgacatctaatagcctgtcatttacagatatctgaatgtcattaaaaacaatcatgtttgccctgcatatttcaagaaaactcctgtaagctgacagggcaccatatgcagctctctcattagagacggctaagaagacaaccacgctatgtacacaagccttatcagcagccttgtccacttgtttagattcaagacgatctctatttgcggcgtcaattgcggcagcagcaattgcagcaagcgatgcaaccttgtccgc

SEQ ID NO: 56265 - DNA, 3961 bp, Oryza sativa
  unsure (1)..(3961): unsure at all n locations
agatgtaattaaattgcaatccggcggctctgacacgaagaagaggacgggcagatcgacctgaaaacaactatcctatctctgcagatcgatttgttgcgatgagctgagattgacggttgggacttgggagttatatggagccaggcggccggcggaagtagaattgaatccgactacgagtccgagtcaggtacgctaatagtggagtaatacggagactaaaccggggtcggccagagtaatggactgtttgtaaaccaaatttgaaaaatcaagtttccttcttatgtctggctggaagatcaaagaacagcaaatcatcaattgattcatttgccagctagtactccagttgaaccatcagttatcctaattcattcccttttttctaatgttcagagtacaaaaattcatttctggtaatgagatgggatcgctgtctcccctctccgctatggcatctcatctactccgatcctcaccgagcataactttgactaattaatcagagtatcatccgcaaccgaaagtaaacatgaggaagagagtcttcctcccctttctctaatttgacagaaaaaaaaagaagagaaagaagcaattagtcactaacagaatttgagcatcagtcttgtcgatcgatcagcattatctgctggtgtcgccgccgggcgccggtgatggtgacgatgaggaggaatactcccatggcgtcatgtccatggggtagctgccgagcacccggaggaaggaggtgaactcctgtatctccgacagcgcgttctgcgccctgacctccgccatggacgcctggaagtcgatgtagaacatgtactcgaagtgcttggccgtgcccacgttggcgtcgtcgacgagccggatggggcggtggcggtgtgggcggctctcgatcttggtgaggctgatgtcccggaacgcgaaggccgacagcaccttgaagagcaccgacgtgccctccctgtcgtgcgcgaacacgatgctcgtcttgaatggccggtccgttcgcgggatgatgggctcccgcgccagcatcacgaaccgcgtcacgttcccggcgtcgtcctggatgccgtccgcgagcacctggagcccgtacagctcggcggcgcgggaggacgcgatggcggcggtgtcgcggagccccgcggcggcgacgtgctcggcggcggccgcggtgtcgtcgaaggcctcgcgggcgacgttgaggcccatggcgttgagggtgagctcgcactgggcgagcgcctgcgggtgggagatgacgcgggtgaggaggtccctgcggacgcccgggagcgcgaggaggcagtggtggacggggagctggacctcgccgacgatgtggaggcggtggcggaggaggaggtcgtagttgcggtggatgctgccgccgagggagttctcgacggggaggacggcgcggtcggcgatccagagctcgacggcctggaaggccacctcgaactggtcgcaggggatggcgtcgcaggaggggtaggccttcgccgccgccgcctcgctgtatgcccccgggacaccctggtaggcgacgcgcagctggctgccgtgcatgggcgcgggggagaggtcggtgatggtgagcgggcgagggaggttggagacggggagcagatccaggtcgagcggcggcgcggcgtggtcggcgagggcgggcttgatgctactgttgctgtcgccgttcacccgcgggactcggcggatggcggcgcaggtggcgtgccagtgggcgcgggagaaaggggtggcgcacggcgggcggacggccgtggatctggggatgtgggcggggcgcagcgcgggcgaggtttccatcctccggcggtctccggaggcgaggcgggcgcggcgaggggttggtggcgggaaagggccgcgtcgcgcggcgaggcgcggcgaggggtagtgtaagtgaaagctaagcaaaagaagaaaggttgcggtgggaggagacgagacgccgcggcgccggcgtgagaagagaatgaggtgttcccggtggttgggtaggtgggcactaaactatgaactatcccattcccaacgatgaagatgatgacgttgcatcttttactagtcttgctacacgccacggagattttttatgtttttccagtttactttcagtggtacaccgaccaaagtcaaatttgtttttgcaagtgcaatcctacgtttcttttctttcctctttcacagtttcaacacacacaaaatatagtacagatgtacacaaatcacctcttgtaactacaaccttctcttttcgtcttaaaaaaaataaattaacctatattgaaatgagacgtaccataaaacaataaatttggatagttctccctttagatttgtctttagatttggtgtcctacattttattctatctaaatctaggttgtgttttctttttacggatgaagtactactcacttagaacctaatcctttaaaatatctcaatttacatcagaaagatgttttggcatcgttggctcgtccattccacattaaatggaaccgaacaatcgcaacggccaaacgagcttgccattagatcacacacccttagatcatgtataataaatttccattagatcacacacctttagagagaacagccggtgtgatctccattggcctccggcgtcatggtatcaagggccagctaccgacgcgataggaggaggtacagctagcggtggtgagtggcatgaaactataataataataataaaaagaaaatcctacaacctacatgaaactaatttttttcctcttcctctccttaatcctagaaattaatcattttaaattgctaactaagatgctacatggcaccacatcatctcagaaaacatcttagtttgacatcaaggatcaaaattaacgactttaagagttggggaaaaaataaatggtttcataatcaacggaccaaagttggactagagctatagtcaattaagggttcttatatatgatacgcagtactcccttcgtctctaaatataagtgaagagaggataaaacaaacggcagagctgctgcctctgtcttttcccagcaataaaaaaactctctaagaacacaaaagctctgaattctatgatgctattaacttttcataaacgtttgatcatttattttattaaaaaaatatataaatataaaaaatatatttaaataaaactttaatgataaattaaatctcagtaaaattaataataactatataagtatattttgaataacagaatgatcaaccggagatttctgaatccgtcgtacggttccggagatgtaaaaaacaagcacttttttccaaaccaacgtgaatattacagtcgccgccattgcctcagctctttgcaggttcactcaccgccctcaatgcggtcagtattcaccagcagactggtagggaaaaagaaagatcaaactagctagcaagacatagttcctttctttttcaacaaaatctatgttaattgatattcaacacggatgtcagctacaaataaacaacaggaatcttggtgaattttacatgttcaaatagcacaacaacgctcttggttctacaacgatgcaactgctaggcaaaatatttggatttaatacatgtaaggaaagatcctccaaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56266 - DNA, 1187 bp, Oryza sativa
aattatccgcccaacgagacagtccaaatatttggcctccgacgaacccacaagttccgcctgtgattatccgccaaatattgcaccgcctcacagccacaggtagtacaaacggagcattaaactaaacatgttagtaaaaatgaaacaacacagtgcattacaacaagcaatacacatgtaggagcactagtacagcatatgtacagtactacctgctctaggatagtgtaacagacttacatgtacataagccaaaaaaaaacctctttactttcatcatagctaactgcagtcaacattatacatagacatctaggagagactagaatttacagtcaggatcctcaagtttgatgaacctcccagcatgcatttccaatatgtgattcagctaccaacacagggaaggatgacgttcttatcaaaggttgcagccagtcggagatctctatcagtaaaggatgcagacaagtgaagtgctgcatctcatggataacttggccaaccagatgttcatacaaggaatatcaacagatctgcaattagcaacaaggtcaaaattacgaactcttaaataaaggtgacccagtaggcaagcacacactccattgaactatacatagaaatccttatgttctattatgagctgacagtcaccacaaacaagccattctgaacagaacttagtttggccagcaaccggtaaccggacagaataattctaaatttacatatgtaaaaattaatatattttttatttaaatccatatcattctggccagttactaccccgtaacctgtccccggctccagaccataacaagctagtaactgccatgcttaacataactaatgctatcagtttagaatcagaaaacagcaacgccgtgtaaattcaaataatgacacccaaagtcaacggtactgtagtctcactcagatatattaacagcaacagcactcagcttggacaaaacaaattttatatgtgcactgaagagttagaacacattataattggaatattggatggatcagctaattagacagcagacaccgtttgatacatattaactcatccgtttgttttcaatgtgtctatacagattggggaatacgataaaattgagactgaaggatatgacgagataacaaagactgtccagttcaatggttgcgaacga

SEQ ID NO: 56267 - DNA, 739 bp, Oryza sativa
cgagcgatgggccttcatgcgacgatggtgacggcttcacggaactagagcgaaaataatgacttcataaaaagatagcgacaacttcacgcacactaagtggaattgttaattactatgtttggagctctggtgaccgatcgattttggtcacatgacttaagctaattggcatgctagttttatcggatcaggtgaaggaaaaaagttttaaggtggtataaaaatgataaaaatttaacaatcttattcttaagtcagtgaatagatggaagttgaggaattgaggcatatgcctgcctccttcctcctcatgtcatgtgttcctctcctcttcatgtggagtcttgagtcttgacaagcaaagaaggaaggaaacctcctcctcctcttcttcggctccaaatcaaccaaacaaacacagcttccgactctctccctccctccctccgcctccgcccatccaatttcttaccccgttcgactccactcgactcgacccgacccgcaggagagcgggcgtcgcaaaccctagctccacccacacccacacgctcatgccccccaaaccctagaccatgcgcgcctccgccgcccccatggagacctccgcctccgcccgcagatccgccggccccgaccccaagaagcctcgccttgcccagcaccccgcccccagggatcccagatcttaccccgctgccgccaatggcaacgcccccgccgtcgaccaggcgca

SEQ ID NO: 56268 - DNA, 1562 bp, Oryza sativa
tcaaccttagttttcttgggcggttccttgttattgtaggtgttctgcaaagcatataaacaggttgattcttccatacacaatagcatgagacacttatttggaacatggaaaggagtgttttccccaacttcactccaagtgattgagaaggaacttggctttcaatcatctactaatggatcatcaggcgctgcaccatcaaagcctgattctcaatccaatcgtccatcccacagcattcatgtgaacccaaaatatttggaagcaaggcagcagctccagcaaccaaataaggcaagccaacttctttttttttttttttgtagatgtagctattcaatgctcttgtcatcctgagtatcgtatcaagactgatagatattgctcccattgaaaaaatatagatatgttcatagcattgtaactgctgctttatactatcacatcactcgtgagattttttcacctcattctattctcccctcgttctgtacagggacaggggatactgggagctggggccaagactactacaatttccgattctggtgatgatattgagaggactagcaggacagctgttgatagaggtgcagggcggcggctggatgctttgaaccctaggactgtcagttcatcatttgatcattgagtaacataagtgcttagatgtatttactttgttatatatataatgcatatgttattatttgactttgatatgcagaatgtacagcgggcacaaagggacccttttagcaatcctattcatgaaaagcaagatagagatatgagggtccttggattctccaacatttcgcagcaggctgttgtgggaactggtcttgttcgtgcaaaacctaaaggccaagatggaagtggcggaccatattatactgctggagttggttcttctgaagaacagtttgacaggcgcagcaatttttatgcaaacaaggatgttagaccatcaggatctgtacgtttagatggtgcacttttgccaactcctgttagtaattctgataggattggtaggccgtcatccaacaaaagctggaagaattctgaggaagaagagtacatgtgggatgatgtacgttctcaaggagcagattatggaggtaccagttcaacaagaaaaagagaatggatacctgatgatggaaatgttggaagctttcaaagggttaaatgggcagaggcgggaggacctttggaccctgaccaacacaaattagatagcttccaaagatttggaaatgcgacgggtcaagatagaagaattacaccatatatggtatgtgaaaagaagacagtactataaaatcatattcaatacttgatagatacagcaagttaatttcttgtacctaatgttgttagatagtttgaactgctggttcgctctcaaatttgcaatttataatattgcctcaaaatcttaggttttacctgtataccatgctaaattttgatgacatatatacacatattccatctttgcactacttttggacaagattataatctgattgttttttcaattgttcaggatc

SEQ ID NO: 56269 - DNA, 943 bp, Oryza sativa
agttttatgtgggttttttttttcttcatgagaagcagagcagggttgttctcctggttttataaaaaagatcgttcaaatattactcattcaacattttgtacaatagtcaagctgttcttgttttaattatctatatctgtgatcttctatgccggttgctcaattatactcttttgaagcactgcagtagctggcctgatgttattctagtgatcctcacaaacgtactgctggcactgatttgttttctccattatgtatttgtactactgctgtttcaattggatcgttgctggcatcccatattttgcttggctttctgtggaagtgtgaatacagtcttatctcaggactgactgttgatgcttatgctttgtgatattagtttcttctttttaaggcatggcctttttttagttccttttgttctttgattgcctttaaggaccgcaaatgtatatctaaaagtacatttgatgctcggaattttgtaactctgcagacagatgtagatgttcttttagaatcaatcattgtttctttcaaatagaaaccttttccgaaattacccgctttcttaatcgttgcgaacttctgttttagaatgtatcttgacgctatgctaacaacatgcatggtgacttactgcagaaaatggaacacgagaagctggagaagttggcccacaaggtatgcaaacatattgcctctcttaaaacttgattgggcagtgcctttaatggctcactctcataagtcctctcagctttttttttttgtcatgcacaagagattatgcattcttttatatgttgtcatacatttataaaatttgttttcgttggatattcatgttttgaacttaatacaagctagtatctgctttgagtgggcgagggaaatgaaactgttctagttcttgcgcttacaatagatgtga

SEQ ID NO: 56270 - DNA, 1438 bp, Oryza sativa
  unsure (1)..(1438): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccagattctgccacatcgcaaaccatgaatccaccaacggccgacatgagcgcggcatggcgcggcgagctagaacgcaacgtaccgtacctggaggaggttgttgggagggaagcgagcggcggcgggtgggcgtgcgggcggcggggcgagcggctggatggggcagtggagcgcgacgtgcacggcgagcgacacgaagacggcggcgaggaggcccagctgctgcgccatgccgccgatcgacccaccaatgtgtagccgacgacgagctcgatcgatcgatcacgctatcggcgtcgactcgactcgccctgtagataagctggaggtgtcaggcatggcatacacgtgacgagtgggcacacacctgttatcgttagcccaagccacgtctgttttggacttgcccattattgcaccacataaaaggttctggtccaaacaaataaccgaaatttacttttctgaatacgtaaaaaattggaatccatagataccgtggtttaaacctgtaatgctcccctcgttccatttggaccatttagaagcctcaggtcactcatggattctgtaaaaggcaaaacgcttgtggactagagttaccaatccacttgttgactagccagttaaatgacatagctttatattccattcgtttcaaaatataaggtttctttgattcaaattcataacacaatataaacattactccctccatcccataatataagagattttagagggatgtgatatttttcaagcacttcgagtctgaataggcctgtccagattcgtagtactagaaaaatatcgtatccctctaaaatcccttatattatgaggcggaaggagtactacactaataactcatatggttcccatcatcatgaattccaaagcccagtcggatacttggaaaggtaatctaaacaattcaaaattcaaaaattgacaattgaagtgattaaactactgctaaacaactagaaacaatccttatattttagaatggctagaggaagtaattagtaccacctttgttcctttttacttgtcgttttggacaacacagttttcaatgcacaaaactgatcactactttttctaattatatgtttaaaaaagtattaaaattcatatataaaagtgttttcatgactattctactactaatagtcttttattgtgttaa

SEQ ID NO: 56271 - DNA, 1555 bp, Oryza sativa
gaatacatgacggccataacataaaaacgtagctaagactgatttagtcataatagtattagtgttgaaagagggcaatcccaaacgaaaaaaagttatttctcaatcccaagaatcaagctttcatcattttccgctatcgtcaagacaaaccttaaaacattccacctcaactatttcatccatagaagcgtatctgacaactatgtcatcatcgtttttttcttccaaaagctagaaagggcctacctagtgcttgcatttcggggtaaagtagctttccccagctcaataagagctacctacaaacatggaatgccaatgcaatgatcagaacttccttgccaagaacatcctgatttattatcaggctttaacctttgtaagtgtaagatgagacggtgagagtcttaggccctgtttgggggagcttaagattctgagaatctgttggttggtagccagcttctgagaatctgggttttccagcttctgggttctagttcattttctggattctacaactatatattctcataatctgggtgacaatttggactgttttggggagctggagattctgagagaagctgcagcaactagaagctccccaaacagacccatagattaaggagtctatcttaattgatgtatttaacatatagagcggttacatgggttgacaatttcagattatctagcaaacggcctaccagataatctatatccgccgaattttaaagataccacatccacacagaatccatatcacactatccgcatccacatccatatctatcggatttctataaactcgtaccatattctcgttttgagcggatttggaatggatcagataagatgttatccgattcgttttcacaccaactctaacccgataatgcccgagcattatagttgtgtttggtagaatttccacttcctatctattaagcgcagatgtaagcattgcgttcctttcgatcgtcgtctgtcctactagtaccgtaagtacgtgagcctctgttaattacgacggcgactaagatcgaatgtgagattttatacgaatcaacagactaggacgtctatggtgagtagggttagctaggcaggtcgtgcagcgttcgcagcaacacaaaaaatatgtatggcgtttgtgcacgtcgaaatggagtgtgatagctagttcgtcgtacgtggaagctcttgtcaaacatcgtagctgcttcatcggcaggcgtgatgttgagaggtagcgacgttgttgcttaaaggcccatttaagtttaagttttgcaggcccaaacttaacttttaaaactcaaaaatcatctctttggcaattagatccatcaaaacttccaaacaaaaaatttacttgtagcaaatcaaaccaaaacgaaactcccgaaacacatgaattttggcaaagtttgaaatttgagttttggttggggtgcgccaggctttggcggtagtgcaacgcctaagtgacgctcaagggctctaatggcagccactattgtgagccccttcctaaaaaccgggatcc

SEQ ID NO: 56272 - DNA, 2439 bp, Oryza sativa
  unsure (1)..(2439): unsure at all n locations
gcaactatgtaaattcctcagtacaacctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgataacagctggcgccgaccgtggggacctccgagcgaaaccactgagagcgaatgccaccgaagaaggtcgtgaaggagaaggttacaaggcgaaaggaaagcgacgccggggcggacatggccgccgaagaaggagcggaaccttcggcatcaatcgccgaagtgggaggagccccgtccgcttcggcaccggcaccgtctgcttcggcgctgatcacagcattgctgccttcggcccctgccacctctgagcaggcgccaagggtggatgaagtggcgaaggcggctgcagcggcaagggcgcttcagaccagggcggagatcctttcggcaggacagctgctggtgccccctgccgctccgtcgcagccaacagtggcccaagccgcactccctgccgtgcaagttcaagtcaactccgaccctgaaacacaagccgaagccgatatggaaactattaggcagaacatggcacgactccaagacatgcttcgccaaatgcaagaacagcaacaagcgtacgaggcggcgaggcggtccagggtcccttcggcaccaantcctccaatannttcggcaggggtattgtcnnccgnnnctcaagtctnngtccacaagtnngcagtccctagcnnccgtntccccgncnncgncnnaagtctcacaggcattcggtgcacttcgccgggcagccggcagccgcagcagtgcaccaggccccctatggacaagctcagcagatcgcggcccaagtgtagcctcaaccacttggccaggtgtcgcaaaccgtagcggaaggggcttcggctctgcaggcgcaattccaagctttccttcagcaactcaatcagccccacaacatttcgagtacagctccctcgactcgtccagaggggagtacaggtcaaggtgcacctagttggttgccgccgaaccagccgaatctgggggcttcgccatggagtcagacacctcagtacgacttcgtcaatgccgcccaggcgcaaactgttcggccgcaaggaccgacaccaggctttggaacaagccaagcaccagcccaagtcgccatgacatggtcgcagccagttttcgacccatccatggcgacccagcaagtattaccaatcgcaaccgggcagccgagcaccatggctcaaactcacgcgcaagccgtaatttcacctttcgccacgccgtacccgcagcaaggtgcagcaaacagagcggggggcgagaaggggctgccgctgagtgggggaattaagaaccgcccaattccaccccagttcaaattcccacccgtcccacgctactcgggcgaaactgacccgaaggagttcctatccatctatgagtccgcgatcgaggcggctcatggcgacgaaaataccaaggcaaaggtaattcacctcgctctggacggcatcgcccgttcttggtatttcaatctgccagccaatagcatttactcatgggagcaattgcgcgatgtttttgttcttaactttcgaggcacttatgaggagccgaagacgcagcagcatctgctcggcattcgccaaaggccgggagaatcgataagagaatacatgcgtcgcttctcgcaagcccggtgtcaagttcaagacataactgaggcgttagtcataaatgctgcttcggccggtttgctcgaaggcgaactcacaaggaaaatcgccaataaggaaccacaaacacttgagcatttgcttcgcatcattgacggttttgcaaggggtgaagaggattccaagcgacggcaagccatacaagctgagtacgataaagcttctattgccgccgcccaagctcaagcacaagttcaagttgccgaaccacctcccctcgcggttcgtcagcctcaaacggcgatccaagggcagccgccaagacaaggtcaagctcccataacctggaaaaagttcaggaccgaccgcgcgggcaaggctgtgatggccgtcgaagaagtgcaagccctccgcaaggagttcgacgcccagcaagcaagcaaccatcagccggtccgtaagaaggtccgaaaagacctttactgcgctttccatggacgctcttcgcataccacagagcaatgccgaaacatcaggcaacgtggcaacacgcaagatactagaccacagcaaggagcaaccgtcgaagcacctcgtgaagcagcccaagaacaacccccggtcgaacaacgtcaagatgcacagcgaagagtaatccaagtgat

SEQ ID NO: 56273 - DNA, 701 bp, Oryza sativa
gaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggatgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacgaccacaacaggtacgcctcaagggagcgtcggaccgagtaatcatcagcgtcagggtgcagaaggtccgc

SEQ ID NO: 56274 - DNA, 716 bp, Oryza sativa
caagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttatgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgcct

SEQ ID NO: 56275 - DNA, 898 bp, Oryza sativa
atattttgatcactattcgtcgatcagtcagtgcgtgcaagctgctgcccagcatcgatgtgatgtacttagagcaagtttaatagcatagcccactactagcttcaattcatctataggcaatctaatagcttattcatataatagttacatatatactacactattaatatctggtcccacatggcatacacacactaagtcttggagtccatgctacagctggctacaaatctgtagcccgctgttcttctttctcctcatttatctttttaaaatatatttacagctggtttatagtatgctattggacatgctcttaatggtggcaaatggcggccaaaacgacgtttgtctgtgtgtgcaggtcgttgtcgattggtcatcgttgccaccactggaatccgggcatccagctgcgacctgcgactgcatctgcatgcaccatccagatgagaacaccttgctgggaatctgagttcacgacatcaacatggttatgaagttccaaatgtagcaaatgcagagttagatagtacagtatttgagagtattaattattttaaatttaaaatttagaataatttgatttttattcaactttcatatagaattcttttgaaagaaaaacgtactgtgtttagtagttcgggaaacgtgcacgtaaaaaacgagatattttttcatctctatcttctactctcaaaaccttacagttggtgcccagcaagtttaggagattgttggcttattagccgagccatagccatggtctatttttttagcattggttctagaaccattaatgatacaaatataaatgttttacctgtatttttttttagtttgcttgttcagttttttaggcataccaactatagctcaacaatcagagttg

SEQ ID NO: 56276 - DNA, 736 bp, Oryza sativa
acctttttattgtaaccgagactaagttgtcgttgggcatttaaaatatgtataacagacctacctttcgccctttactgttggtccttgttatgctttcgcctacttctcactattcgattggttttttgccatttctgcattatctgccagggtattcgccgaaaactgtgtattcgacccccgtctggaagttggcgaaaccaaaacgagaaatttgtggctttaaaagatttgccgaagatgcgatgcccgtttcggcctgtgtatcgtgaaatgctgataaatggacacagctataaggttttcaaggttgctgggtggcttcggagtcaccctgagcgaaccctggaggattatgatcttgttcattcaagacgtttggacgacatggcttcgcttttggcggaatcatcagaagaccgatcggcaggaagcgatctttcggcgccgttatggcataatttgcgtttcgcccccttctccccttagagtggtgtatgatattagcgacgacgaaccttgttcgcccgatcattctttagccgacaggggagaaaggggacacgagggcgaagatgtaatttatttgtgatctatattgcactgtttgagttgtaatcctcgatacctcccttttttttttgaatcaataaaagtgtgctttacttccttttcgctattctcgcattgtcacttcgcgtgctttcgttgggtcggaacatgtcggtccctt

SEQ ID NO: 56277 - DNA, 1697 bp, Oryza sativa
  unsure (1)..(1697): unsure at all n locations
nnnnnnnnnnnnnnnnnnnnnnnnnnnnnnnnnnnnnnnnnnnnnnnnnatcttgaaactgcaggctccagtttggccatcccaggctcccagcacacccgctcaaaaagacagaagtttagagagagagagagaatatgcggtaattttttttagtggagttggttacatacaaatttcttataaaaatgttgattgtgccacgttatgaacgaatcttgattttttttttataactcgcgactaattaaataaaatgttgaaatcattataaggaagaagtttatatataagactattttttctattgcaatgctctttatcataaagacgaacgacctgtcaatggtcatattactattaatacgctgaaacaattggtactagggattagggaaaggaaaaaaagtttgaattagacctccaaactagtgagtgagtaagaattaccacctagactttagattggttttgctcttatgtgatagactagtcaatattttttaaaaaaaaaattggtaggacccgtccatctcttcttacaggtggggttccactgatttattatgaaaattattgattgagctgtcataatataggaccaaaactattttggattgtgttaaggggattttaattcaataaaaaaattcaatattaatattaatatggcgttcatgaaaatatttatagttgagagtgaaaaatgtatgattttcgtgtctagaggttaatttgcactcatccaataatttagagggtgtaatagttgagagtgaaaaatgtatgatttttgtgtctaggaggttaatttgcactcgtctaataatttagcgggtgtaatttggacttttttccatacagaaatgggcactgagtcaaacaacaccacatcattaattactgcagtagactgtgagcctgtgaagatggtataaatgtatgctgagcgcctagaggcacgccgaagccagacaggcagacactaaccgtggagtagtctgatcgatctatagaaatactaagtagtagaacacagtactgtagccaaaaactaggccaagagagagattgggcgttctgagcgtagccaaagacatggcaactgatgcccacataacacacttcgcccatccacaacaccgccttctcaagaccccgtacagcagcgcctcgcgccatgtctgcgacatctgcgaagccaagctctccggcctcgtcggctaccgctgcaacgcctgcgacttcgacatccatgaggcgtgcgccgactacttcaaggagaccatctccttcttcgcccacccgtggcacaccctcacgctctgccgcatgcctcctgagaataaaggatgggtatgtgacctctgcatggagcattgtcccccaggaaatttcgtgtaccgctgcatccagtgcaagttcgacgtgcaccccctgtgcacgttgctccctcagacgatccgcagcccgcttcacccacaccacgacctcaacatggtaccttcttcagggcactgcaatgcttgccctgaacgtttgcccgtgtggcactacatctgtggcccttgtacgtctccgtcttatcggctacatatcgggtgcgtctctggcgcgccaagcggtgtcggtcagggtagcggcagcaccaccaaccagaacaacagtagcagccgtggccagggcaccggcaacac

SEQ ID NO: 56278 - DNA, 723 bp, Oryza sativa
taatctgagctgaagtgcaagattagatgacaaacggctgtacttctatgataagtctttgtatgggccccctcttctttcatttttgatatttattggacttgtcaatttcctgactaggaagtggccactgctagatcattgatagcgaccgatagaactttctgattgttactttgttcattggggcttctagattatagttttttatgcctttctgaggtgggtactgagtttccgtcatctctttattatattgagcagagggaacctgcttgtattgacttgtacttcagtattgtagaatctcaacagattcctggttggttatcagatccaatcagcgtggtacagtttggtgatttttgttgcctgctcttttcattttccctgtttgtggatgggctattaaatgtatgatgctttactattttgttgtaacttggggcactttttttttcttttttctttagataatggaagctttattaagacttagtcaaatacaccaagttcttggggcacttatatatgtttagtaagcatggctgttgtctgagaacattgcgaattggctgcaatttaagttctgctgccttttctgtaggtttcaaatctaagtcatttgagcaaactggctcgtagaaatgatacagccagcagagtagatgaagctgacaaattgcgtacggttttccttgcaatggaggatgcgagagcagt

SEQ ID NO: 56279 - DNA, 1664 bp, Oryza sativa
ggcttattactaatgaatgggctttaaagtgggggaaattcaagttgggcctgattttggcccatcttgagtagtaacccattaaaggcccaacttaacatttgctttttctttcaaaaaaaagaacattgacacggtcatggaaaaaaatgtaaagatttgattatattttttagataataaagatttgattatatgacccgataaaattattttcagtgacgcttttcagtggtgaaactaaaatttgggcctccttttagcccaatcttgagcagaactcacttacggcccaacctatgaaccatagcccacatcactaagctttcctttccttttctttggtagagaagtacaatatgataataaccattaactagtactagttaagtatgaagtgatgcataacactataacagcataagtacagtatgatactaagtttctctgacataatcatgtcataaaatgcttcaaaatccaaactgtgccaagtacaatttcctagtcattactctaccttttcactgatgatgatgaaaaggtcattaggatgatactatatatatagtatatcatatgtgatgtgtgcatcaaaaactcctagctaactgagatgcatgcatatgagaggtgtcaatctacctaggaaaagctacagggcactcaccgaatcgagcaggatgttggaggccttgaagtcacggtagatgaccggcttctctgcgtcgtggaggaacgccaaacccttcgcggcgccaaccgcgatgtttaatcgggtcgaccacggcagcactgcaggaatctctgcagaaaaagaagaaaagaaaagaaaatatcttcagaaatctcagcaggatcaacgtcagctaaagccgcgcatgtcatcattataattaattaatcgatagctgatagccatgttatgtatacacatcaatcgaataagaaagctggaaaaggaaaaacaaagcagtttatgcgtattgttgcagcagaggagaaaaaaaagacgatgaacagtactggctagccggccatgcgtgttgtcgcctttgtggaattttggtttcttgttctttctgccttctgaattttcaagaaatgttattattgtaatttggagggattcgatatccagtcaacgagttaggagatttcgtcatgaccaagaacaaatcaatcagcttgagccagtgaggcagctgggaagattgcagcacactagattactatgtcaacctgaaattgatccaacaactacaggtgacctcactttcatctgacgtctgtaatctagcattagaaaacgtctagtagcataatctatagcttgtctcgcaagggtgagtgaatgtataattgacccttacctaatgaaatactattttccatgggttttgcaagctcataagtgagcagagaaggccagtcaaattcagtttggtcagaactctgaactctaataagctaaagaagttggctagccaaacgaaggaaaacatatccatcatccaagctgaaagcctcaaagacgcaaccaagttttttgagtagcaaagctacccatttgaagtagacttctgaataatggctttgcttctctctcattttgtgatatctataatccattattaagttggaatataacctcattttctcaa

SEQ ID NO: 56280 - DNA, 1383 bp, Oryza sativa
tgcacggtttttcatggtttttcacggttaccgcggtaaccgtgcttaccgccggggcgcggtaacccggccccggcggtttaagaaaccctgatggtgggtcaagccttggggtcgacctaccagtatccctaacagttattctttattataggtaacggtattaccatattatcttattgttctcatcaaacacatgtgttgaaaagataaactaatagtagtgatattactcgacgagaaaagaaccatgtcaagtgattaacacattccacttccgagttcttacaatggttcaaaagacgcttctcttctcttattttcccctttctttgttgtctcttatctaactttctatccattgggatgtggcaatcttactgccaaaatgttaaagataaaaccaatgatgttttttaacaagaaaaaaatatttatcgacacttgtctggcttactatagtggtttgaaagacaactttctcctatttcatctatgtcacgtgattcctttagggctccaaccgtgtgtccggtgtgacatgggactcttaaaatagtaaaatccccttgtgatgcatttgcatagttcatctacatggagattccacaacaaaaacaccaggacaacacatcaagaaacaaaaatctaatttctttttagcttccaaaaaaaatctccttccttcttggaccaaaatggcgataaaaccccaaaccacagcccaacatcccagcataacaaaccaagagagaaacaagcctaaaagaagcaaggcccagcccaatagcccatcaagctcaccattcctcgcctcctagggtttcctcctatccaatccaccaactccgcctcgccgcctccatccctcccattcccgaacacgtccccaaggtaagccggcggcggcggcgatgacgacgagcctgaggaagaaccgcaagaagcgcggccacgtgtccgccggccacggccgcatcgggaagcaccggaagcacccgggaggccggggcaacgccggaggcatgcaccaccaccgcatcctcttcgacaagtaccacccgggctacttcggcaaggtcggcatgcgctacttccacaggctccgcaacaagttctactccccggcggtgaacgtggagcggctctggtcgatggtgcccgccgagcaggcggcggaggccgccggcgccggcaaggcgcccctgctggacgtgacgcagttcggctacttcaaggtgctcgggaagggtctgctgccggagaagcccatcgtcgtcaaggccaagctcatctccaaggtcgccgagaagaagatcaaggccgccggcggcgccgtcgtgctcaccgcctagggtttggtcctggccctgccttttgttc

SEQ ID NO: 56281 - DNA, 1805 bp, Oryza sativa
gaaccgtcggagcacattatccagggctgctcgacgggctcgggttcagaggttgacactggggtccattcggctacaaagtcggctagcacttgagacttgacagcagtgcgcgcaacgaaatgcaaatcaaacggggatagttctgctgcccatttactaagcctcccaaagatttccttgcctcgtagtatttcgcccaaagggtactgtgaaggcaccattattttatgggcctggaagtagtgcttgagcttgtgcgaagccatcaccaaggtgtaagcaagcttttccatctcgatgtatcttgtcttcgcctcttgcagcgcttcggagacaaaataaactggtttctggccgaactctgtttcttgaacaagggcggcgcttactgccgctggtgaggctgctaagtacagcagcagttcgcttcctggattcgggcttatgagggctggtgggctttgcaagtattgttttaggtcgtcgaacgctgcttggcattctggtgtccaactgaactttcctgcgccccggagggtcttgaagaatgggagacctctttcggccgcttttgagaggaatcggctaagcgccgcaattcggcctgcaagcttttgtacatcatgtgtgcttgatggaggcttcatttgccgaatggcatcgattttttctgggttcgcctcgattcctctttcagaaaccaggaatcccaacaacttgcccgcgcgaactccgaagacgcacttctcaggattcaattttatgcccgctgtgcgcaagttgtcaaaagtctcctgcagatcggacgcatgatcgaaaaccttacggctttttacgacaatgtcgtcaacataagcttccacatttcgccctaactgattacaaaggaccttgtacaccaatctggcgaaggttgccccagcattcctcaagccgaaaggcatcctgaggtgacagaaagtgccaaacggggtgataaaagcagttttcgggatgtccggtgggttcatatggatctgatgatagccggaatatgcgtccaggaaactcatgagttcgcagccggctgtcgaatccacgagctgatcaatccgcggcaaagggaaatcgtcttttggacatgccttattcaggtccgtgaagtctacacacattcgccatttgccgtttgacttccgcaccagtactggattcgccaaccattctgggtggacgatctcctgaatgaccccagccttgagcagcttttggacttcggctttcgccgcctcttgacgatctgcggacatcttacgcagtttctgctctcttggcttggcatccggcttgactgctaggtgatacatgatgaggtctgccgaaaccccccccccccacttcgtcagggccccaggcgaagatatcaatgttcttctttagcaccgctaggatgctctcagcttcttgtttgcccatgccgtctcccagcgatacgagctttgtggggtcggcatcgtcaacctgcacttttactatcttgccgtgaggtgtgggttttggcgcgtgttttggccggctgtggagttcggcttcgacattgtgcatggccctgttgactacggcttgatcgcctttcgacgcaggcgaaggctgaagccccttgaccactatcactcccgctgggccgggcatcttgagtttgagatagttgtggtgggaaatggcttcgaacttgttcagggtcgcacggccgaggatggcattgtagttgtacgggatgtcgacgacatcgaacagtacttgctcttcgcgtctgttttctc

SEQ ID NO: 56282 - DNA, 1527 bp, Oryza sativa
ccacaaaaggaaggaggtctgcccgtgtctcgaagtcgccgggggcgaagcggggcaccgcaagcgaatactctgacgcggacgtttcgccagccgctctctttcccttcgcctcagtcagcggcgatgcaattggctgacgaggaggactgccgaaaactttcgccgcggccgtcacgatcctttccgcggaggccgaagccccagcggcagtgctaccacccgctccagtgccgccaagtggaggagcgggagcggctgagagatccaggctgcggccagcgggcgaagtcagagtcccgtcagaggactcatcgtcgctaaaaactcgagcgatatcgacaagtcctttctttttagccgccttcttgacggggcctcccttcgccgccttgccagaggagaacgcaaccagagccttcgccacgtccaagtctttttggcgaaggggggagctattcgactccaccccagtctcgttatggccaggacttggagtgggggtataaccgggagtttcggcgcgtccctcggtcacctcgaccgcggcattttcgaccgcggtctccgtctcttcttcctccccctctccctcttcgccgtcaagttcttcgccatccttgtcgtcagcgtcagaatctgatgaaacaggagccctacgcttcctaggggcaagcttaacctgaccgcgcggccgcttccgcgaaggccctgcttcgtcaccagccttatggggattcgcccgaggaggcaattcgccgttaaaaacccggttcgcccgaccagttgcctgccgtgtaagcatttggctgtactcaacgaccgatacgtcgccgatcatcttacgggcttcggcttcggcttggtcaagggttagcactgcaaaggaaaggaaaggagtcaggttaaaaggtcaagcagagagagctaaagcgcgaaagtatatggcgaaaacagcagacttactgttcattccctcagggaggaccagcttaggcaagccatcaacctcttcgctcaggttaaccgcaacctgccatgactgggagaggggaaagatgcgaagcatgcagaactcctccaccaggtcgcggcagctgaggcgggaacagactttccttagcagggcgaaccgggcctccatagcgccatccacggcgatcctgggttttcgattcggcgcaataaccctgcgccgacaccgaagagctttcgctgaatcagagccggcctcgaaggggatggtgtggtaaaaccacctcgccatccaatggcggtcccacttcgacatggcagcattcgctggccaaaggtcggaccgttcggggcgaacattgaagttcacgctcccgatcaccgtcttcttcgtcccagccggagtaatcaccgtcttggagttcacggtggcgaagaatatggcgccgaagagagcagcgctaggttcgaacccagaagtccgacaagcccaatcgaaaattgagatccgaaccagcgtcgatgggctcaattgggggagctctacctgga

SEQ ID NO: 56283 - DNA, 713 bp, Oryza sativa
agacatgggtatatgagatgacccagggtttgtaaccaaatcatacctttctcggccttttggctaagatcaagtgtagtatctgttcttatcagtttaatatctgatatgtgtaccatgtgttcactttgatattaaatttattttagccaaccatgtcctcggcgcctagggttcctaggcgactcaaggtgggttctgcgtgggtagggtttcaatcttctctcaaccccatcggtctcatgcctgatcggatcgatctcttcggtctagatcctgagtcggatcgatctcttcggtctagatcctgagtccacatcccatccttcctctgtgtccacggttagattctctgttttggagccgagccaaaccttgctagccggggaggggtagttttagggttcggagggcaccatggaggcgatgcaggcactgatgaagcgcatgcaattgtcggaggcagagaagaaggggatccggatctgcgaggcggagtctggaagtatgggatcaggggatccgaaggcgatcgggaaggtcctggcggagaaagtggtgaacgcggagggtttggcgcaagcactggggaagatctggtgtctgattaggggaataacgtgcagagatctaggcgagaaccatttcctgtttacctttcatcagcatccgggaagcggcatgctctggaggatggaccctggatgtttggt

SEQ ID NO: 56284 - DNA, 1691 bp, Oryza sativa
cacttttgtcttcattccctaatgatcacactaatacgattttgcatcgtttacatatcatgtcagcaaaagcatcgcgtctcttgacgccgccgcacccgagcagagcgtattcgatcaccacccgcgccaagagcgcttgtcgatccgatccggtgcaggacaacttcttccatcatcccggctgaggatgcttgctttgctgagctaattgcatgcaagagagcaattgaaacaggccaaggaagtcagagtgttacctagggacagtcggacagacagacaatccagatgtagtgagaatgcttgaggggagggatctcaacagatcagcttatggagccttagcacaagatatcaaagcgaaactcctcttacttcaggaggtaaaggttggctgggtccgacaaatcaggcgtcgcataagttagcgcagaatagaatttttttaccagtgcttggtttaatgtatgtaacccctcattcttagaggcggcttttttccccttattaaatccagggaacttcattttccccccttattttactgtagaaactagcaagtgcagaggattcaacccaattttgtatatgagaagaaaaacaatgcatatactctatattatatttcccatttttatctcagaaggtacaaactttaccctgtatcattagacaatatatgattttgatcaagtgcttatagccgctcaagaagctggcattgatatcccatcacaacaatgaatttggagctggtagtaagagttcaggagggcctcattgaaccgtttcgggtcctcctgtggggcatatggccggtgttctttatgattttccaacctagcattcgcacgaaagtgttctgcatttgcattaattcatcttgtgtaagtgaaattacaaggtgcagcctcagcatgtaattcccctgcaattattttaatattttttttttgaaaaagagagcaaaagctttgcttcatactctatcatgttccataatactcgatgttttggacagggttaaattcaaacttttatatcattaacgaacaataacattaaaagtacttagttcaaagtcagtaaaacaacattacaaagtattataataaaagtaaaatatatttatttattataaatattataatagaaaattatagttaaatatgtattttgaagattatgtggttcaaatcttaaagaattgtgaaaccggagagagtatgtattactctaattatattagaaggaataagtaccgacctcgctactttaaatgccttctccatgggaaatatctgatcatgctctcccccacaatacaagaacttgctgaaaggtgagacagtcagacaaagaccatttgataaaggtaaacttgggaagtaaagcactcttgtaattattcatcagctgctaatcgctatggaatacctggggaaatggagcgagatggaatttgtctttgtcccccagtgttgtccccttgatgatgagctcttctcttctattttgtcggtgtagagatactgcaacacagtgttacctgttactgttactcattctttttgataaataagttactgatactaaagtcaagaagctgtaatcaaagataatgactctcaagaacaattagtgcagttgattacatgattgtactcatcactgccagaaaatttcca

SEQ ID NO: 56285 - DNA, 732 bp, Oryza sativa
cgcattttgtcgagcacctagctagcacaaagtatcattggcccaaaaacaaaaaaaaagaagaagaagaagaagaagaagaagaagaagaagaaaaaagctagtacaaagcacacctccctcgatggcagagagtgagagaggagaagaagatcagatcactgacgtttcaggacgcagctgcgccttcaccttatgtaggcgaggtggccgaaccttgccgccgggatcgaccggccgaacaccttgccggccttgccgacgagccctcttaccaccaccttcaccccccgcgcaacgccgccgccgccgcccttcgccggaacagccgcacggccggcgactccgccatcacccgccgccgccaccgccgccaccttagcgccatgaaaacaccgcagtgggagctccatctttctcctgcaagaagacgacgacgacgatctagctagctatggacaccgtgcttttatcagctacgcgaccctttctttctttatacggcgggcgctcgtcggagccggtcaaagacagcgtggcgtcgcgaagtcggcgccgccgcccgtgccgggtcgtgtcgtcggacgaacacgttgcatgcgagggcacgacggcgacagtaacctctaaaactaactacacggcaagagacctcgtcagataccaatgccttgtcaacggccggtaataagaaaaataatccaggttgatgtgatcgtcgagatcgatctg

SEQ ID NO: 56286 - DNA, 922 bp, Oryza sativa
agagccacgaagtataagttaatctcaggccaactttaccgttctgggatgcttcaacctctactccgttgcgtttctttcgccgaaggtgagcaaatggcgaaggagatacaccaggggctatgtggcgctcaccaagctgcaagaacggtggcctccaaggtgtttagacaaggggtttactggccaactgtgttgaaagtctgtgcagagcagattaagaagtgcgagagctgccagcgtcatggctgaagtcaaaccgcgccccactatgacttgcagcccattgcgccaatttggcccttcgccagatggggactggacatcattggcccaatcccttcggcacgaaacgggtataagttcgccattgtggctgttgaatatttctctcggtgggtcgaagccgaactccttggtgcaattacttcggcagcagtacagaagttcgtgtggaaaaacattatctgccggttcggagtaccaaaggagttcatcaccgacaacggcaagcagttcgactctgaaaagttcagacaaatgtgcgaagggcttaacctggaaataaaattcgcatcggtcgcacacccgcagtccaacggagcggccgaacgaacaaatggcaagatcctggaagcactaaagaaaaggctcgagggggcagcgaaaggcaaatggccagaagagatgctatctgttctttgggccctgcgaacgacccccacaagaccaacgaggtttagcccgttcatgctcctctatggcgacgaggcaatgaccccagcagagctaggggctaactcaccaagggtggtgttctctgggggcgaagaaggacgcgaggtgtcgctcgaactattagaaggagtaagagtcgaagcactcgagcacatgcgcaaatatgccgtaaacacttcggcaa

SEQ ID NO: 56287 - DNA, 1938 bp, Oryza sativa
  unsure (1)..(1938): unsure at all n locations
tcatataattgtagtagtcaatgtgtcaaaaaggaaaaaaaaaagagatcatgacatgctgaaggctgactctcacccactgaaatggataagaaattcacaagttgaatgcatggcttctcattattttagaaagaaaaaaaatttgagtggngtttatggtttcccatttctcaacttgcatggacaattaataataacaattaaataatgatgccacctgtatatatttttctaggtgtagctaagcgatcaatacgcagtacaaaacatagacttctatctgcttgcaattaaaccaaacaaatttgctgatttgttcagaggtcaagttgatcaacaactggatggacagtactgtctctataccgaaccaagtggtacagattcaattaactgcagcagcatttgcaacgccgttcttccaattgatatacatcgattgatcgatcgagaccagaagcaaaaaagtaatattaataaatgaacganaagaacaattgtagcttaattagcgtacgtatgcttttgtccaaatgctgaaaacccaacattgattatggccattgccagtagtcgtatatgcagtctgcaggacaaacgtactctcgctacgctgctattaaaacgaggaattaattactactgttgcaacaagtacgtactccagagcagtgtagcttgcttctgttaattaacagaanaatgcattggcaagcagtagttgcttgtagtggagcagtattcttcagtcattgtagtaccaaaattttgcagttaattgcagagcccaattaaaacactgcagcatcatgttcagaatatcaattctgtacttgtgtgacacccataattttcgtctgaaaaaactgtgatactgaaccagaaccagtcccatttgcttaggcgttagttatctctgtacctgatgctacaatcgaactccttaattatccgatgatggatccacgtcaaactggtaatacagagtcatgagcagcactgtcgttctgcagtgtactaataaggttttagaatttatattccatgggttgcaaattctctgaaaaactatttcaaccttgtgacttgtaggtttggagaacctttgactgatcatgcctagtaggtcttttcgtccgaattaaataaattaactactattacaaggttgaaaagttgctctaaaatatgctattgcaagttctctacaaactccattaagagcgaggctaataatatagctgacttgttggctataagatttttttaagacttctctcagtccatccatataataattagctctttacgattaatataggacacttgtctctcacacagagttttttggttcttgtgtctaagccgactgtaaatttacagaccgcttctcttctcttttctcctccacctcaacatttagtcggcttataacctactattatacttttatacttgctctaagcttgtgacttgtaagcttggagaaagattgactagatgcatgcatgcacagcacccggtgctagttgatgactgtcatcatgctgatggcaaaaacatctccataattgtataatttgtgtttaatttgcatggattatgtgaggagatattcaggattagccgaaagaagagagagagagaagagtcagaagacaagttcattgctccctacaaaagcagcaagctgcgggtaggaaaagacaagtcttcaataataagcctgcacaattaatggttccatgaatgcagagtggttcctagttgaaaatttatgcacacacaggaggaagggagaggtggggtgaggtcgtttttatggatttaatgcaccccccatgcttgcaaaggaacaaaacacttgcacatttatcaacccttggtgatctaagcttccaccaaatccatttggctgcagttggagttggagga

SEQ ID NO: 56288 - DNA, 2338 bp, Oryza sativa
  unsure (1)..(2338): unsure at all n locations
ctccacctgaggccgcctgctatggcctccgccgccgccgccgggaacggctctccttccgcgccggaggactccacaggtggattctgcgtcgtcgattaggcttttgttctgttgcgcttcatgtgatttgctaccatgctatgcttgacatctccactagcagtaggcagtagcagtagctattccaagagttcttactctcttttgtgaaagctaatcctatttaatttgattttttaaactctggtttgtgttcggaattctcagcgttgtccaggataggagaagtcaagagggtgaccaaggagacgaatgtgcatgtgaagatcaacctggatggcactggtgttgccgattgcagcacagggatacctttcttggatcacatgctcgatgtaagtatggttttcctgtggcagcgattgtgaatgaggatttctcctatatagatagaatgtgcttgtatactgttgtgtgtagaaatgtttggtttttgacttaggggcttgtctaaagcaagaatatcagttgaaccattcgaagaggaaaagcaattgcttagtgcggaaggggaaacaatacctattaaactaacgaaaacatcttaggtcaaatccactaaatggttgaatagacgctcttaagttgcattcacttcagacgtttttgagtgccactggtgcaatcttattattgttgggagaaagtgatgtgttggggccattaaagcctgaataggtcctacttgaaaaaaatctgccgcttttcaagttccacgtgttttagctgctgttcgctaagaactgttctatcaagcaattagttcactatttgggaaatgctatttagttttgttttcctggtatgatgtgatacatgtaacttccacctattaactcatgtatggctttggttattccacgagcatgataaatgaccacttcatgtgaccaagtcctttaacctcgaatcaatatttcaagagaaatcacgcaaaattatcaacatcagttgcgtgtagcaaattgccagcgcttcattcgaaagaagtgtttttgtctagttttctgcattttgaatggttctactattgtatatgtttctcttgtaggtaccagtctttacacatgctgcataaatatgctcttttagtcaaatctggccattaattctgtgtctataacttacagcaactggcatctcatgggctctttgacgtatgtgttaaggcaaagggtgacactcacatcgatgaccatcactcaaacgaagacatcgctttggcaattggaacggtaattgttgctttcaccttatcatttctgcttctagaaatacttgtaggatcattatgaattgaaggttagggtatccataatttcatacttcttttcccccttcatttgtgcaaaattgaacgcgttatcaacacactatttacattgttgattgcatgctgaatcatcagtactgtaaatgtctgcaagctgtgtaggtaagcaaaacgtctagtatgattgcttttttatttttggtacttgtaggcactacttgaagcacttggagatcgaaaaggaattaatcggtttgggcattttacagcaccacttgatgaggcagcggttgaggttatactggtacatgctatcatcctggctttgctgntacatactgcaaatgtatatacttccctgcatttctacgtttgtattcatgtggccataattctcttatgccatgcaagcacataattgagttagagtcctgcaattagtcatgaagtttttaatgatattataattgtcatgagtatctatcgttctggtttactggcccatctgcactaatggcatttgaacacttgcactgaatggtaatgtttttgtagcacagacccatctatcacactataacgtcattagcaagaagatgactgcagtcatctggcctttgtcatatatacaccaattatttgccattttgggttcatcttagcttaattttttttgttagtgcggatatccatgtctaccacttcatcagtcaggctaattgataatgtgacttactctattatttactattcccccatatctaggatctatctggtcgtcctcatttgagttgcggcttaagtattccgactgagagagttggcacatacgatactcaggtaattcctgaaattatgtagctattatcctttttttttgggaaaaacttgtgatggtttcttttcgtcatgccagatccaatatggcttatccttaatcgtctaatgtgacatggctattgggttgtcttgcatcattcgtattcatcctctgacgttctt

SEQ ID NO: 56289 - DNA, 1639 bp, Oryza sativa
acttaccctgggaatctccgttggttgcgataacagaacatgaagccattgctaactagatcaccaaaaaaggaacaaatttagcactgttctcatgatctattcttctgtaacatttagcattcgaaataaacatgtccggccgttattgcaattttggatgctagatgtcttgagttgtcatctgtgttgtccatcaaacggcgtgtctagcagctcagtttcactctgtatgagttcagagttggtcatgttgctgaacctctgtattttcaagggaataaataagttttgcacctacgtttctgccagactccaatcatatttgctattcctgtgcataggcagcacataaatatccaactttgttattatttcataaagaggtgtaacatttttagcataatacactgatgcgatttcaccagattattggacacgatcgagatgtatcctacgtgtcaagccacgtagacacgcagcttacatgtgtaataaaggttttataagatagtaacatgcattatgcatgacgacgacgccgcctttgcatgcattgctaagcgcgtcgagaatgaggccgtctatggcgcgccgccgccggggaagccgccaccaccgccgccgccaatgaagccaccgccaccaccagaggcagccggtggcgcggcgaacttggcctggatccagtcgacctgatccttatcaatcatgaacgccttggcgaggacgtcgtcgaggatgggcggggtggatccaaacacggcattagcaatggtgatcaccccagggttctggctgctgagcgcggcgatggcgacggccgggacggcgccattattgagctggaagtggatgagaccctgcgggaagacgaagacatctccggggccgagcagcttggtgaactgcaagttgccaccgcccggctggttggatgtgacgaagccgacgaggagggtgccctggaggacggtgaggatctcggtggcacgagggtgggtgtgcggcgggttttgcccgttgggggcaaagtcgatgcgggcgaacgagatgccgagcgtgttgaggcccggcagctcgttcaccgtcacaggggttaccgcggagccctgtgcgttcacggtgttgcctggaacgccgagggctttagggaggaagaagtcgttcgccgtcacctgctttgggttcttgcacacgaaaccattcacgaacactgcatttgcaatttattgttcatagattaatactttggtcaaacctctttgacatttatgataagatttagtcaaacatttaaaactttgatcattaatattttttcaaagagaaattttacagttctaaatttttagtaccatctcaaaaactataaaaaatatcttttttaaatgattgttttaaaaacataaggaatggtatacgtagattttctttgaaaagtaatatcataatactataaatttattggattttgtagtcaaagtttcataaccattcacaaacactgcattacaattttgcaaattaaagaccgagatgatacatacgtgaagttccttatatgattcaatatgctggtaaaataccatgccttggaaaatttaagtgttttctgatgaaaaatgtggtgcagtaa

SEQ ID NO: 56290 - DNA, 2090 bp, Oryza sativa
ttgaaatggaattagtagttgattttaaaaacacagtgcaaggactaaatatatgtacatctttgataacttaaaaaaataataagatttaaattgacataaatttgaacaaccccttatatctttactttgtaaaaactatcaagatatttgcatgcatattcctagtagagtctagagaggctcattgctgaatgtagtactacatcgtaattaccaccatgtgaatcctttcctgttaggaattcaacgttcaaaaacattgtaagagaaaaaaagagaaaaaaacgaccacgatgggaaaaagagaaaaaaacgaccacgatgggaaaaagagaaaaaaacgaccacgatgggactcgaacccacaatctcccgctccggaggcgagcgccttatccattaggccacgcggtcacttcgtataatagctcagcacaaaactttataaactataaaaaaactatcgtacttgggctttttggtaagaaagagcccaaggcccaccataggcccaccatcttggtccagtccgcgcaccacatcgccgctgtcgcccgcggtggcaaccaccgcctccttctcttcttcctcccccgccgccggccgcccgaatcctcaaaccccaactccggttcaccgttcacctcccgccagccaaggtactactccttcaccccccccaccctctcctccctcgcttatcttgcgcccgcctttcaaacccacactgttcatgtcttcttgttcttgccacagccaacagcatgtcgagagccgtggcgcgccgatcgttgccgccgttcttgaggctgcgctccgcggtgtgcgacgacggatactggatcggtaggttggaccacaaggattggctttcccccaacgaattgctcaagatcttcgcgaacatcagggatcctagccttattaccagttccttcaagagagcttgtgatagaagggattacaagcccaatgaggcactctatagcatgatgatcgacaggctagcatcctgcaggaggttcagtgatgtggaggagttgctggccagggcaagagctgagaggttcaggttttctgatgagttcttctacaggctgatcaagatgtacggcaatgtggcgaaccatcccgagaaagcaatcgagactctctttgcgatgcccgggtataactgttggccgtcgaccaagacttttaactatgttcttcacatgcttgtgtgtaagaggcagtacgaagttgtccatgaggtctacttgagcgcgtcaaggttgggagtgacattggacacctgctgcttcaatattcttgtcaagggcttgtgtcagttcggcaaatttggcgatgcgatttcgctgttgtatgagatgccgaagcaaggttgcgtgcctaatgtgacgacctactctacattgatgaatttcctctgtcaacatggtcaggtggacaaagcattcgagctttgtgagagaatgcagaaggaggatattgttgcagatgcagttgtctacaatattttgatcgctggtctttgcagagaacaaagggtaacagaggcattcaatttgtttaagtcaatggttcctaagggatgctatcccaattcagggacatatcaggtacttcttgatggtcttttgagctcaggaaagtttgtagaggcaaagggccttgttagcatgatgagggcagaacgtatgaggcccggtttctcatcattcaagttactgatagatggactctgtagtgtaaactgtttagacgacgcgcatcttgtcttgaagcaaatggtggagcaaggtttcgttcctcgggtgggtacttggacaaaacttgttacatcaatgtgctagattgtggtctcatgccagtgatttatggaacaactcaaatattcaaatagtaatatttctgatatggtagcttggtactattggggtcttataatggccaagaccttttcactagggctgtatgtgatcaggatctaatatagatcgggattgtgtgaagctgggaaaggtattgttcgttttggtaagtttgtgagattagataattatttacaaaaagtaactatcttt

SEQ ID NO: 56291 - DNA, 1160 bp, Oryza sativa
agtacagtgctggtacagaagtacagaactattgcctattacagctaactttagtcttacaatttctcctgtctcattaacttttgatctggtgaaacataaactgaaaaataaatcctttggtaaggcgatttctgtttatgcctccagtgttttagagctagtagttgcaatgtcatactaatggtttgacaaaagtgcaggcagcaacaggggatctgagaacgacgtgtcatgggcgaacccatcgtcgccatcgccatgaacgaagctggagatgatggagcctccatggaaaagaagcttatttacatctaattgttctatctaagctgagatttaccttgacagatgtccagactccacagatccctgggcttatgcagactgcagagaagctgggacatgtgtccatgctgatgaactggtgctcagtttgcaaatgccaacaagaacagccggttagccactgcacatgacaacagggtcatcacaatgtgcatcaatctagaccagcacatgctgcaggaatcagacaggtgactgaacggtgctctggtgctggaaagttcaggttttggctgctttcgccttcatttttaacccatctcatttcagcctggtcgccactgaaaacgtggctatcatcggcttggctgggtttcctcctacctaacttcggtatcaaatgcatcaatcattttcttgatctgaacattgaacatttcatcatttcaatgagcccatcataagacgtgtactgtttctgaggtgggccatctgccattctgccccatgaccattagtaccactactagtactgaaactgttgagcctgaccaaattttctccttgattgcagttcctccaaacgcacaaagatccatcaaaaactaaatgaaaaacgagtgatttgcagcaagttaggcaggatgcgatctatactcttgcaagtgcatgcatagctgaagcccaatcagagagcaagaacagaagattcccagaaataaataaatagagaagaaaaaaagaggaggaaacagatgtaatggatggaaaagaaattcaagtgctgacgtttaagtaggaattgttaggtacaatctcaaaatctcttggcatgaaagtgttgaccatctctctctctgcgcacgcgccaa

SEQ ID NO: 56292 - DNA, 959 bp, Oryza sativa
aattttagcttcgactgtgtgtatgcccgatcaaattttctagcaattttttttctaacctgtacttacgtgtaaatgcaatactgatttcctcaaatgggtgaatgttgtacaccttgtggtggctttcagtacagagttggaggcaggaaattctgaatttacacccgaatttgccggtacaacttttaatttgccaagtcacatttgcaggtatggacttcggtgattctagacgcaagcctaatgtcgtcgggaagttcaccgtagctgttgcactcacggtcatgtgcatcattgtgttgaaacagtcgcctggttttaccagtacaagtgtggtaagtgccgaatctctccacaactagcccacttcactgtcgaattgttgattgctgttgagtcctcacttctcgttgttgtattgttcaaacttgatttaattgtgacacgtaagtttcatttggaacaatcgcatattgtctgacagaaagaggttcctttaacatgattgaaagaaacacattgatcgtccattccatttgatgaattcactgttcatttatctgtgttctgtgctagtagtggttattttctatgcaccatcgtagtttccaataaagcacattcataattccattggaagcaaagctgtttttgtgaagcatttcagattgtcatctgatctagttttcatgatacattcacatgctctatagttctctcgccatgaaattggtgtgactcatgtgttggtgactggaggagctggatacattgggtcacatgctactcttcgtctacttagggacaactaccgagttaccattgtggtaaatttcttattccagcttcatgtttttattcctaactcaaagagcttttatgttacagcaatttcttccatgtgatctttacaggataacctttctagagggaacatgggagctgtcagagtcctt

SEQ ID NO: 56293 - DNA, 3646 bp, Oryza sativa
ccgcctctcctatagcctatactaaaatttaattcgtaagaaaaaactcacttcgttttcttttgaattagatacttcaacgtcattggatcagacccaggggggcggttaggggaagctccacgaccagagctgcgtgagcatggacggatttctggtgcttgctttgatgcagcactgggaatcattccaggtttgaaggtactgaacatgctcacttcagcatgtgtcctgacttttcacatggtaacatactatggtatatgactttcaccctgctttaggttcggggaactgattaccctacagctgatggaacttgcataagggactatattgatgtcacggatctcgttgatgctcatgtgaaagctcttgataaagctcagcctggcaaagttggaatctacaatgttggcacaggacatggttgttaaaaatatcactaatcatctcaacacatgcacaattatgtactcatttctctgcatgtatttccttgtttctgattgtgctttgctcatgattttatcaggtagatcagtgaaggagtttgtagaagcatgtaagagcgcaacaggagctagcatcaaggtttcattccttacccggagaccaggagactatgctgaagtttacagtgacccatccaaaatccatgacgagctgaactggacagcccgttacattgatcttcgcgaaagcctttcaactgcatggaaatggcagaaagcacacccgaatgggtatggatcggcctgattcagggtttaatagattcagacttaaggtacacagattctcaggtccatgtgcagaaatcatatatccttcagaaaattggttcttcagcacaaacatagtgccaggcacagaagtgttctgaatttttttggcagcatttggaagaagatacagaaagaatggcccctctattcctggcttaggatcatacatatagttttttttttccttgacattttttttaatcttttctactcgttaaagcataatataataaccaatagaaaatgtgttgtagacaaggtagataactatcatgtatgaacgttcatggtgttgaatgaaaggatatatgaataagtagatgtttgcttattagtggaagttaaatttccattttggcaagctcagcggttaaatttcttgtatgtgaagcaaggggtgactggggacaatgcattgctgtgcacaactcctggtctcacttgcaaaaacatttcttacatgtaactagagtacaagtggttggattataccgtatgtacatgaacgtcaattcgcagctacacttcttcaaagagaagattaattatgtactacatgttattcgcaactacagttcttcagaagagaagaacaaacaatgcaatggtaagcacctctaccgcgtattctgaagaaaacgaaaagagaagagaagaataaagaaagaaagggctacgtttaccctgaacttgatctgctgtctctctctgcgcctcgctgttcagacgaaaccgagccattctgcaagaagagggcacagcagcaggaccatcaccggcgtcggcagcggccgctcgacgccgccggcgttccagaggaccgccgccgccacgtccacggcgcggcggaggaacaggaccgcccccgccggcggcggcggcgcggcggcgccgcgcccccgcatcccgtacatgatgaacagcagccccgccgcgaggatcgcgcacgccaggacgagctgcagctgctcggctccttccaccggcggcgccccgcccccctcgccgccgccgccgccgatggtgttgagggtcaggaaggacaccgccgtgagcaccgtcgcgaagcccgtgccgacgaggtccccgccgcctccgcctcgcggttggtaggggcgccctggttgccggcgcattgttcgtcgccggcggcgagcggcggccacgaggaagaagctctgcgagaagcgggatcgcgagccaagttaaagcttgtgtcgtgtcagtcgtctatatagctatagctatctagagcgaggtggaaagaggtgtgtgagcatggccgcatgggaatttagcccgaaattgcacttgaaaccatagtagtattatcttcgaaaatttacgtcgagcttgaaagataatcgccggttcggcgtcgtcacgcgacgagtgcttctcggatacttcccaatcttgcaaaaggaaacctgccctttttaattagttccagcttcgcattgcggcattggacttgtccacgatcaacaaattagttaattactactccctccatttcgaaatgttggacgccgttaactttttagcacatgtttaactgttcgtcttattcaaaaacttttgtgagatatataaaattatatacctacataaaaatatatttaacaatgaataaaatgataggaaaagaattaataattacttaaattttttgaataagacgaatgtttaaacatttgataaaaagtcaacggcgtcaaacattttaaaacgaagggagtagttgagaagccatatgatgaggcggatgctcgcgcgctttttattcagaaaaggcgctgcgggattgacatgtaaaagagacggatctattaaagttttcagacgatttcttgagttcttgaccagacaagcttcatagtagcaggttggtatatatctggtgatttatttcatactacgtacaaagatattatatgattttatcatcaggtaacttctaagaaaaaaaaaaagcagacaacagtatgcagtctgcaattaatattgcttccaagttctgagagtggtttgaggtgaagagaaaacaagaatacgtgaaagacgacgggaggtttggactttggtgcttctagtatactagcaagtagcaaagcacgttaatatggtaatttaattttcacatgatttgcagcttcctggctgctgcggccaagagagtgaccggtgttactatcttataatctcgccaggggaagggtttggtagccacattcgtaagtcctgcatagtacaggacatttttctgaattttctcttctgtcatcggtagtgagtagtgacagactctgatctcacaaaagccgagctatgtactaccataattgagtacgtacaaaggttcttctgtttgtctgaaagcctgaaatcaccggcaaaaaacgatggtgtgatctgccgtcgccgtccgctcgtggaggagcgcacgtcgctagcttctcccgcgagattgacggcgccgtcgtcgccgcgggggaaggtgtttggaaggggcgcggaaactctagcaccagatgtgtgggcgtcgcgtacgtcgtcgtcgtcgtcgttgtcatggttcaaagtacgagtatgagtgtacgacgtacttgacgatgacggcgcggtgaggcgagaggtcagtggagacgacatgtgtgtgtccatgtcgtcgttgttccatgggaaattttaccataggtcgatcggagtcagcgtttgcgtttccactttccaccgccccaacaaagcgccgcggcccaggcgcgtgcccgccgcgtcctctcgtggcctcgccacggtgagggcgcgtcgtttgattgcctctgctgctgccgaggcgtgaccgcgtgacggtg

SEQ ID NO: 56294 - DNA, 867 bp, Oryza sativa
tgcttgcataaccataggtctgatgaatctgcgacgtggcgaacagtggattggtgcggaagtaactgcgtagtctgcgtgtaatccccactcccaccggccggcgccgaagcggccgcgcgcgccccaaggttcaccacggacaaaccacttcaccggcgcccgcgcgcgcgcacatgccgcgctccatacctccctcccccgcgcgcgcccgtgactccgcccctgcactgcatgcacgtacacgtactacttccccaagctagaagacgcgcggcgcagtcgccgccttcacttctcagttttcctctcctcggcagtccactacatcgacacgacacccctgctccatcctcgcaatgttgcaccatctcgcctataaatatgcccatgcaaagttgcaaacacaaatcaagctaagcagccacacagcccacagcgaaagaattcgccgaacagtggaaagctatagcagcagtcatggccaagcaccacaatcgtcgtctctccgtcgtcgtcgctctgctgatgctagcggcgtcgatcgtcctgctgcttcttgcgccgccctgcgatggtaggagacagctgaggggaagcgaggccaccagaggcggtggagtcggcgaggagaaggcgtcgttgctgccgcctccgatacccaacctgccgctgccgcccatcgtccccgggaatcctcctgctcgcaactccgtcgtcaacaacaaatctccatagctctcttcatcatcatgtctttttaagataagcttgttgttgagaggtagtaataatactctgttgtgtaccaaagcagagagtccttgagaggatcgttgtggtgtgttctttacgtgaaaaccatcg

SEQ ID NO: 56295 - DNA, 1296 bp, Oryza sativa
gtggatccccccttttgtggattttcagctcttaattcaaaattggagtgttagaaatagatgatttaaagaagagacatgacgattataccttgcaaaacatacctgcttgcgttaatgggcctactggactggactcaatcctagtgcaccaaagaaaagatttagccatttataagggcttatttttaccgaaaatcaagaccttcatcaatagtcatacactactccctctatttttaaatatagaaaaaaagttcatttcactctcccgaactatttcattggatcacttaaccccctaaattatttttttcttatttcacccccaaactattagaaatggttcatcttaatccttaattaacagtatctatcaatcctacaaattaaattccattacaaaatatgacttataaagcgaggaaaaaaggagatgccattaaagattaagatgaaccgttttcaatagttcagagtgtaaaatgagctgagaaattgtttaggggttaagtgccctggcgaaatagttcgagtgagtaaaatagactattttcttaaataaatgatgatgttgaccattcatattgtataaaaaaatgtagcatcacttattttgttgtgattttgtttatcatcaaagatattttaagtatgacttgcattttgcatatttgcactaagttcttaatacaataaatgaccatgctcaaatattgacaacgcgatgtaattaaaaactaaaaaaacggagatactagtactcctatgtcatataaaaaattttaataatagctataaatctgaatatgtgtagattaaattttttatgggacgcagggtgtaaattggatattatatagttgaaatatctagtactaacacacatacacccatctgatcaaagagtagatatatctgttcatttccaatacataaaaaaaaaagaagagaaattggtccatatatctccaagctagcatttcgtagcttctagctagcatgatcacttcaccgatagctagacggatggatggaacccatccgtatgaacatgacggggcaggtgagaagagatgggatcgatcgtcgtcgtcgtcgcttgctcgaagccgctctgcgctattcatccccgttcatcagttcaggtcacagacgacgacgacgacgacggcgaggaggagaacatttatgggcgggtgatgtgtgcaccgaaactgggttatgccttgcaatttattgcaagcgctagcagtacgctcgcctacgtcctcctcctcctactgccgccgctag

SEQ ID NO: 56296 - DNA, 2559 bp, Oryza sativa
  unsure (1)..(2559): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattatcatatttgtatgtcatgtaaactatcccattactatttcttggatatttgtatcttcacattgtgccccaggttatattctatattctaacatagtaccaatggattcaaaagctgccattatcgttctagatcaatgctcataatttgtaaatggcaaaaggcagagcttggacagatttcaccaatgtacttactgcactatctttgaccctaaaatcctagtactagcataaatgtctcgacgacggcgaccacaagttagcctagcgctgacatgtgatgatgatgctcctgtccagcttacatagatccaggttgcaagcttgtcaggggaatttgcgagtacactgaactcatctgggaccattgggcttgatggggtctctcttctgcaatcgttcgtgctgatcacatgcgtcttcaatgcagatcctgaactgatttgcaaaccatccaaaccatgggagctgcagatgaatctggctgaaatttgaaaccaacatttggtagagctagaggagctacgaaattgcacagcatagctctgaattagccttatacatgaggaccccccggatgataagcaagattgtcaggttcagaagcaatgaaattccagaatactgtcaggtatggatgcatactgtgtacagtgcagcgtacagctggctcggatgagtggatctggctatcctatatgacctgcatacagtgaaccagtgctcactgatttgtacaacgatacgtcaactaacaggtttacaaacctagtagtacacttgagtcaatcagtgctcactagctggcacaacaatacatcgagtaacaggtttacatacaattattgcagcggagcaaacaggacaggaaaaccagacacaattttgtaagccgtagaaaagagaaacaagttcatccacaggagtataagagaaatccatgcagagaattgcagtaacaaattatagctcgatgaaattagtaggtggtaaaacagcctcaacaggaaactaagataatgagacatacttcagttttacaagcaaaactgtttgggaagtaaattcccaggtaaaactttggtacactcaaggactcgaccatcattgattgacgagaagatggaaacacaacagcagctgtaagcaagtcatccattgtgttaagagacggttatcactggatgactggaaaacatatcatactgagaccaagactgttaaatttctttttttccccttttagataactaagcaggaaccaccgagttgtagtgctcaccaagaccataggcatgtctgtgataggacaacctaatgctagggccatctttaccacctgaatccaatttgtattctttgcccatttccacatctggaaatgagcccgagtatacaacaatgcgcttcttcaggcagtgggttagagcaccaagctcaagttgcccaccccaagcagcagttgactcaacctcctcacagtacctcttgaagctctccaagggatctggtccagactcgaccttgccctctgataggaaaaatgggagaaaatctgccgcatgctctttcatataattggcagtcatttgccgcagctcctggtaattgtattgtgtggtttctctggaatagagtgacagctggttctcaacagcacggtacaggcagtggccatctggctttatctcctgaatggtcagtcccatgggctcaagcttcttctcaagcttttcattttctatcatgcggtcactgacaagattgttttgctcttcttgaatccgctgctctctagcggcctcttcctttgccttcttctctcgacgccgtgcacccttgctaggcttcgcggaatccgcgttgctggtcacagaaacaccagctatagcctttactaaggtgtccatgttccccttttctgagctgcctgaggatttgtacccaaaagtagcgagctctgcggcatgtttcgcctctaactcagctgagaggcgtgaaatctcctcctctacctgcttcttcttggccttctgctcagctttgctgcctttagcggctgctttcttgaggcttgtttccttatcctggagtttggatttctctttcctgtttaatacaaagagaaagaggacctcaacttttagaaacaataccatataattgaaaaggatccaacccacaatttgtgaagtcatgaaatcaacaggaaacgaaaattagagaatatatgtgcttcttattgctttaactgaacaaattaactaatggttcacattctacttctaagaaaaaaaatgctctgctgctcttcatatgggtaactaaacaacccaaattcttgcaagtacttcactgcaactattttttt

SEQ ID NO: 56297 - DNA, 2791 bp, Oryza sativa
aaaacccgacgaacaatgggaaaattccaaccttttttacagcccagcacaaaactttatccaagtcgcaattgggaccaataaggcagcacttaataataaacagcaagataaaaattttatcccctaatttgccaatgggactaatagcgcaacacttaataatcatcatcatcatcaacaaaaacaataatgggaccaataactcagctcttaataatcaacaacaacaagagtaatcctaaatcctgccgtgccgcagcctccgcccaccagccacgccaccgcgcactgcatcgccgcctccgcctgttgctctgctctgcggctctgctagggttcaacaactcgggggaaccccacagtcagcaagtaaaaggaagcccgatatagcccactggtacgacccagcatcacaaagtccctctccgcctctcctcatcaatcgctcgcagctctccccttcatggcgatacggaggacggcatcgaggttccggttcgggggcaggcggcgagatcgaggtacggcgaggtctccggcacatgagcacacacggcagcagaaaaagaaaaaaaaattgaagggtacaaagccaaagagtaaactaacctatgcctcgagagcacctcctcgagcgtctcttgctgcgattcctgcgctggctccgccgcggctgcctcgccgccgccggcggcggattcgtcggctagggtttcgtccattggcaaacgatgcaaaactcagttcaggcgaaggaaaaagaaaagagaaaaaaaaaaggtagagaggcttttgtgtttgtgggctactcgtgtgctcttgcgggtcttgccccaccttatcggatgcggatctgttactcttgcgggtcgtggattgtcacgatgcttcgcccgtttccttgtctgacagagactgggcgattaatctgttcttcttcagagattctgccccttgtttagatccagattctgccccttatttagatcagggtgtaaagtttcatcgtgtcacatcaaatattatatagagtgttacatggaatgtttggacactagtaaaaaaaataattacagaatccgtcagtaaaccacgggacaaatttattaagtctaattaatccgtcattagcaaatgtttactgtagcattattattatcaaatcatggaacaattaggcttaaaagatttgtctcctaatttagtctcaatctgtgcaattagttattttttagtctatatttaatactttatataaatgttcatacgttcgatgttatagtgtgtaaaatttttacgtgagaaataaacatgaccttagatcgttttcgtgtttgatgtggactgaactcttaccttatacttgtatgatgtgcttagctagatttcaactcctaaaaccacctactccaacgttttgatttcacgcgtctcacgcgaagatttccggctgtttctaaatccgttaatttactgggacgacaaaatggtttttcatgtcgaattgtgtctagaatagtcggagctagttaatttaattcttcctgtaagtgctggtttgaccatgttgaaaacatgcacgagtattttgaaagccggtggagttgaaactatttaaaacatgcacaaaagagcatgggaacgagtaacttgaccaaagttatggaagtcatatgttaagaataatccaatgggttctccatgctcaaagctggctatttttcgtgttcattcctaataaagaggttggcctttttcgtatcaagcaactatgtgatgtgtttcgtaaatacagctgtgtcacggcctggaagaaatcacctctcacgagttgtccgtctcgttatccaatttagcgcgtgcttagttcacgttaaaattaatagtttaattgaaattaaaacgatgtgatggaaaagttaaaaatttgtatgtaggaaatttttaatataatgaaaaagttgaaagttcgaaaaaaaaaagcgctaaaccaggccttaaccaggccttatccttgtgcacctggtgacaacacacttttgtcaacagggagagagacgtacggcagcacgtaacgcgaacacacggcttaacgtgtacagtacggctcagtactcacgtgcacggtggacgtccgtagtacctaagtctgacggatttgatcgatcgaaccggccgtccaacgacgcagcacgcgttcggtttggatacatccttgacgttttaacgacgacgtgccatgcaaaccccgccgtcgcgtatagtcgtacgcccacggctacgtacgcacgcacgcatgcacgcacggcccgcgcgcgcgagaccaaccgagccaacacggccgcgaccgcgaccgcgaggttgtgtgtgttgggagtgaaacgccgagacgtacgcctgatcaccggttcgctctctgctgtgctgcctgccacgcgcgcgcgcgcacggtgacgctgacgcagtgcaccacggtcacacgcagtcacccaccgcagcacgcgtgccgctgttgtttttaccgcgccctgcgttacgtcacgtactcaaatgggtgctcaaagggcataactactccctccgtcccaaagcttacgctgtttgaccatttgtcttatttaaaaaatttatataaatataaaaagcgaaaaattatacttaaaataatttggataataaagtaagtcaaaaaaaataataattctaactttttaataagacgagtgatcaaacagtgcaaacaaaaactcaaaattccttatattatgagacggaggagtagttagtt

SEQ ID NO: 56298 - DNA, 1755 bp, Oryza sativa
cacgttacacgtacccaaagaccggtcgaacgaatcggcgtaatacgacgacggcgcccgcacgcacgcgcgcgcgaggggtttggaccctttgacgacgcgacgggccaaagcttagccgccacgcgggacaccgtcacacaccacgcaaacccgtactatgtctatgtacttcatgtcagtatgtgcatcgccgcgctccgccacgttccgcgaccaaccgagccaacacgcgaggctgtgtacgtgtggaaggggaacgtacgctagctgagacgcccgcccgcctttcacccccgggcggcgcaccgccgcgagtacgtacgccggctgcttttccacaccgccgtaggcacgtataagggctggtttggtttgaggcctaaattaggcttaccaatatttagtaattttaatagtgtttagtttctatttggtttgaagctaaattttaacatgcctaagaaaatagaccatttcaatagtaaacttaggctattttgacttcaatccaaatacaacttttccttaccaaaattagtcatgccaaaatttggcattgacaaaatttggtaaggcctatttagccataaaccaaaccaaccctaaatgcgcgggcatgtgggtacgcgctatattaaacgcaaaatctatttccagaggcatctcgatttagacttaacgagcgacgctgacaattacgtgagaagtactagtagcattacagacatgcatataagtagtttttgctattaggttgtgcattttttttcttcttatgaaattttctcttaaattacttatccgatatataatccgattacaccgttgtgttcataacaattaaatctttacaccaagatctcacatgattatattttgatgaaaactcacacattacttttatgatatgtgtaaattacttttagatttcactaagtgacttcttagacacacacaagtaaattcagtaaagcctacatataatttatatatattatagaagtgacttagacacaacgaatgtgactttggcgtgtcatttgaagtaaatccgttgtagatataaaaacatggctctctctagaaattatatttatcagcgcatattatgggcctccctcaacacactaataaaagtgatcaccccagagcgctatgtatgtatagagagtgttttaatcacatctaaaagtgatatatatatatatatatatatatatatatatatatatatatatatatatatatatatatatatatatatatatatatatatgataattatatatatgataatttgttcaatgaaaaagggtattaattaaagttactttctttttttataagttacttctataatatatgtaaattacttttaaactttactgaatttacttgtgtatgtctaagaagtaacttagtgaaatctaaaagtaatttgtgatttttcatcaaaatataatcatgtgagatcttgttgtaaagatttaattgttacgaacacaacggtgatatcggatcgtaaattggatgagtagtttaagagaaaattgtatttgaattatagatggatgatatttcttatagatggagtggtagctggtttagggggtgtttgggaactagggactaaatttagtccctctcacaaaattataagtccctatggtagggactaatgtttttgtgagagggactaaagtttagctccactttagtccctccaaccaaacaccaccttagacaaaccaa

SEQ ID NO: 56299 - DNA, 7109 bp, Oryza sativa
  unsure (1)..(7109): unsure at all n locations
tgaattttttctcaggtttttttacatgtcatgtgccgttggtacctggccctgtcgttgctgtcggtgagggctcgaaatctgctccaaacctgcagcagcagatgcgctagaaagctactactaccactgaattcttactcacagttaagtccactgcaggttcagttcttcggtccctttgaaggtggcggaggcattgctcccagcatgggcgcttcgtttgatgttcggaaaagtgctcgacctggcaaagaaatgctgagtaacaggtttctgaatatggcaagttggagtatatctgtacgaggcacacattaccaaatgtaaagtaattgcgtaatggaacatggaatatcatagccacctttttggcccatagcatgggcgtcagactcctaggatgctctttctccaccacagagaggccactggcgttggcgtcacttgctagcctaaaatcatattgaaattacacaatatgatttaaataactccaacatcacccaaaaagctcacattgttgtgtatttctgttagcaatccagaaaatggttttgcacttaaatgtcagtataaatactgaacatacatacatgaaatagctgtgctcaatattaaaccaaagaaaaggaaaatctggggaagaaaactactatggatcataaacccataaacctatgaattccaatgaaggccttagaagatgcaataataattaagaaaccatagtggcatactaatatcaaaacacttgaacttcaatgttagaagtatccaagtctgttctgaacataccttcattttgcattgccacttgacttaacaaggtatggtgttttgctgagagcttgagctctcatcttttttgcagacattgaaagcgagtgagaggatatcatttccttggtttacattcaggcatcttgtctgctgcatcttacttggtgacaaatgcctccgtctgtaccatataagaaaaaaggacataggaggtcaggataagcaccatttgatgcatctgttacaccagaggtcaaataaaagtagcatacgaaccgaacaagcagaaattatcatgaaataagaaaaatatggtatatctaaactctacatatctagaggtatggaaaaaatgaaagaggccataaaaattggctaaatcattagtggctcaaagatgcagatcagtacatcagacttattcattatatgcatgggagaccccagagtgagaagggtaagacagggtgctaacgagaactcaccagtcaccacttgatcaaattcatcagttctttctatgcaaatatattattgtttgtggttgtgccccccaatctgagccctcactgagcacttcatacagaactgcaaagcaccagccaaatcattgccaactagaacaacttcatctacaatcatattcagttcaacatcttctgccttttcatcttttatcaggtcttcaatgttagtttcctctttgatcactgctaacttgtcatgtccttttgctagatgacctgaaggaaaccgttactgtgttcatccataaaaacatctcttgcttctggcgcgcatgtctctgagaaaagataataacacagtcaatatcaatacaaccgagatattagtgaactctagcatgcttattccaaattcatttaaataaaacttcaggcaggttaccttattcggaactacctgagatcacaaacttcatttgtaggccccacacaaactctcccacctcagttattttgtgtggacctcctgcagctcttggtctttgctggcagtagctagtattgctacagcaagaggaccagaatctgcagtctcttcctgcttgctccagtgatttctgcagatcttcgtagtcttcacccaagaactagttttcttcaacttcggttgtatttttcaatgctttgtatgcctcttcttccttttgcaaggactgctgcatggtagacagctttctcttttcagcatcagtcttcctccctagcagatcacctgctccctatgcagcagcactaagttctgattcgagttcatcagatcaagtatttccttcttcctaagggatttctctttccctggtttttcaattgaaacatttcatcaggagcatatgtctgatatcatgttcattgcagaagtaaggtttcctgctctttttcttggagaaacggccttccaatcttctgcagagctggcaacatgaaaatatcaagttatcaacatgaaaatccaggtaaagcaacaactgcagaattttcaggattgcccacaataccaatgttcacatgtaaggtttctagggacaaaattcagttacctcttcgatattattttctaagttatcattgaaattcccagcttcatcaagtgtcgttccctgatgagatatagcaaacagttaaaataaatatcggcgtgtgataaagcaaatgaagcacaaaagcatgcttagtttacctcttcttcctctggatcatcgtaaacacgagtataggtttccttgagaatggatcatcactgaacatacaatcgacatgcaaattaatagtacaaaaagtacaatctaagaaacattttgtaacaacacagctatgagtgtagtgagttgcttgtcatcatgcattacttccttattccgtttttcgtggacttgtaaggttgacggcttattcagaacacaggataggaaaaatgcaagaacaggaaaaacacaggaatagtataggattacatacggaaaacagaggattgaaaactaaggaatttgatgacatgaagcattcagaatacaggaatacatacaacacaagaattntacaatcaagtaacctcatagattataatctaattaagcaatagaatactattttctatctagtcactactctcaagtactctctagacaggaaagccttatcttatccccttcattcatcagttcattcaccgcatcatctttttccccaatgttccagaggcatggggagcagcaaacagacaaaatcaacagggatggcgagctcggtggtaggcggagcaagcgaggcggcggtcgggtgacgagctcgcacgggcgcgtggcaggagtgagctgctgctgtggccactcacaaggtcgagcagctggcaacctcgacttgcttcttccccttgttctttttaattggattgtgtcttattcctatccttcatagttcttgctcagttgcttcgcttgtgtttgtaaaagttcttgtgtattgcttgattgcctcggtcttacgcgaaggaaaacaaaaatgaggtcggagtgggtgttatttttcctgtgtttttcctatgtaatcagcagcaaaggaatctttccttagattatcctatgaattgtttgtgccttccgaatgataggaaagggaaaaatcccaatgaacagtattcctccaaaaatcctttgaaaaatactgtaatccgaagaggccctcgcatctttgcttctgctaacagatctcaatgtactgaaactgtcaagcataccagtttgacagagtctacaaaattatttttgcttaacttacaaaaatggtcaagtagggaacaaatatgtacacatacaaaaacaattactaccagtaataaccgatgatcccattggtcagaatgcaggtgtcatatccaaatctgtaaactgataccgaacaaagcattcactaactacactaaacaattagttgatctaataacatatacataccacatttgaatctgatgggtattcaaatgtttccaataaaattggaccgatgagtccattgcgtaaaggttcccccatttcccattggtagctttcccactaaggtcccgatcaatcggagaagatccaacactaaactaccgccacgcatcaccaaacacaaccgatcagaagttcggaacctggataaaccctaatccttgctgagcactcgaggtatggaactcctagtcacaaactgaatcggaatggtagacggaagaggacctcgcgttacctaggggagggaagaggcaatgcgtctccgaacgccgaggaagaggacgcgcgaacccgcagaaggagagatcgtcggcgccgccggccaccggccgcggcggcgccgccccggacgagcgagggaggaaggaagtgaggcggagagcacgacggcgagggcaattttgtaataagcgcattttgggcttttactaggtaagcattagctgtgggcctttagcgaggaggagagctacggcccaatatgctcaagtcgacacgtggtccacggtggtgttgggcttccctgcctttgaatggtctccaagcccactacgaatatttactttatgcctttttctttttatcttttggatggaaaaaaaatattgtccatcccactagctcttttttggaaaaacaaatgtcatctgcaaggtttgagactttcagcctttcaggggacaagctataatttatggcaccacattttcaaaagaaaaaaagcagtcaaattattcgtttttacactgtaaattatctacatttgcacactaattattattatgtaaatttcaaaagtatatcataaattttctaataagctatataagtgaattatgtttaaaagtaaagtgataggagaggtataaatatatatactgtacatagagacaacaatcacataaggaaaacggttattggaatcaataaaaaaaatgcgtgtcatattttagtaagattgtttttcaaatgtacttaccttcttcaggttagagagtccaaattcccaattgtgattaggactttgttcattaattaattcatataaaaatcccaattacatttagtcatttacagatgtcgttgcctgaatttattgtgatgacaaatagtcatgccgaacaatcatgatgaaggacaaggtttgtgggttatcttaatagaaagaacaaggttgcacgcactaagcgtaattatattgttcaatcaacacggggatgacattgccgtgcaggcaagcaatctaattaagtatcagtactcgagcatgcatgtagtttatagtatactcctagatgattaggtttgaatagttttctcacgtacgcgtatgtacgtgcatgaaggcatctcatccatgaaataattctattttattcgtaagcaagcagaaatggtcagcacagtgattttcttaacacgattttgctgagttggctggcaatttggttcaccgatccgctgataaacagctcgtcggaatgcgcacgtgtgacgttgtctgcagggaaagtttgacaaaattatggggtgatgccaatttacagatttgggtcagattcagcgaattccagctcacgtggtttcagcatgtgcttaaatgattaatttacactcgtaatcttatctgaaatgtcatgaaaggagctgattacagctcaattcatttttaatcatcatactcaaactgtcaaacttatgcaaccttcagtagcgtggagtagggggcagtaacagtgtgatgttcagatgagatggcaagttaggaaatgttcttatgattaacaccaacttagcatataattatatatcatgctgccgccctgcaggtagcgggctgctctgcagacctcactgctttcgtcaaaatcacacactgattagatgtgagtagatatatatctactgcaagacggctatgatcttccctggtaaattaatttgaccaggttaatattttaaaggaggtgaccagagtgaaacctgcagagccttggcttacgtgtttgatagccttaattttatcccatactgccaaagatgacattagtttgttcaggtgtatcaatcacagtatgttactcagaccaactcccatgtacttaaaaattttctgaatttttgacttgatgctcagttagatctccgtggctcattctgcctctggtgattttaattgatgatctccttccctgaaaaggaccggcatgatgacttgtaatgagaggactggacaaaactggccactgaactgcttatcaggcgatcagaaaattcagaagttgtcaaagtcatcaccaagaccaagtacggagtggatggtgttgtgttctttctttcttcttctccccatgttcttaattttgatttcatcacgagaacagtccattccatccgtgtgccttgttacctgacgatgagatggcgaaagcagttcgcagagtagactttgagaagttcgtgttcaaactttcagtgagacatattgcctgaattcagtgacagacactgtgcaagttccttcgaggcaggccagtggtaacaagagacgtacaacaaagcacttggactagatcactcacttatcagttatcactgttaacctcttccttttgccgaaaatagttagcagccagcaagtttttcttcacaaatcttcagagaaaactagcagagaactactgaggaaagctgcagcctttgtcacaggtttgccgtcaggtcaggagttgctcggtagtagtgaacaatatgaaaatgcaaggcataaataatactgctaataaattcaggagcagccatctgttcctgacgtaattagcaaaacttttcttcaggtaggcgctgctgaaatggagatatgcgcatcatgaacatcctgctgctgatcaacaggcgcgacctgttgctacgcatgctgggtgatgccattagacagtgtttgttcggcggatttggactagtaataaaccagggttaagttcagggatcaaggttatagctttggacgcgagtcgctgatttgatgttccattaattactagcggctgtgttgaagtacttgcgtatcatttcttgggcggttttggcccatggatttcgcacggatcgtagtacgagaggccaagccgaccacgcgaatacagcctaatttttcgtcgtcggctccaacgacagcagattcactgtgtggcggtgttgccgtcgcagtgacaccgccggcgatgacgctcagtagatacatgatggaacgataggacactcgtatggggcaccatggtgcccgggcaccaggtatctatgcaca

SEQ ID NO: 56300 - DNA, 2305 bp, Oryza sativa
  unsure (1)..(2305): unsure at all n locations
actactacatccgtcttaaaatatagctacattacacttgatgtgatatatcctagtccaacgaatctggacagccacttgtctaaatttattgaactatgatgtgtctcatctagtttcaaattgctatatttttagacggagagagttgtagatattagttttttttatcatataataactacgtatcctcgtaatccggatgagaatatgtttgatggagcaagagactaatggagtatacttgcaattactataagctccacaattcaaacataccatattcataacccatccattttagatattacatttttttatggcatcaaacatggcagatgcttaaaacaaactggcgcatatgccttgagcttaaaattccaactccgtatagtatcaagtacagcaatttctattgggtggcgtgcgtcatccacagtagccgtcgttgcgtcagttcttttcatggcacaataaaagaaaaacatatgtggtctttgcctacctacatagatctcccctattaatactccatcgtgtccgtgtcctagaaaaacttctgcacacgcagccgacgcccttctctatctagctaaatctccattttaattcctctctctctctctctttgtgtctttctcaagggagaattaaccatcaaatcaatatatacaatgagcttgatcagcatgatggaggcgaacctgccgccggggttccggttccaccccagggacgaggagctcgtcgtggactacctctaccacaagctctccggcggcggcgagttctacggcggcgtggccatggtcgacgtcgacctcaacaagtgcgagccgtgggagcttccaggtacggatcagatcatctcgtgcaaaacttcagcttaattttctttcggaaaggtgatggcagatgcgtatattgattagctccgagcagcacgaactgtgtgtgattaattagctttgcaccctctgcaccgatccaatggtacatgcataattgcatagcagtcgcataacctgaagaaagaactgtgtgattatttaacatctgcagcttgcacccatccatctgcaatatctgattttcttttttcagaaaggctatacagaacatccgcagcctgcacaattcagaaaatgtttttttttaaaaaaaggatattcagaacatatgcagctttgacgaattcaggccaaaaaaaaagactcagaaaatgaaggaaagaaaaaaaaaagagaaaaatggcgtcgcccggactcgaaccggagaccttcagtgtgttagactgacgtgataaccaactacaccacgacacctttgtgttaccgaaatttagactaaattatatatttttgagaaatcatcttgcacgaattactatgagcaccagctgcatctctgtagatctcgtttcgattttcctttaattttgaaacaagttccatttgcacatttcttcacgtcactagttgcacttgacctatctgaactatatggttttttttacttgccatgaatcgttagcatatttcttgcacaatctgatcattttccctgcacgcgcacgcgcacgcgccgcggtcgccggcgacgagaagacgccgcgcgggtgggcgccacggagtggtacttcttcagcntgcacgaccgcaagtacgccacggggcagcgcaccaaccgcgccacccgctccggatactggaaggccaccggcaaggaccgcgccatcgtcacccgccgccgcgccgccgccggagaggccgtcgccggcggcgaggtggtcgggatgaggaagacgctggtgttctaccaagggagagccccccggggcagcaagacggagtgggtcatgcacgagttccgcgtggacggacatgccgttgccgaccacccctcctcgtccacctcctcctcctcatctaatcttctcaaggtactacatgccagcatttgttttgcgtgatctcagcagtaattattagtgattaatctatcatcacgcaggtaaaagagtgaaaaaagagagagagagaaagatgagaagtactcactctattccaaaatataagacacaactacccttaactcaaagatcaagaaataattaatatatcattatcgttgtcataaatcactctaattaatacaagagatgcaaccaatagaattaaagatcttgtgagtataggatttaaaataataataacttaggggagagaatgtgataattaattacatgcgtgcgtgcacgtcttatattatgaaactactttaaaaaatagatgtgcctatattt

SEQ ID NO: 56301 - DNA, 5370 bp, Oryza sativa
acatgtttctttcacagttttgttttctttggctctacagactttagccgaatgctgtttttttttcctttttctgaacattctgatgtgataaactagttatgcaacttgccaatgattgtttctacttgacctagtcccatccaatcattcccaaaccttgtacgtatcaccaatgcttgccactcgaggtttgttcgattggctacatcgctgtgcatcatcagcaacactaaattacaagcctagatatgtaggggaacaatttgaaaaggatttgactgcttttatagcacagattctttattccaagttgttagttgttctgttaaatgatgatttaaggccctatttagatgggactaaaacttttaagtccctatcacatcggatgtttgaaaattaattataaatattaaacgtagactattaataaaacccatccataatcttggactaatttgtgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctgaatctaaataccacctaagcatattcagattattgaggtttccacaatatcaagcatcgtacgaactgtatatatatctatctatctttacaagataatataaacttcatcccaacctgaggtcaccaaatcttattttaaacacgaatggtaagttaagtacaacttaatctactttgtctgaatatttcttttgacaaaaaaaaaatgcaggagggctgggtgctgtgcagggtgttctacaagagcagaacggctacaccaagggcagtagtctccggtgaggctgccgtgtcactgtccggtgagctcagcttgccgccgccgctgccgccgcccgttgcccccgccgtcgtcgacggctacaccggcggcggctattacgagcaagacagctcagctgggtaccaccaccaccaccaccaccggccgccgccgtcggcagcattgccgttcaaggacctgacggacttcagggacctgctgagcaacatggcacaaggcggcggcggcggcgctgccgccgccaagacggaggggttccatcttggctggagcgaggaggagtcctccggctacgtgcagcagagcgccatggcgtcgcaggcgtggaacccgttctagcttagctagagctagagctagagctatatatagctgatataagctgatccagttctgaacttttttcagaaatggtgatgatatacaaaggcaaagtttgtaggtgtagcttagacaatgtaaatgtaatttatcttcgttgtttcagtaattttcctttgttaattagcgtggttgaatcctagttgtgctactgctagttaacagcgtagtgacaaacaatttgtaaatgtggagatggtttggtttacagtaacttttgagatgtacaaaggattgctccattcagttcattggttgctaaagaagagaaatagattcgatcgttactcatcttccaatgatcctcttagcaaaagtggtgcaattagatatctgttttggatgctttgttttgttcaacatttgctttattatgggctgcaagttttattagcatgcattgtgatggtccagtgaagtccaattatggcccataatcaaggcaggcccatcacagcctgcctagatgaatatctgtctgaagtctgaacatatgatcctcttgtgatttttcatcagaagttgatgtactgcacttgttggattcctccccattacggcatcacggacatctgcagtggttgatgacacttgatggtaaggcagttttgtaccggagtgaccagactctgatatgtcaagaacagacataatgtttctatgcctcaccgaagtactatagtaatcaacatggttcaaccatgcattcttaaatgttaacaaccgatacctgcaccaaatgtttataattgagcttatgcttctcatcgaagggaaaataaagggagaagagcaggagaggatgattcacaaacatacctgatactagttgctaatagattacagttcactacttttcagagacaaaaatgctctagttgaaatgattgccacagggtgtggccttgctagctgttgcccttgtcagagaacattcttcatggaagtatcatagtgttgtgtctttaggtagatggattaataaaatagattgataaatgcagaaagctttggtaaagtgattagcagcaagctaggccatgttccaaaatccaaacggcctcaaaaataaaagcaatggtttgcttcctctgggcggccagatgaagagggacccaagtgttagagcatcttttgctcatagccctcacatggattgccccccatgccggagatcacagaggattaaaggaaacatttgtgactgtttaatataatagtgatcatactaagcactggtgtcccaactagtacaaatgttgcaagcttctttcagagacctgtcccaattaatccagcatctggtgttaagtcaccacacttcttttcagggagtctgattgatccaacatcttgtgttatgtaactcttgggatgctaaacctaaaaaaatcaaatgatagaagagatgattaaagaaggggtaggagtactttgctagttctacatgcatgacagatttcagtaggtttggtatagtttgattgatgagcaggtaataaagacatgcatgtcctgcagagctagattctttttcccctttgtctttggcaagggtagttgcaacaagctagtaagccaaactgccaagacagtagacagagactaattgatctctagctggattagtatattattactgtggcatgtcgagtaactaaccaacttgtgagcaacttcttgattgattttgattttggaatttaggccttctcttgatctgatctgaacttatggtcgcatttacttctttatgttttatcttaacgaaagcgtataggggcctacttacgtatctctgttgtaataataagatagaaaaaagaattagtccgcaattcggattagttcaactaaacaactatgtatatcatctacataatgtacatctttattgcctgtctcctgcatcacggttttctggtaaatgtatcaatcaagtttcaatgaaatatgtcggctgacaatattacatgatctcatataagaaacagtttactggaccaacggaaactgaacaaaaaagttcaaaatggaacctaaatcttcttcaatgatccgattaaaaaaaaggcagattttctgtgtgtttgttagtgaacgtgtcgttcatctgatctaccaaagtttcatgtgcgattctcatctatagtcagaggagagatatcgtggtttcattacgaagatcccaactaattagaatgtttgtcctctgcatgctatgcagctcacatgctaaataggcacggtacgatgacctctttgtcatgtctttcatcattcgaccattagcaagggcacaacacgcgagcttttgtaaatggaaaccaggacatgctccaaatcaaacaacggatacggaaatgtaaagaaatggagcatttataaacaccgacggatttacgggctctaaaagttttgataaatttcactacagaacatcacgacctcgcggttttagctataagatgaagtacaaactcatttttgaaggaaaaaaaaaactctctaaccgttgttattttctagcactcattaaaataatgtatttatgctgacgaggtaacaaggggcctgatattttacacgttgtgacgccgccactattctccccaccatcctcgaccaacctcatcgccgggatgcaaggctgaacttcgctgtgtggttcgtgtggatctgagtaacctaagggtccacacagtattcacctcttggctgttgtggaagaagcagttttcgccaccgtcggactacacacccaaaattgcctcgtcggcgtgctggagactagtttggttcgcgtctgttcaagccaaaccagctcaatatgatctggacccgcacgcaggggcagtttggtcactccgcgtaaaatatcgggccccctattgtctcgtcagcatgaatacattattttaatgagcatgatgtttattgtaaataaccatgtaaaaagagtgttttccctcaaaactgagtttgtgtggtgtcttacagttaaaacttcgaatacgtgatattctgtagtaaaatttgccaatttctttcatgttctgccattgttttttatcgaactcaactaacttatgtctaaatattttaaaaaagtttagcagtatgatacttagtttgaatgtgaggtgaggattggttagttagtgacatggaaaacaaagcgcgcgattagagcatattaactattataaatttaaaatattattttattaaaaatcttctctatatatattttttgtgaagcacaccgtttagccattcggaaaatatgctcacgatgaatcaggaagtagctgaacaaataatctacttagaattccctaaatctagtcgcacaattagttctatgaattcttgagttaataatctgatatgacaagcaatgaatacttagaaaaataacaacaccataatccttaagataagataagtagtgactacaataaaagcaataagagttggcaccgccgatgaccgcggcggcggcggtattggcgacatgttcatctaccacacctcattattgtatcattagtcttagaatgtttcatttcgtagctctctacatacactatttgctccattattaaaaaaacacatacattatttgcacaagttttccatgggaaaatcagattggtcttagccgctgtggtgcaaacctgaaactatgcaaggcaggtccacgcctccactagagccatttcagctgcgctgctgattgctgaagcagtgaagctgacctatgcacaccggtttgcctcgtattctctcttatcggatccggttcacccccgcccgttaacccgaaatcacccgaatatatagcgaactttccgtgacacagtggagttaaccaccactccgctaaccaacctcacgagctgagcttaattgatgcgccatcgccgccggcaatggccgccgccgcagtgaagtcgccggagccgccgttcgcgttccgccccgcccgtcccccgctcccgccgctgctggacgacgaggaggatggcgagttcgagt

SEQ ID NO: 56302 - DNA, 6652 bp, Oryza sativa
gtcggcctcgtcgtgcgactccgggatcaggaacgcgcggcggccgccgcggacgcgctccgcgccggtggcgagcctcctccacctcatgtccaagaagcccgccgccgtggacgcgccgccgaagcggcgagaccatcatcaccagcggttcctggcccgcgcctcctcgtcgtcgtcgtcctcggcctcctcctcctccgactccgggaggaactcccgcacgccgtggcacccgcccggccccgcgcggccgcggccggcggtggccgccgagagcccgcgggtgagcgcgtccgggcgcgtggtgttccgcggcctggagcggtgctcgagctcgccggcgacggcgggcatcggcccgcggcggccgcggccgagaggcatggagcggtcgttctcggccaatgtgcgcgtggatccggtgatcaacgtgttcggattcgggcatctgttcctgccatcttcgccggccaaggagaagaaggccgacaaggacagggacatcgccggcggcggcggcggcggcggccggaggaacaggccggcgaagctggccatggtgctgagagatccgcaagattaggtggtggccatgctggaaataatgcatgatattcttccagtctttggattttttttgtaacttcttgctgctgcttgatctaattcttctttgtctttcagttgttgtacacttgcactgtaatatactctagatttagaacaacaatttgcaaaatttcagagacacttttggtgaatctgaattcactgtcagctgtaactctgattataaatgcctatgtaaagaaaggaacttgatgaacataaaacattcggtagtacacaaaaacccaactaaaacaaatgactaaaatgagtactggtactaaaatgcaatcaagctgcaaataggatcaaagatgcaatgtcaaatcaaaagctcacaaccactggagaaaatgtgacaccaaagttttgaaatttctcgtcgtcctcgacagtacggtagaacaggaggcagtgactcctcctccccctgctgctggagtgagagaaatgggttgattagcctcgtgatctgtgcaggttttggggctctgtgctgctctgtccccacggttgtaattcaaaaagataaaaatatggtttgaactaaccagttgtatttggatttatttggttccaaatcattttaaagttcacccgtcgtgttttgacacaaacatgaggatctctcggtacttgttgccgatgctttctttggtgccggcagggacatattcttacgaatctatgcctttttcttaaagcgaaaaatgtgcacacaagttcaagttgtgttcttgtgaggtggatcaagttccagttgtcaccatcatcctcgttgatgttagcattatctcggatcggaagccaagcagaggcagcacgactggaaactcatttttttcaatcgcccaaaagcagtagaatactcatctacctaaccaggatttgctgccgttgatggcgacggcttccggcgccgctgtctcgccgccacacgccggtaaatgtgttatatgcgctaatgcgcacaggtcgacggcgttggtggcgccgccgctgaacacacaaaaaaagaaaaaaaaataagtaagatttggagagacatccttccaaacagttttttttaaaaaaaaattataagctattaagaattgaacaagagacatcaggattgaaatcacacaccccgcgttgcttttggacacgccgggactttggcacagctccagcttcagctccagacaatttcagctccacttaaaataggagtggaactaggtgaaactctcacaaaatgaactagaaagatggagctaagtttaaataggtcaataactccactttaaactttttatagctaaatttagatattggagctatatcaaatattgccgctacgtgtttttctagcttttgtgctgccaacgccctggagaagaaaagatggcggagtggttgagctgacgcgtgtgacccgagagaacggaagcgaaaaccgcaacggccgccggcaacaacaactactcccgtattggcagcaacaacaacgcgacctgacgaaacttttcagctccacggaaaggaaaagggatattttcctttccttatttttgggtgatatatcatatgatctctccccggtggtcaacgactccgccccgagtcccgaccggggcacggtacaactcacacgcgacgctgatggatggatcacagcagcatcagcctgattcagcgttggatcggcaagcagcaaaaccgctcgcgaggccgtgaccaactgaccaccaccaccaccacatgtacgtccacatgcgcgaattggcgatggaaacgggacggcatcccgttgcggcaacggagccctgcgagagacgagagacagagggccaaagtttggggagcttttgcgcttctcctgaaatttcctgctgccagaaatttcctcaaacggtttagattttcacacaatttctaagaaactgtacttgtagaatgagagagactagagaacatgattccgttagaacatgatattttaagtgacttcttcctggtacctgatagcctagtatcaagctgttacctaggcatctcggcttcgcttgaggcggagagacaccaccgccgaccgcagcggctgctgcttgcatggggcaagaccacggcggcgcagcacgtggtggtgtggcacctagaccacaccttcgagaagctcgcgtcggcgcacctcccgctcgtggcggcggcaccgctggtggacgcgctgcgtgcgtcgcccgccaagccactcgcgctcttcgacctcgcccgccgcctcccgctccggctccatcggcgaggcgcgctctacttcctccacctctcccctcgcatgttcggcctccgcgccccgctcccgctctccctctcgctcaccgcgcccgccaccgagctcctcgccgttgccgcttcccccacagcggcggccgttggctccggcaatcggtggggcgacggcgacggggagggctgcacctcgggagccatctgatttgtgggaggagagtgagggtaggaggaggggatccggattagtatagattttctcttgtagaattcagaagattagttttctagcttctctatatttttatttattacctctcaaaattttaagcttgtagaatttagaagaatagttttctagcttctctatattcttatttattccttctcataattttaagctttcttaataggatcggagtacacgctgctgagacggcgggatggacgcccctgttgatgggtcccaattcgcgtggaatctcgccgcctcgacgacatgtcacggcgccaccacacgacccgccacgccacggcgcagttcgtgtcgcggaacaggaggatgcatgggcctcgcgcggcgtgtgggggaagctgcgaatctcgcgtgcggatcgtcgcctcgtcgtcgtcggcgggtggaaggatttcttggcgcatgcggtgacggcacgcaccctctggcccagtagtactaccagtagggcccaaggtgaaggcctggctgataattgcgcacgttgcgtgatgggccaggcctggctgggctatcaggccgtacaggccgagatttgcaggagccgcaggttttttggctggtgttgccactgccgggaattcggtgccagcaaaaggttcacgcacccgatcaccgtgtgtgcgttcgtgtttttatgatccttttgtatttggacatttctaacacggagtaatacatagtatgtttcatataataagttatttaactttttctcagttaaactatagagaaatatactaatatttttaatacaaaataaataaactatcaaaatatattcaatgttaaatttaataaaactattttggttttataaatgttgctaatttttttctataaatttaattaaccttaaaagctttgactaagaagaaaatcatatgacttgtaatatagaacggatggagtacatgtttcaccgatctcactgcggcagcctgcatgtcccggtggttgcctcacgacagcacgaggatcattactggtctgcctatgatgtcgttggtggagctaaacatcctgaaaatagctaagtattccctccatcctataataatataatatagcaatataggataggacgagacatttcatataacaatgaatctggacatgcatacgtccagattcattatcctatgaaatgttttgtccggttctatattgctatattataggacggaaggagtagtgagttaaataagaattaagaaaagttaatattggtaaaaatcgaacataaaattctaaaggtcgtccgggtaaccagaaacttcataatttggatctatatctctctcgggccagtgtgtgtatgcggcagctgatgctattgaggctaaaccaaacaacttcaatgtgcaaatatcaattcaccaacagaaaaaaatatttcacacaatcaacttctgtatcctaccataaagtttgaggataatttcaactagtaaaacaacagagaaataataacgtttacatgcacgcaagacaaaatgatttacgtgaaaaaacatcctcagcgtgaggagtaaaaacatcggtccactccaagcatccactatagtacaaataaaatattgtccagaacacctagaggcatatcatagcagcatcaaaatcgtcgagttatacacttggcatcaacaacaaccataacaactaagaggtatagcaacaataagcgaagaaatggtagattatatctcatttgttggacctttaagctacaatgggctaagagcaaaaagctcctgcagagagaatttagcccaacagatgcctgtacaattttttttttgagagctctccgctttgagtacaagctgtagtatctgaacatacgtgcaaacgcactccaccacgcacacacacacccctacacgcatgctagacctatcaactatacacacacgtgctaatgagatgcacaaagccacctaagaaccttgtgcgtgacgaggacgtcactctactattgtggcgctggcacgcatgctagacctatcaactatctgaacatacgtgcaaacgcactccaccacgcacatttgagagctctccactttgagtacagagtacaagctgtagtatctgaacatacgtgcaaacgcactccaccacgcacacacacacccctacacgcatgctaaacctatcaactatctgaacatacgtgcaaacgcactccaccacgcacacacacccctacacgcatgctagacctatcaactatacacacacgtgctaatgagatgcacaaagccacctaagaaccttgtgcgtgacgaggacgtcactctactattgtggcgctggcacgcatgctagacctatcaactatctgaacatacgtgcaaacgcactccaccacgcacacacacacacccctacacgcatgctagacctatcaactatacacacacgtgctaatgagatgcacaaagccacctaagaaccttgtgcgtgacgaggacgtcactctactattgtggcgctggcacaggagagctggaaatttatttgggaataaatcccggtgagacgcgcggatgatgatcccagggatcgaacccgcgcgggctgctcgctcaccagcgatgctagccaaccgagcaacgctcggttctcgatgcctgtacaattggtccaattggtccatgggctaagagcgactcgtggaaacgacagaagtcctctcaaacaaaagaagtaaaagaaacaacagtactagtcaaaatcggtcgttggccactgatcactcgctgactcggccttcagaatcatgcatggcggctgatggtggcgccggtcgatcgagacaaaaacgcatgcgtggatgcatggacatgtccccctcctcgcatcttgcggtttgttgcatgtcgcgcccactcgcgcgcgccgccgtcgtggtgttcgtccagtaatccggccagcatttgcgttcagacttcagcaagtactgccactcaggtggtgtttgaaactagggacttaactttaactttagtctctgtatttaaatattaatttagagtattaaatatagactatttacgaaacaaattacataaatgaaacctaattcgcttaataattttttaaacctaattaatccataattagagaatgtttactgtagcatcacataggctaatcatggattaattaggctcaatagattcgtctcgcgaattagtccaagattatggatgggttttattaatagtctacgtttaatatttataattaatttttaaacatccgatgtgatagggacttaaaagttttagtaccatctaaacagggtctcacgttgatgctagactgctagtgctcttgattattgctatattctctcataatcagatgctatggtttgtgataatgacagttttctaatctttagttatagccgtggtccatgatattacctgagctaatgataagtcaaaagtatattcaattgaatccttccttttggcttctaaatatggataagggcccctt

SEQ ID NO: 56303 - DNA, 3137 bp, Oryza sativa
  unsure (1)..(3137): unsure at all n locations
aaaggattgaatcctatccaattctttaaaattctaatggaatgggtaatcctatgcacattttggaggaaaattagcaagaggtctaacctcttggaacatttcctctgagtctatctctctcatctgattcctgcgtttttcctgtggtccaatcaaacggccattcctgtgtgtgtttcctgtgttttgcaatcctctgtgttttacagttgtattcctatcagaatcctgtgttttttctattcctttgttttttcattcctacgattcaaatgggccctttgggaaagtggccttggtagttgcagaaaagctgtacccgatcttaaatttgaatataccaaacaaacagatcagcaagcgaacttcgttgaaaactactactaatggttattggagtacccggctcgatctatgtcttgttattttcccaagatcgttcaaaattttcagcttggtcggtgaagccaacaaaaattcccctcggcaagttggtacttggtagcagacgacgactaagcaccatgattccgagtcgttgcccttgtttttagctaagcatgcgttgatctgagcagtccaacaagtgatacacagagtttttttggcaaaagaaaccggtgcattgcagttagcacactgcagtattcagatttcagtatcaactcgcctgctgttctggaacatccttccctaactcttagaccagcaattcagaaagtactactacaattcagaaagtacttggaaatcttgatctcaatggcaacaacaatgaacaaacagaattgagcttttacactcgaacagactaacagaaccttcagaaatcaagaattctctggtcagtaaagtgacccaggtctgaacattttggcagtagagaaattttacggttcttaaaaagtacctcaagatatttattttttcattaaaaatcttagtacctcaaaatatttagcatccaaagttaccaaaattttatagtagaaaatatggtacctcctgtactttttgaaatatatgataaattgtccttgacaataaggcaatcacagatgctacaattatgtcggcatggcaaccatatctcagaatttcgatgcaactagccgtaggcccgtagtagcctctgctagagtgctagttgacttgcccgtaacgtaaagccgcatgcatatggtacgcccatctcaatcttctcctgcatatatcgttcccgccaaatttcaagtcaaaacctctcgccaaactgacacctttcgtcaaccgcggactctgaccgaagttgacggctgatgcaatctgttctctatatgcataatgtatttgcgaattgagatttgatcatgtgtttgcgtgtaaaagggagaaaatttgtgagcaaaatggcgcatcgcaattcgccagccatgcatacgcgtggtggtgggctgggctggcctccgcttggccacgtccgttttctcagtacaacactgacacttacaacacatccacactcatccctatagatgtatgtacgtaaattctacacctataagtatcttcgaagattggaccaataaatcctataaatctttggtacttacagtatcggatgcatcgagagatactaaatcttacattaaaaaataggtatcttctaatattttctcaatgactttaaaatcactctacctcgcttagttgcacgcatcgattctttgcatctgtcacgcatgtgagatgccactcaccgagatggctgcgccatcttgttgcttcatccactaacgcaagatttgggttcagacttcagctgaattctactggttttgtagcttctttcttttttttcccctctcttttgccggggcagcccaagcagagtgctcctcgcactatcaggttgccaatgatgatgacagtgttctttgattagtccatgctaacggccgagcgaaaccaaccgaaactaactatattcaactaaaatcttttcctggctttctgaatcatgcacggtatgctggaagtgtattcaattactagtgtctgatttttaatttttttaagggtatttaacacacgtctcttttccatatggctaagatttcttttctttttctttttcttttttgcggggacatatggctaagatttctgattagtggtgaagccaacctttcttaacattaaccaaagcacgtgaacttgcttctgtcttgttcgtcttgtgcacgctgcacagtccaatattttcagcatgatatcttgtccgaaaattttatactactgttctctcggtgatcaactgatcaagtaccaaaatgactctgaaatgcagtttaatatatattttttgtgtgtgtcagtactagtattctccattgtgcaatcttaattttctttctggcagatatatgaacatgctttaaaccgctcgtacgagaggttagggtttattattggtcctgtgttgattagaaaggtgcctttgtggaagccaggctaacatttgccctgggtcctgggcaagttggtacgaatcaaagacatagagtgtcgtttatacctaagcatgcgctgatcttaatcctgattcctgaagagtccaaaaagtgttcgtcctatctgatggcacaactgattgctgaaaagaaaccactttcaactggtacaaggacaaatttagcacggtggattcagaatataccactttcaacaggtctaccgtttgaccacccctttttgaaccagcaaaggattttacaacagaagaaaaaagaagtccattttactctcttaaataatttcattagatcacttaacgcctaaattacttttggctcattttactcctaaactattgaaattagtccagtttactccatagtagtaacatttttctttnttgtttctctgtatataagctagtagtatattttaagctataattttttagagtcatatgataccattatcaaagttctaaaaatatattcattttctttcacgactgttttcttcaacttataatctcgatgttcaaatcaatcccctaggtacttccaagttccactcagataaactgtggtatgaacaaaaagtattgagatgtgagatgtatactattatcgtcctaccaaatt

SEQ ID NO: 56304 - DNA, 10118 bp, Oryza sativa
tttatatgcacttgcgattttgattttgatttgatcccatggttgcatggagaggaataaatttgcaagcaaaatgtcgcagcattacacgaagacgatttgcattgccgtcgtcttggtggccgtgctgttctcgttgtcgtcggcggcggcggccggctccggtgcggcggtgtccgtgcagctcgaggcgctgctggagttcaagaacggcgtcgccgacgacccgctcggcgtgctggccggctggagggtggggaagtccggtgatggcgccgtccgcggcggcgcgctgccgcggcattgcaactggacgggcgtcgcctgcgacggcgccggccaggtgacgtccatccagctgccggagtcgaagctccggggcgcgctctccccgttcctcggcaacatctcgacgctccaggtcatcgacctgacgtcgaacgccttcgccggcggcatcccgccgcagctcggccgcctcggcgagctcgagcagctagtcgtttcttcgaactacttcgccggcggcatcccgagcagcctctgcaactgctcggcgatgtgggctctcgccctgaacgtcaacaacctcaccggcgcaatcccttcttgcatcggggatctgtccaatctcgagatcttcgaagcctacctgaacaatcttgacggggagttgccgccgtccatggcgaagctcaaaggcatcatggtcgttgacctcagctgcaaccagctgtctggctcgatcccgccggagatcggcgacctgtcgaacctgcagattcttcagctgtacgagaaccggttctccggccacatcccgcgggagctcggccggtgcaagaacctcaccttgctcaacatattcagcaacgggttcaccggcgagatccccggcgagctcggcgagctcacgaacctggaggtcatgcgcctgtacaagaacgcgctcacgtcggagatcccccggtcgctccggcgttgcgtgtcgctgctgaatctcgacctgtcgatgaaccagctcgccgggcccatcccgccggagctcggcgagctcccgtcgctccagagattgtcgctccatgccaaccggctcgccgggacggttccggcgtcgctgacgaatctcgtcaacctgaccatcctggagctgagcgagaaccacctgtccgggccgcttccggcgagcatcgggtcactgcggaatctccggcggctcatcgtccagaacaactcgctctccggccaaattccggcgagcatcagcaactgcacgcagctggccaacgcgagcatgagcttcaacttgttctccgggccattgccggcggggctcggccggctacagagcctcatgttcttgtcgctcggccaaaactcgttggccggcgacatacccgatgacctgttcgactgcggccaactccagaagctcgacctgtcagagaacagcttcaccggcggcctgagccgccttgtcggccagctcggtaacctcacagtgctgcagctgcaggggaacgctctgtcaggtgagataccggaggagatcggcaacatgacgaagctcatcagcctgaaactcggcaggaaccggttcgccggacatgtcccggcgagcatctcgaacatgtcctccctccagttgctcgatctggggcacaatcgcctcgacggcgtgttcccggctgaggtgttcgagctgcggcagctcaccatcctcggcgccgggtcgaacaggttcgccggccccatccccgacgccgtcgccaacctccggtcgctctcgttcctggacctgtcgagcaacatgctcaacggcacggtgcccgcggcgctgggcaggctcgaccagctcctcacgctggacctctcgcacaaccgcctcgccggcgccatccccggcgcggtgatcgcgagcatgagcaacgtgcagatgtacctcaacctgtcgaacaacgcgttcacgggcgcgatcccggcggagatcggcggcctcgtgatggtccagaccatcgacctgtcgaacaaccagctgtccggcggcgtcccggcgacgctcgccgggtgcaagaacctctactcgctcgacctctccggcaacagcctcaccggcgaactcccggccaacctcttcccccagctcgaccttctgacgaccctgaacatctccggcaacgacctcgacggagagatccccgccgacatcgccgcgctgaagcacatacagacgctcgacgtgtcgaggaacgcgttcgccggggccataccgccggcgctggcgaacctgacggcgctccggtctctcaacctttcgtcgaacaccttcgagggccccgtccccgacggcggcgtgttccggaacctgaccatgtcgagcctgcaggggaacgccggcctctgcggcgggaagctcctcgcgccatgccacggccacgccgccgggaagaagcgggtgttctcgcggacggggctcgtgatcctcgtcgtgctcatcgcgctgtcgacgctgctcctcctcatggtcgcgacgatcctgctcgtcagctaccgccggtacaggaagaagagacgtgccggcgacatcgcccgcgactcgccggaggccgccgtcgtggtggcggagctgaggaggttcagttacggccagctggcggccgccaccaactcgttcgaccaaggcaacgtcatcgggagcagcaacctgagcacggtgtacaagggcgtgctcgccggcgacgccgacggcggcatggtcgtcgccgtgaagcggctgaacctggagcagttcccgtccaagtccgacaagtgcttcctcaccgagctcgccacgctgagccggctgcggcacaagaacctggcgcgtgtggtcgggtacgcgtgggaggccggcaagatcaaggccctggtcctcgactacatggtcaacggcgacctggacggcgcgatacacggcggcgccgccgcgccgccgccggcgccgtcgcggtggacggtcagggagcggctgcgggtgtgcgtgtcggtggcgcacgggctggtgtacctccactccgggtacgacttccccgtcgtgcactgcgacgtcaagccgtccaacgtcctgctcgacggcgactgggaggcgcgcgtcagcgacttcggcaccgcgcgcatgctgggcgtccacctgcccgccgccgccaacgccgcggcgcagtcgacggccacctcgtcggcgttccggggcaccgtgggttacatggctccaggtaaaagctacttcctccatttcagattataaaacgttttaactttgattaaggttaaatcgttttaagtttgacgaagtttatgaaaaaaaaataataatatttttaactcacgacaaaattattataaaaatatattcaattattaatttgataaaactaatttagtttgggtataaacttagttaaacttaaaacaggttaattttgatcaaaattaaaacgtctggtaatcggagggagtaccaaactaccaatccaaccatttcgtctcagtgatctctgaactgaaaacgtctaactctgtgctgaaaaaattcagagttcgcgtacatgaggacggtgtcgacgaaggtggacgtgttcagcttcggggtgctggcgatggagctcttcaccgggcggcggccgacggggacgatcgaggaggacggcgtgccgctgacgctgcagcagctcgtcgacaacgcggtctcgagggggctcgacggcgtccacgccgtcctggacccccgcatgaaggtcgccaccgaggccgacctgtccacggcggcggacgtgctcgccgttgccctgtcctgcgccgcgttcgagccggccgaccggcccgacatgggcgccgtgctctcgtccttgctcaagatgagcaagctcgtcggagaagactgaacaaaaaaaaaaaagaagagaaaagctaaactctcgctgcaattctgcagaatgcagcagcgaaaacgtgcaaatttcttggaagattcagagttcagttcatgatgatctcaaatggtttttcgagttgtttgcattgcgaactttctccattgatgaggtgtactgttgctactgtgcatggtcaaggagccgttcgtgtgagcttactgagggtgtgttagttcttcgggagtaaagcttttgaattatacagacacatatttgaagtattaaatgtatactaataacaaaacaaattacagattctgcctgtaaactgtgagacaaatttattaagactaattagttcatcattagcaaatatttattgtagcatcatattgttaaatcatggcgtaatttggctcaaaagattcgtctcaaaatttctatgtaaactgtgcaattgtcaaatcatctgcaattctgcacaatgcagcagtgaaaacgtgcaaatttcttggaagattcagagttcagttcatgatgatatggtttttcgagttctttgcattgcgaactttctccattgatgaggtgtactacttatttgctactgtgcatggtcaaggatccgttcgtgtgagtttgctgagctgaattaattgcgaggaacagtgcaggtgcagtggttaggtatcaatctcgcccatgctgcctgaaagcatgggtctgaagtggtaccaaagtttctgccttttgaccctcccaaaactttcagagctgcaacatacctgtatgcgcaggccctgcaggtgagaatggaagctgaaagattgaaagattcgacggagctgaaaacaatatattactcgagctgcatgagtgcgaacaaaagtggtgaactcatcacaaacatgttaacgtgaattatggcttctcagatgtagatgtgtcttttgaatccccggcagtagcttgttgctgggcagaagaatgtctcctgataactctcatttactactactcaagattaggtgcagataatcaatgccagttttgtcattacaatccgttcataccacaagtacatatttagctaggaaatatccattgctgcaattctctggagtacttgattaaattagccatgttgatttgcttgtcagagcacataagcatcagcagcaggaagtagactgtctgctaatatacagtacagagatcacaaaaacgctttaggtcttgtatgcacagaacatgacgaggaagcaagatcaggatcaccactatttattgacgtacaaaattaactagttaactgcatgcagtagattcatcactccattgagcaacttgtttcatctccaggaacaccatgaactgaatgaaggttatgcagtctagagtagtagagtctagactgcatctgcttctggatctcttagtaactcgtcaggtggtcatcactccaagaagttgtacgatgaattcctctccgtgatccaaccgctgttgtggccactgctactagctagacctcttctctgctgctcctgcattagggatgaacaactactcatcagccatgacgcatagcttttttttttgaacgaatcggcaagctgccaatttcattgaatagagaaggagtaaactttacaagtaagaaaaaccaggcccaggaccgaaggtcctactgagctaaaaataaaaagcaagccagctaccaagaatgacgcatagcattgttcatgtgcagaaagtctcctttttctcaagcacttatagtacatgtaaatacttttctgaagtgttaattagtacatatcatgtaacaatcaaacaccatagacatacataacctcatatcaggaagataaaagctgtactaataatggcgataaaggagtatatatggactacgtaccggcgtgtacaactgcaattttggtggtctgaggaaattttgaggtggctctgaagggtgcaaattctgcatctggctcaagaaatccgactcgacgttagactgtctctgttgggtggcgtgggttatctgaaatggccgcggctcggaggggcgtatgggaggaatttgagaaggatcagctgtgatatagtgcatgtattgttgcagctcaggaggaacaaccggtgccattcccttccccatgaccagcatctgtgtgcatgacatgattatgatcagaaatcacatgaaataaattgcatcacttgatctctaccacagtttcagatataacttgcataaaaagatcaggtcttggttctaataaacctgatcatatcttatgtttgatgctatttgtacctggagttgtagttggagtgatttcaggtagtcgatcgcttcatccagcatcgaaactttgaagaaagaagaaacaagaagattagaagttcagaactgaatggctctacaagatcgagatatgtatgaccaaagatgcaccacatattgcataccttggtgcaatttggaagtagctcttgcagcgccttcagcttctcattgatcctatcccttctcctctacaggtatccagatcaaagataagaaacaccaagtgcttataaaccagcaattctgatcgatttgcatgataacaacctaccctttctgaaaaattgtggaactcagcagatctgcttctcctggtaggggtaggccttcttgcttccatcggatcttttcaagaatatattcaccttcctggaaacaagatgtgcaataacagatctaacatttaaagataacatacaaacaagaacaatggtaaaactgtctgaaacgtatgaactactcctaagatcatcagcagagataggatcatgttcttccttgtcatgcatacctgagttttggtgtctgctcttcttcttggctagctgcctccttgccttcacctcctccccttatgaactgatacaggctaccaatggctgctagctggtccagccctaagctggcctagagatggagagttctgagagctttcttggtgacaagatggtctcctcgacccaccaacctttagctccagggatagtagtatttatggcatctgaattctataagcttttgcaccatggcatgcagggtctgcgcactgtagttatccttatctttttcactcaccggccgtggaatttcttgtttggatcgatcgtcagcctctaccatgtatctgagtctctgatgggactttgtttacgatttttggagaggcgcccataaggtcaatcatttcacctaccttgctataggtgatggctctaacttgacttgcaaagaaagagttcgtcaaggtacagtactatgcatagattgtttcttcagagttcagagtagtgagggctttctgcataaagacatatacagtagattagtaaatgttgagagaaatcatgactgatgaatgtgaaactagtatgatgtttgtcctactgtaatctgtaatccttacatgcatatgttgttcagcaatattttttttgaacgacctacaccagacattgcgaagattcattgaataaagtaggaaaaaaaattgcaagactagaaccctgggatgcaatagccaggaaagaatgaagaaataaccacccccacgcgccgacaacaccttcacacaacccaggagaaggctagcactggacagaccgcgctagaccaacaaagaaactacaaccgagatcgcccaaaacccaaacctaacaaccatgaccggacaccactctatccacatctttggattgttcagcaataatttcaattatgattgaggatttgttaatacttgggtattatctgaaaaatttagacatgattcttgagctgctaaccaccaacactgtttgctcataaaaccgctaaactttatttttagataatgatagaagaataaaactagtgacaagaaaattgctagtaataaaaatgatagtctggttctggaaaatttgaagatccaagattaattagcatctgattggctgctcatgtgcatcctttatgaacagatgtgactactgacgatcacaattaaaaagcatcgagtagacatgtgcagtgaggatgctggctgctgctagtagtgctagtacctaacatgatgagcagctagctagcaagcagcccatgcgttatttctgaacacaaaaccctcggaaccagaagaatgcatggtatggtgaagcaaattgaagcagcaaagaaacaaagaacacaatcttctcctcacccctaacccctacacacatacaattctccttaattaattcgatcgacatcgatcttgatgattccctgcaaaaccaagagataactttcatcattacatatatacattcaggtgaagaaattctgacgatgatgtggtgaggtgaggtaattaagggtgagctagcatcgtcagcggaaagggtagagtccaagaatcgcccatgccgctgttgcgagggggggatgaggtggaagacgcaggaagggaacaaaggaggcagtcacctccattattttggttgctttcgtagcccgaatgcagcagctagtagaggccaactcctagccctagccctcctcctactcctctgcaatggtagattgcgccggtgactgcacgcgcgtgcgagcgagcagccgagcatgcgtactgccaggttcaggttcggtgaccacgctgacaacagacagattccggcagccaccgcgcgcacgcgtgacaacgcccgattcgctgcgtgcgcgactcgtcgccatcgccatcgccgccgccgccgccgccgcaggtgggcggtgcccgcggcggcggcgttggttagttggttagggccgaatagatccgcgcgatatgggccgaattcgccgggaaaaattgggcctcctcgaggagactcatgggccacgttagggtggagctgaactgatgggccgaactatgtatggttgggccggggatgggccgacgccgcgcgaatctcgaggaggaaccggatgcctcgttctcccttctccgagacgagatcacgagacagcttggctgctcgactcaacgcagcacacgcaagaggagtcgtgggagtccaggagaggaggcggaggcgcggaggagagaggaggaggaggaggaggtggttggtctccgccatggcgagctcgtcgtccgaccccgacaagctcatgtccaaggccgacaagctgcaagtcccttcatccccccatctctctcgcttttctaactccagatgatccgcgagcgccccatccgatttctgtcccttgtttttttagattacggatttttggcgtattttctgtgaatgaggccccttactcgagcgtattaagctgcgccctcgtcaaattcatcacgtcgtagttggcgaatgttagattttgcgttttggatcaaggactgggaactcgtgtggatctgtacctgatctgtagatgggggcagggctaccgttcctatttccaatttcgtggtaccgatttaggattttctcaggagaggaattgcctgtcagtttagttttagcttagtttgtttggtgcaaatttggtgagattttattcaaggtcatgccatgttttggggggaaaggtcatagaagcgagcgcggacgctttgttttgcggcaattttgtttacatatgtgtgctgtgtgggagttaccagcagactttatctcctactatgtagtattcgattttctgttcaaatatcttcagaatacagaatgcaagtacgatacttgtgctacctgtatcaattcagcagtggatgtgcttgtctgtgtaacttcagaagtggaaaatcagccactcgtcatcatttacagtattgttcagaatggatatatgtggtgcaccattgtttagacatgcaaactagagttcacttccagcactcgcacagaaagattacttctcaatgtgtctgattgggatatcttgtttgctctcgttttcatgccagtgcttttgagttgattttgatttaaatactgtcattgttttcatgtacttcctctgtttcgcgttataagacgttttgggttttaaatagattcgtgtatgatccatgtatgtgcttcatatgtatgtcaaaattcatatgaatgttagtgaatctagacgagtgatggaggacccaaaagttctaagtactctctgtcttaaatgct

SEQ ID NO: 56305 - DNA, 1371 bp, Oryza sativa
  unsure (1)..(1371): unsure at all n locations
tcacgagatgaatgcgattggaagagtgctacctccttgtatgagcaagctggtccgttactttttntgccatgttctattttctttctgtcaatttgcttccctgtggtgtatatgacagaactttcatatctactttaaagctattgcttataggttcaaaaaggagaatgagaaagcaaaggatgcctttgagaaggcttcaaaaggacaggaaatgatttcttcgtatccttcagaaaaaaaatttatagctgttgtattttcacatgattgaactatcacttaatgcacccttaactagtttaatataccctgggatgctgctaaacacatggaatctgctggtgctttagcgaaagagcttggacgctggaatgaagtttcagatttttatcgcagagcatcagaattctatcgtgaatgtggaagagcacaacctgcctctgatgctcttgcaaagggtgccaggtaattcaaaagaaatctgaaacttacgtgaacattgtgaaggattattgttctaacttgatgatatcagtttcttggaggataacactccagacgaagcaataaaaatgtatgatgaggcctgttcaattctagaagaggatggaaaggaacagatggctttcgatttgtatcgtgctgctgcaagtttatatgtcaagctcgagaagtaaggatattccaacatattccaacctgcttaatatttgtttattatattattcttctttccattttttcttttacggatagtttttaatctttttctttcttgctgggtaagttgtcattgtagaaggaattgtcaagtaaaccaataatatttgatcctttgtggcacttgctttaatatcgattatatgtggactgtctctgttttgatataatcacttcccatctcacacttctcattaattacaggaagttcttttcatagacctactagcatatctgtgccggtccatttttcctgaacagtttaaccttactactgtgacggttcttgatagatttttacattcaccctttgaatgattagagcctatcaaattgtttaattgttgatgatttccattcttactacaacctttcaagcttgaagttatcgggaatcaataaattgtcattactatgcatggttttatttaattctgcaacaatactaggaggtttcgctgtacgtctgtttattataactattgaggtcaaatgtacctggctttgatgtgctgtttaggcgtacccttttgctctttgcttgcacatgttttcacactttcttctatggttttgctctttgtttgcatgcattactgctaatctcatttctttgctcattcgcatttattcctatctttggcg

SEQ ID NO: 56306 - DNA, 1765 bp, Oryza sativa
cacgggccacaaggaagcaagagaggagagcggttacgcgggtttctcgtgggacaacgcgccgcgcgccggggaggagagagagtggggggggggagctcaccggagacggccggatctcgtcggcggggagggggtcgccggagctagcggtcggtcgccgacgaacggggcccacggggggggagcgtggggcggtggggaccaccgtcagtgagacggggagggcatggagagcaagttttggagggctagggggaaagccgcatatatatatgtgccccccaccccatgtgcttaagcccacacaagggctcaagtgccaaatggattaattgcaaagctttgctttttttttttcccttttcttttccctttctttattattacagtattattttttcttgccttctctttcatcacaccacacaaacaatgcttctttttttaccacctcggtaaacatgcttgatcctactgttatctcgaaaccacccccactaattaaaaaattccactcttcctattggcggcattcttctgccttggagtacaatttgcagtactgatatactagcagtacaaatttctgtgtaattttcactagtactagttttgacatctgaagtaaaatcaacatgtctactttttttttcttgtaaaatcaatgaagaatctttgagtgaatgcaggatgaggatgaactgatatatataatacaagtactaatttctgtgtaattttcactagtttttaaatctgaagtaaaatcaacatgtctctttttttttgtaaaatccaagacaaaatggaaaatctttgagtgaatgcaggatgaggacgaggacacacgaccatgcatgcgcacaagcacagctgctgaacatgttgcaggaggctggctgtactttgctcttcttttcctgcctctcaactcttttttttttcttcttgttataatggaatgttttttttttcacagtgtactttcctttcttctcttggattcagggcagcgaggttggaatggaaaagaatctctagagagagagagagaatgaaagagagagagagaggtggtgaccgaaagccaccacttggtgtaggccatgcacgaccaaattaatttacgcacgttgaaacggcagacagatgaaaaggacgccgcattatcctgtgattatttattcgtgattttctgctttatattaagagggaaatgggattactgttatgcagtactcccatcgtcccaaaaatataaaaatatagtatcatcggaagagatatttaatgtttgttcagattcgtagtttttatattttcggatggaaaatttataccacctaatagaatataaaaataaaaaacaatgcattatccctcaattatttctagtgcctgatatgagagaggttgatccaaacaaaaggcaataatatagtgaattatttacgcaaaattaagaggacggtgcatgatcagagatggattggaactgcacgggcatacagtacctggagtttatgccaaaaaaatgtatagtagagtattttattttattattacctgtagtgagagaaactatagactcattagtaggaaaacattactttattaaccgagaggtctgtattttattccacctacatttgtttaatctggtgccaggctgtccggtgtggataaggacggctgtcttctcaaccgggtaaagttaccgccccggtaaacgtgaaagttacgcactaatcgcgctcgctaa

SEQ ID NO: 56307 - DNA, 1790 bp, Oryza sativa
tccaaaattcgttcagcaaccaacaccattcacatatatagccagaaatacttaggctgtgtttagtttcccctcgttctcaacttttcatcacataaaaaactttcctacacatataaactttcaactttctttaaacttccaacttttttcaggaactaaacacacccttagagtctataagttttgaaggaattttcacacaaaaaaatagaaaaaaaaggggaataaacccacattccttttacttttcctaaacccacattcctataaaccgaaagacactcataagaaaaaaaaatccttaaaaatttaaattctttaggttttcttcaaaccaaacaaacccttaaatcacacaacgaaatgcctggctaagagaacaggacacgataacacgaatggatcaaagaactatcatggatgatggaatatggttgtagcaaggcgagaagcaagcacgacgagatggcccaagaagaagaatggtacgtactcctccgctggcgtggagtagtagtaggcgagtataacgctagctgttgcatggaaatgtgcagatctagttgccacatccgggaggccgcctagcctagcttagcccggccggggaggccccacccaaacaaacagggtggcacattgcccccctgtagcctgcactgcaacaaacacacattaacaacaacaccacacacactcgcacaaaattctctgacctgcaacaacaaaaaaaaaaaagaaaagctttctgtttctgttccatagatgcacaccccccacagtagcagtatataaatgtgtacacgtttagctgtgtattccttgcaatgccagggagtagctttacgattcggttgaggctcatcagctgcagctgcagctgctgttgctgctggcagagtgacttgattccgtgctgccgtgctacgtatactactgtatccgtggtagatatagaccatgtttagtgaatctacatgaagtattcaatatgagctaataaataaataattatacagattgcgactaatttgcgagatgaatatttttaacctagttgctccatgattcgataatgttgtgctacagtaaacatttgctaatgacagattaattatgtttaataaatttgtatcattgtatcgttgtttactgatagattttataattcgttttttattagtgtctgaacatctcatatgacaccttatataatacccgatatgacacaccaaaacttcaaaactttatgcctcttgatctaaacaccccgatagatagatagctcgatactattactactagaaagggaggagaatcatatgctacaagagggatgcacgaatacactgctaccataataagggtactactacgactccagcagcatgtgatgcgtcattatggagattcaaggcgcctgacattgcatactagcgcacttaataactgtgcgaatgggggtgaacccttgtacgtcaccgcctcaaaagctagagaattagtagtagatcaagtattaacatgcgtagaagtagaacacatcgagttatgatgcggatacacactacagtggcatctaccagtcatcacagtgtttgttggtgtgacctaaagctttggttaataaccagaaaccgcagaatgtcgctacacatgcagcaaccattgatcgatcgcattgatcagtagggccgtgccggcaggaggcaagggcactagtagatctatccatccatctatccctatagctgcgcgaagaacgcgcagcggtatttattagtgcc

SEQ ID NO: 56308 - DNA, 931 bp, Oryza sativa
gacccatagaccctcatacccccatgacatgcaagtgagggtcactgacatgtgggcccctagaccctgatgacagtgagcagctacaggatcacactaatcaagtactaaaacaaatgtattcatcggcaaatgatccaaatccacaactggctggagtttcgccatctgaatacaatcgcaacagaacagccgggacggttgccctcgtagtacatcggtgtagaagtacagatagatcaagctgcacgagaataacaaaccaaacaatgtaggatgtatatgtgcagaaatcagatatgacagttgagctgagcatgataaatatcaagatacagactgcctcacacaagtttgtactttgtaccgtgtacatcgatatcttctttttacaaatcgctcatgttcatcaacggtaacatgagtcaacctcaaatatttgctttctcagcgtctcccggtacgggtagtttggtattaagttaggtcattctcgtccaaagaatcctcgccgtcatcgtctgccaatttcttgatggtctgcagatcacccgtaggtagtttctttgcaagtcgaattacctgcagtaatattcaccataaatcgaagtgaagaaggatgaacaagcacacgaacaatcgagcagatatcattttagatggaacagactatgttttagctgataatactattatttgtcctatggtatgatgataagtgatggcctgataattgatgaggtatcactgcttaatcaaatgatccaggaatcaatatagtatagagcggtaatgttgactaaaaaagagatcatgagtaacatcttcaacctgtaacgcctcagctcctagcacactgttttacgcatactaactatccaatctgtctaatcgtataaggagattgaaataacagcctggtatatatagt

SEQ ID NO: 56309 - DNA, 1219 bp, Oryza sativa
  unsure (1)..(1219): unsure at all n locations
agctctcagacccattagcagactgctttggcatcgtgtatatgtgatttaacttgctttcatcaagtacttgatttggatttttatgtgctacaggttcctaatgtcaaatgggaggacgttggtggtcttgaggaagtgaaaaaggttattctagatactattcaggtaaaattttcttatgttcatcaatgtttattgtaacttaagaatatgaagctgctttagtaagtttgtgaatagtaatttgcctcttttctttgctatacagttacctctgttgtataagcaccttttttcttctaaattggggaagcggtcaggtgtcctgttgtatggacctcctggcacagggaaggttggtttacggtgtttttctattttatactttgtttttagttaagctttaccttttcgtttcttcccatctgtccaaagaggataagcacatagaaaagcaatgtatacgtgctcattattattatgtttcaatttgcagacattattggcaaaagctgtagcaacagagtgctctttaaactttcttagtgtaaaaggtccagaattgattaacatgtatgttggagaatcggagaagaatgtaagggacatttttgagaaggtaaattgatttacacaaccatacaattgccataagatgtgcatatatgcttacggttgcaactcttctgtcaacctcaggcaagatctgcacggccatgtgtaattttctttgatgagcttgattcccttgctcctgcacgaggatcctcctcagattccgcaggtgtgatggatagagtagtttcacaggtatggttgttttcatcactgaggcagtgtctcaatgttttttttattatctctgttcaaatattggactttgtggtctcagtttcccctttcctctctttgactctttgttagttgcttgtggagattgatgggttaagcgataacagtcaggtattatccttgttcataccaatttgttttcctacttgttttttttttcctgagatgctttgacatgaaggggaaccattttcccaattcttttctaggatcttttcattattggagctacaaataggcctgaccttcttgattctgcacttctccggcctggccgctttgatnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56310 - DNA, 848 bp, Oryza sativa
gtacgtacacgatcgatcgatggcgcggatatgtcaagcgagtggccgaccccccacgcaacgttgtctgccgccgtacgtacatctccggcggtcagactgtgatcaactgtcatatgcattccaacatgtggtgggacgtcggttggtggttaggctgctcctattcccactgtcccaaagaacgatctattgatgaaatatgacatttattagtacaatgtatattaaaaaaacatcatgttttattttagattagtttttatgaaaaaaaatacgttgaatggcttgttcatattgatgtcatttcaaatcatattattttttggtagagtttttgcaaaactttagtatataagaaatcctactaaaattttaacaatattattaaattgtcaaaatttaataagatttattttgattacaatttgaacagcccaaaatattgaatggttgtcagataggtgtgcacgggccctattacaaaattgatgaatgatagtgccaagttgacaacaaacgagagctggcaatatttaacaataaattaaataatatgaaaaaaattaataattacttaatttttttaataatacgaacggtcaaacgtgttttaaaaagcaatagcgtcaaatatttgatttagagatgaagggagtattgtactagtgttttaacgttttttattgcgacaagtgttacgtatctctacgcgacagttgctcaccgatcagcacacgttgttgaacttgaacttgaacacatctcttcgccagaagttaatgagcaccaaataattagctcttggcaaccatttggtcctttttaacatctgacttccaaaaaaa

SEQ ID NO: 56311 - DNA, 1284 bp, Oryza sativa
cctacgattcaatatagtgtcacagtttgagatctcaaattcaaatatgtttggtgcattaattaatgtaattcaatatggtatcagcacaaaagacctcgaattcgaatccagctaagtccttagctgcgatgcaattagataaaaacataaaacctattaccgtttcacacttcaggttttaggaggcgtatataagtgaattctccacagtttgttaaaaataaatgataataaatttatctgctctaaactatgaaggtatagtatcaagttaattattgatgtccacaatattgataggtgaaaaaaaagatggaagccctatttttagccttttctcttagtaatatcagatttgatttgtacgtcaaaagaaacaaataaacaagcaataaaattgacaaaagacatgtttcaactaattagtttgtacagctacaaattgaagaaaaaccaacaaataaggaacaaagagattaacaaaggttgggcttctatatatttgcccagctgcaggtttgatccgatcctacgatcataatatctatttaatttttttttcaggaggtatatatatagacctacacgactgatccatctcaataagtaaaacttatcagaatgtttctgtatcactaaaaaaagaaaaagaaattaattgaaaaaaaattcgtttccaattttttttcttttccaaatatttttctctgatcactcggtgtcgtcggccgccgcattcaggtcaatcttgggcttcttcccgctgccgtcgccggcgccggcggaggcttcccggggcttcccggcgagcggcgggacgttgccggcgcaacgcgggcaccgggggtccgcctcggcgatgagcacgtaggtgaggcaggacgggcaggcggccgcacgcatggacgggctcgcgggcgtcgcggcggcgccgcctgagggcggcgagcggtggcgcttgccgatggaggaggaggacgaggaggtggacgccgacgacgacgacgacgtggccggggagccacgcgcggcggcggcggcggccgacctcccggccgtggcgcgctcgagcgcggagcggaccatgtcgagcgtgcagaccgcggccgacgtagacgcggccgcggcggcggaggacggcggcggaggcaggttgaggtcttggtggccgacatggacgccctggagccgaggagtcaagaacgtcttccctgactgcaagaagaacaaaaaaaaaatcagtaaactccatttcttcaagatcaaaccaagaacatggca

SEQ ID NO: 56312 - DNA, 2583 bp, Oryza sativa
aactcagaaatcacagagcgctcacgagatcagagagagcgaggactcaccatgagatcaagccgcctctcccacccggcgggaaccttcacctcgaggtcgaccaccttgtcctcccctccgccgccgccgacgacgccgccgcggctgtcgccgccgcacccgccgagcagatccatcgtcacgacctcccccgccgccccgcccctcctcccggcctcccctcgcagcagcctcgccacagagctcacgtccgccgccattcccctctcccccgtggcggctttcctctgcttctccgcgtcgccgcaagaagaagaagaatcgaaagaagaagaagcggtggcgctggtggtggtgggcgcggctcgcctatatatatatagagggcgcgcgccgccgtggccgacaggtgggacccacgcggcgaatgggcggccactaatttattggtgttgttgggaaatggttgggggaattattcatgccaattaattccgatttctagggggaaggaggaggaggaggaggagaaagaaagaaggcctctctctgtggtttgatctagtcgagttttaaatgcattttgattttttggatttgttttggtttaaagtttgcatttattctgcattccatatacctgtggtgtggtgccacatttggcattcagaaaaagatgaagaaaacctgatctgcccacctgtaaattgtagtaatggttcatttagagagggctatttttatgcagtgatgcaaatatattcatttagtgtcatgtctttaatgagaaatgatcctcaatttatttgcattattcagttccttatgtgtagttattagttcatctagaaacagatgttcattatgatattcattattagttccatctaccatgaaagaacatgctatattaatttatatgcatggcgcgtcatctgtttttagatatataatcttattaaaaataaatcacaatgatttgtcaacgaacatagctaaaacgtgttatcgtatatttcttggagctgaataatattaatctctttgtcaaaagtcatatattggagtacatgcacggtatggatactccagcagtcgtaaaaacattaaaacgtcccaaacaaacctttaattctttgaatggcaacatctttttagattgattgtataaaactcatatattcataattatcttaaaaattagctctcaatatgatctcaatgaattttgtaaataatagtcatcaactcgtgcgttgcatggctacaattattcataaggtaaatcttagaattcgaatcatatgttcaatacatagattactttttctccaaattactactactacctttgtcctattttcgtattatttagcatatattaagatttgagaagaaagactaaggtgtccctcattaaatggtgtataggtaagagtggggtggtggttgggggtagaatatggaaaattttaaatcagaagtgattaaagggaaaattagtactctattataacaactattttggcacaaatttgaaacgtacagatacaattattatgggacggtgatagtattgcttagatttaaaagggagtccatgtcatttataatatgataattattaattttaatttcataataaattgagagcataattctaagtggtacaacttcatatttattagttacaaattattgaactttggaaaaaacttaaactcaagactccatgtataatggcatgttttatatcacactaaatctcaatatgatatatagccgtgataatacaatcaacttaatcaacggttagtaccatatctttttgttaacgtaaagggcactctcacactagatatatattcttttaaacagtctaatatatctactttctacactcttttatagacaagatgatagataggtagatagatagatagatggcgtgttcgtcgacatagggattcaagatgccaccgtcgtcaccctctagccctgccgcacggagagggatttggggatagatccaactatccaagggagttggacagagaagaggaaatacaacgagcggttatctgcgaagttgtaacaggagatgtgtgatggctttctatacaaacgctctggctgaattatatcctttgtattaaaattaaagggttgattgcattagtgcatgagggctggtgcgtgcatagaatacattgccaatcgatacatagatagatagatagaaatttgttttcataatattgcaattttaggatttttttaattactctttgttccaaattagaaaatggagggatgtccgtatatatttttaaaaacatgtaaaaatatctatattttaaaatggtggtaatattataaagatggtgctgatatgccaaatggcatgtattcagtgatccaattccgtaaatttgtggcaacccacaccaatattaaggaagtataatcttactaataatgatatgatccgaatattgaagaaaaaatagttcaggcatatgacagtaaaattttagtggccaaatagggtgtcatcaattcactctaaaaatgggggat

SEQ ID NO: 56313 - DNA, 1108 bp, Oryza sativa
tggagtattaactaagttagctatactttcgaacagaggaaataatttttagaattaacatagaaggttttcaactgctttcgtaactcagctgggttatagattgctaggatagaagaatataattattatgctaaaattattttcggttaattcagaaacatgttttcgtttttcttttagaaaaaaaagctttgaacagggttacaataatcatcttctccatttcccttttctgcgtacagtacgtactctgattttattttctgctacgttggacgaattatcttctggaacagtatgttaaggtgcattaataattaatttaaaaacaatattggttcgatgtagggccaggtaaaacgacctccaacaaaccaaattaattaaccaccaacgactgaatgctcatgggaaaagtagcttcctaaatcttcacactcacgagttaaacagccattaaatgcgatcaacttcttgatacttggactgcacttattaatgaacggattgtttgggcctttggttatcctcgcatttaatgcgaggcaatgctaatgcaggattctctgtgggggatgcaccgagttgacatgtgtgctctcaacgtgttttgttttactgggaagacccacctagaaatacacggggtattccggatagctccacagggtggtgagttagccggcttgtatttgatattaggtaattctctaatatttactgttttttttacaggaagacctacactctcacacactaatatacgtcaattcccttcagtttcataattcttgtcttgtcttttggacaatgatacgggctccgaaatatatcgttagttatgtatttttattatgatatatgcgataactaaatgcatgtttagtatcattatagtacttttgtaagacaaatatatatatatatatatatatatatatatatatatatatatatatatatatatatatatatatatatataagcattaagatttaagagtgaattgcacccacggtgcaacaacttggcaggtgggtgcaatttggtgtaataacttgaaaaatgagcgttctggtgcaacaacttagtaagaaggtgcaat

SEQ ID NO: 56314 - DNA, 832 bp, Oryza sativa
tgatccctttgagttttcccgaacgattaaccactgcgatctgcaagcggccggatccgcaggatcaggccaaactcctcgtcgatcgtcagtcaaaacgatcggaaatcgatgctgcacacacgcacgcacgcacctcagctagcaataactctcgacgtacgacgtcgacgtgctcactcatcaactccttcaaatcaatgcgagcttagctagcttagagactaacacgaattcaacgttctcaacttaagtctgatcgatcgatcgggtcgagcagtagtgaatgcgtgagcacgacagagcccgagtcattctagctagtataggtagatgcattatgcatgtagtatggctaccactgctagtttatttactactatacgtgctcacgtacgccgatcatatcatatcgtgttcaagatgttcaatgcgatcgcctgcctaattctttctccgagagcgacccggttttaattactggttacttgcacaggttgcgcaaggatgtcatcgccttaattatggggatgaaatagtctgaaaaccacgttgttgtttgccacgtagtttggtagtagatgatgaacgaatgtttttagtcggttactgtagtttgtattcaatcatgcttaatttgttacctcgtcttatggcccatctggtgtacgctaaatatgtacctaaacttagctttgtcgtgatacaatttgagtaacttatgcctaatcacgacctgtttcggcgaatagcgatgaacacccgcaaaaacatcacatcgaatttttttcacaaaaacatcacatcgaatttttggacacatgcatgaacc

SEQ ID NO: 56315 - DNA, 2202 bp, Oryza sativa
actgcttgtgtttggccgtgcctatacaggtcttgctatttggatgtacaatttactggcccgtggttggtcccgatgcactccaatgaacctgcctcgctgcctctttgcctcaggaagctttggtgagattgctattgttgctggtgggtgtgataagaatggacaggtgctgaaatctgccgagctgtacaattcagagactggtcattgggagactttgccagacatgaacttgccgaggaggctctcatctggtttcttcatggatggaaagttttatgtcattgggggtgtgtcaagtcagagggattctttgacttgtggagaggaatacaatcttgaaacaaggacatggagaagaatacatgatatgtaccctggagggactagtgcctctcaatctcctcccctagttgctgttgtgaataatcagctttatgcagctgatcaggcaacaaatgtggtaaagaagtacgacaaaggaaataacacctggaacatagtgaagccattgccagtcagagctgactcttccaatggttggggcctagctttcaaggcatgtggtgatagattgcttgttattggtggccatagagtaccccgtggtgaagtaatattgctgcattcttggtgccctgaagatgggaatggtggtgctgactgggaagtgctctcggtgaaggagcgtgctggtgtattcgtttataactgcgcaataatggggtgctgaattacatttctttcggtataatccgtatatgcctcttgtttagcaacccacccatttcttgctgctgcttagctaccccctataatgacctgtaattcagaaaaatgacaccccccttttcgtggagctctcaatgaaatgtttgggagagagcatagagcattcagttcagtttacctggaacttcttttaactcgttcaaaatttgtcttcttgtccagtatgaaatttatgcagtattctttattcatcatacttgctggaaagtgtgcctgttttattgtcctgagttcaatcacatttctctctttcctgattcatgtctgcaccatgcaatatctgttgttctgagttcaatcccatttctaccatcttaccctgattcatgtctgcactgtgcaaatgtcggtggtttgatgaacccaccttataattgtgcactgtcagatgtttccaatgctcagctgtccttgttattagaaatttcagagtggtacaattggcggtaaaaagctacttttgctaccttaccagtacactctctggaagtgatttctggcaatatgtacaattttcaggttctgtgtacttctataagtcagtggcatgaccaagtttatcagtgtaacagtttgacccgggaccttttctatccttttttttcgtgattcttcggctccaattttttctacttcgtttacttcacggatggttttaatctcatcatcgaacacttttggcttttagggcccacttgcaagcgacagacattgaactgcaactctctctaaaaacatgtccatgtccatgtaaataaatgtgaatgggttatgaatactcctacatattatctgacttgtgctttgttgaaatctcactttaaagagttgacgaagcaaacggtggtagagtacgatccagaaagcatatttgacatattcaggccgggcagtttttttttctgaatacgtcatacgcacagagacggatgatggccacgtacatggcctaacaaacttcagggttcagatatcttttccaggatttcggagctttttgatccgttccaaacttgtccaaaacgtcagtgtccgtagagacttggagccacttgaccatccatgtaatgcaattgtgtgtgtgatgttgccaccctttggacattttcttcctactgacagatcagcatgatgagctgcagacgccatggcatacgtacagcttcgagctaagatctcatttctgaaatatatttgagttcagacaatttttgtgtatgatttggtcaagtggtttgttagttcgttgcagagaaaaatttgatagactgatgacaactcagagatgtgaatcgtgcagagcttatctttgaggctttgaacatcttcatttcgagatatttacacccagatcgagaagcaatacgctgcctatcttaaacatctcctcgtcacaaaaatcaaaca

SEQ ID NO: 56316 - DNA, 2158 bp, Oryza sativa
cttcataaggcaatcttgtgttggtgttgcatctgccgctaacgatttccagtagaagaacaccgaagctatagatgtcggatttctttgtcacctggcctcggatagcgtattcaggtgccaggtatcctctgaacagaagtgaatttcaagtcagaacgaaagaactttccgatgtaaaccgagtaaataaatttggatttagttatgcttacaatgtgcctgcaactcgggtgctcacatgagttgcgttgggtggaaggagccttgccaatccgaaatcagaaatttttggggtgaggtccttgtcaagaagaatgttgctcgcctttatgtcacggtggataatcggagggcgaatttcctcatgtaaaaatgcaattccacgagcaacacccacagcaatttttacacgggtcctccaatcgaaccggatgttgctacccctagatcctgtaatatcacagccagaacatttgtaagtatggcagcgaaggaaggagttggtaaaggacaagttcgggaaaataatgtgttactacttgctttttttaaaagaataatgtgttacctagcaatgtctgtgcaagactgttgttctcaagataattgtaaacaaggatcctatgagatccttcagcacagcaaccaataagtgtgacgaggttttcatgcttgatgtcagaaattgctgtaagttcagtcaagaactctcggacgccttgtcttgaagtagcagacagcacctttacggcaacggttgtcccatctctaagcactccctgattaacaaaatgaaatgtaagatgatttgttttgacactatgggcatgagacactgatagggtgaacaaaatgtaagacatatttaccctgaacacagagccaaaaccaccctctccaatcttatttgccccactaaaatcatgggtagcctttctcaactcactgtaagaaaatatcttcactctatgttcacctggaacaacaaaacaacaaactcaagcatgtaagaatgatgaattgttttgaacaatacaggtaagaagcgtgctaatatacaaacgctgctcaccatcatcaccttcaacaggttgtttttttctgaacataaagcagcaatccatctgaaatcaaattgtagaggtgcccacaggccacaagaagcaatgaattggaaagaatttctgcagagcaaaggtaaatagccatcagaacaactgtaaattcatattgcaacaataaactaacgtaaaatgaggtgtacaggactcttagcaagttaatgaccccacatgccagttgttattgtttaaacaacaatttgcgcatcgataaccaccaactgcactgaaaccacatctttgcttggttgattaatggctcaagttactatcaaaaagtctacatttagtacgatggaaagaaataaaatgtgaaaccacccaagaaagaagatgtaaagagacttaaaaccaagtcaaggcagaagtcatccaccccatttgctgagcaatttgaagaaaatgaaacgtcggttgccacaagcaaccttaatcctgtctttctgaaaggaatagcgcctgatagacccaacggaccaactatccccgttgacgagtggaaattttgcagcaaccaaacccgttggaaatgaatttcgattcagatatagagcaaaagcctgttaattttcagtaatactaactatctataactaattccgcaattgcacagcagttgagtaactatttatacttttgtagtacaagaaagcaacaagctgcatattcccatacgccgatgagtaactagcatttccttcaagccaggatttgcctcatagctttacctaacaaaaatcggatttgcagctacagaaaccaaatcttgcatgcatcaaaatgagatgatgcatcacaaacacaagaaaaggtatcccctttctacttcccgctgacctaaaccaagcatcacatccatggaactcgatttcgtagaacgggaggaggtcgctcccgcaaaggcgcaatcgatccccaatttcaagcaaatagagagcgaggaacccagcaacatactcctccacatagaaacaaatgtaaaagcctaacgagttcttggtcatcctcactcaaacgcccccaaattaggaacc

SEQ ID NO: 56317 - DNA, 859 bp, Oryza sativa
taatgagcaggctattcctttgcttaatcgcgcgttaaacatcacgtggttaattcgtgttgctcacggggagtaattgggaccgagttacttctgaaaaccgatcgatggcgtggcgctcggtttggctcgctcgccggcgccgtagggcgaggagacagagactgtgatgtggtctttgagtgcagttttagctgatcagtgatggagtctctgtgattttgacgtgcaaagtggttaaaggcacaacaccggccactagattagcttagttaggagtagcgtatcacgtgtacctggtcatcagttttgtactctactctattctctatccgcgtacttatggttgagaggtgcccgatgcttactctgaatatacaaatacaatgtgtgcgacaagggtccaaaattcagacggttggatacaaagtccgagagattattagattaaccaactgattgtcgatataagtatatactagcgcgaacgtactgaccagcaaaatccacgcagaacacggagtaagtaaagcataaagaaaaaacacagatcagatcacatgcagcttgttatcattttatggtcaaaagcaatccggcacccatgccaggtgagctgcacctcgcacccccacctcatgtgctcgtgcttggtagatccatgctatagatactactcgtacacagcaaacaaaattaagcacgtgcatgtgcctgttatgtctatctgttcgttcaaaaatgtcagcttgttgttcaataggaacagtctgggtgtcgttcgcaggagaatagaggaataaacaaagttgctgacgaacgcggctgagagcaagtttaagagctcactaccagctat

SEQ ID NO: 56318 - DNA, 1559 bp, Oryza sativa
ttcaaaatcttttagtcaaacttccaactttttcgtcacatcaaatatttggatatatgcatggagcattaaatgtggacgaaaaaaaaccaattatacaatttgcatgtaaattgcgagacgaatcttttgagcctaattacaccatcatttgataatataatgctatactagccatttactactaatagattaattagatttaataaattcgtttgcagtttagaacggaatctgtagtttaacacagcctcagtcggtttactgatttctctgaacctctctctcctcttctccctcgtgtggactctcctcttctctctctcctctctctctcgcgcgcgcgtcgcagccatggtggaggcgacgcggcagcggaggaagccgctggtgctggcctccacgcaggcgctgctcgactcgctgccgggggaccgccgcgggtcggcccttccgccgccgccgccgccggagccggtgcgcatcagggccggggtgctccgcttccccaactcctcctcctcctcgtcttccgcgggcggaggcgagttcggggaggccgcctccttcgtcgccctcccctcgtccgcgctccgccggctcgccgtcgtcaccggcacgccggtaagtggactggtcccctccccgcgccttctcggatcaaatatcccattatctcgtctcagttagatcgttatgattgagtaattcggtggaaaatctggtcagtgaattggattttagtcgattttggatggtcacatatggggtttacctgtacactgttctgaattctgattagttggatgggaattgatgattagcttagccaaattgagctgtaataagtacaatggcaagtgatgcatagagcaatggtgctacaaaatttacctttgtgagcatacgattgcatttatgttacacttgattcaggcaatctaaatgatgatagaagtgcgctagtgtatactcctagcataaggttgggcagtatataggaatctattgtgctgaaagtaataaagggctttcaatctgcaggtgcttgtgaagaatgctgacaataatgtcggaaggattgccaaagcagtagtacttgatcacccatgccttgatgattccctgacagaacatactgagcctgtggacgcagcctctcccttggataatgccatgggtatcttaccctgtcgctcttttccaacaaacggctttccgcccttggatgaagaggtcgcttatgttagcccacttctggcattcaatctgggagtccatgtctcttgtctcaagcttcttgttcaaaaaggagagaaacctttcaagttctgttctaaagttgaagatagtgatctggctgctggtgaagaaagtaatcctattcttcacttagagattcttccatcccctcaagtgccgaaacatgctttgcatttgcgggtttctgttgtgaggattcctgaatgtggtgtgtttgcttctctaaaggcaaattcagccatggaggaagtgactaccaagatatgattgatcaagctctgaatgagcactttaag

SEQ ID NO: 56319 - DNA, 8080 bp, Oryza sativa
  unsure (1)..(8080): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccagagtgtgatcaggcaggcaactatggatggctgttacgagttcaatggcttcttccacgagtacatgatctcgcggccagtggaagaaagaattttgttgccactagaagtctctgtactggagggctattgctggagactaaccacaaaaggcgacataggacaacacaggggcgaagccactttgggcggcctgggtgcccaggcaccccccggattcctaaaatttcttagagatgaacaaattttggccctttaggcacccctacagcccaataggaggcacccccaccagaccttgaatcccacgatgccacttattcagcccacgacgcatcagctgcccaactctttttctcctcacgacgacttcgcgagacgtgccgtatacaccgacgcagcgacgcatcgactgcctgcccttcctcccgactcccgagtcgcgacgccgacgcccggagcgagccgctgcccacgaagacaggactgcacgaagacgaagccgctgcccactaagacgcatcagctgcgcgtgcgacgatcgtggctgcctgcctgcctcgccggcgttcgacttcgacgatcgacgttcatctgatcatctcgccgatctcgtcctcgtcagcgtcaaagactcaaagagccgctgcctgctgctcgaccaactagagtgagtgttcgtcctctgtcctcaaggatcatctcgccgattatgtgttagctatactatttgcttgaacatcacaaaagacattatagtcttgataaagttaggcaccccccacccatttgctctagcttcgccactgggacaacacctagccatttggaacagctgggacaggaacaagactctgttcgacagcctggacttgttgaggctacggtctttaacggtgtttggtccatgggagtcattcttcatctccaacaagatgggagtgcttcgtgtgctcgacctggaggatgcatgcgatgtaactgatgttgatgtcgagaatattgggaaggtgctacatcgcctcaagttcctatccctaagaggacacaaaatcacttatctgccggattccttcggtgggctgaggcacctccagactcttgatatcagatgcacctccattatcaatcttccaacaagcatcaccaagctaaagaagctgcagtatgttcgtgcaggtaaccctgtacctgtaccactggatgatgataccagtactgatggaatcctacgattacgaccaccgccaccagaagcagcatcagcaacagcttccccatcattatcagaaccgtcgacgtcaatgagcaggccacatgctgcgcttttgtagaggcattttgcaaattgcctctaagatcaggagttttatagcgtagagacactttatagaggcactttcaaaattgtctagaaaatttttactctagagacactttagaaatattttcagcgcattttattatattttatcttgtagaggcattctttcggcactttaaaatgtgtctaacatgtaaagacatttgcttgagacactttaaactctgtagagacacttcttacaaaaaaaaatatactaaatggctaaatataagtagcttaaggcataaacatatacaacgaatgacatgaggttgagttggttagtgccttgaagataagaatgatttgatcaagaaatcacgagttcaaggattggcaaaaacaagggaaaatattttattctcatttttacattggtttcatatggttgtggtacaatttaatgtctctagaaaatgcctctaccaccttatagacattttataaaatgcctcttcgtttatagagacaattcaccataagacacttattagacatttttaaaaatgcctctatagtattgtaaaggcatttgaaaagtgtctctatagtactagaaaaatgtctctacaaagcatttttgttgtagtgatgcaactgcggtgtcccgtttattcgagttgcgggagacgtggacaagccggcaccgcggccagcagcctgctgttgctggcacctgcaatggtggaattgtggtgcccagagggattcgaaaaatgacgaccttacacactctgggtgtcatcgacgtcagtgttgcaaagaagggccgagctattctggaagagctcaagaaccttacccaattgcgcaagcttggagtatctggcatcagccggagaaactgtcgggagttttgttctgccatctctggtcacgcccacttggaatccttgtcggtgcatctcaataaggagaacaatcgaggctgtttggatgctatctccaagcctccagagaacctaaagagccttaagctgtacgggtatgcagacgacaagctgccagagtggatcacgctgctgcggaagctcagtaaattgaatctacagatggccacgttgccgtcaggtgatgggctccagttccactcaggcttcgacagtctcgtgatactcaagatttcctgcagccccagtttacaggccgtaacgtttcactttggagtaatgcctagtccttgagtgtatatagctcagttgctgtaatgtctcatagttgaggctctttggattatcagccctgcccggtctcaaggtagtatggttcggtggatctatatagtagcattctagcgagagctgaagaggcagattggccagcttcccatggaaatgtgacctgtcctgaaggaggaggctcacgcattgccctgaatcctgattggggtgcactgcacgcagctatgcgtgatagtcgtcgcctctactgtcccaggagcacccacaggattacacgagtgctgttgttcacttccttttcactacgactctgtccagcctagcttctcgaccactggaatagggatagttgtgtatccagcgcacatctctagctgtaattgttgttagttgatctgttgatgtcactgaacactgaaatgctatgttccatgcatgccccttttcatttcattgtatggatgaaatggactgcatattgcctggattagcaggtggattgattatacaccgtagtatgtacagcacagcacattcattctacagtctgaacttactgcgcacctggaaatggcacattgctatggcaattctatgatcgaccttagtacttctctatcgagggcattgctgataaccaaatgattgtggacaaatcctgtctggggagctcatctcttgcttcatcagtgggacttcacaggatttgtgcaggagagacgtcgtggctaatgtcatcactacttgtgagaccccttgatttttgcaaacggagcataactagcggcgtctttgcatgcgtccccttaagtggcccgtacggaaaaatcgattttcccatacgggtcttttaagaggaccgcatgtaaaaatgacacttaagcgcccgtatggaaaaattatttttttttatactggccacttaagaagccgtatgcaaaaataaaatttcaaaaatttaaaactatgaactccaaattagatgattcttttttctaaatatttctaaaatcatgctctatcatgttattgtgttcttgctgctattattttggttattttttcttgtgactttgttttatcaattaaaattttaaatttcaaaactttaaataatattttgaaccagtaattgatttcaactgaaaaagtcatcaccaacaaagttgtataactcatcaagatctataacttctattttagtcatttcttcatccgacaaggttatttataagattgttaataaaatgtacatctctcttgtagttttataaactttataagagatatgtgcatttttgtgaacaattttataaatcactttatcggatgaagaaatgaccaaaataaaagttatagatcttgatgagttctacaactttgttattgatgactttttcagatgaaatcatttagtatttgaaaatgttgtttgaagttgtcataatttgaaattcaaattcaaactgttcaaacaaagtcatatagaaaaatgaccaaaacaaaagttgtagatcttggtaagttatacaactttgttgtttaaaacttttccatttgaaatcatttattgctttaaaatattatttgactttcttatattttaaaatttaaattttatatagctcaatcaacctcggatggaaaaatgaccaaaagaaaattggtagatctccacgagttgtacaactttgtttttgataactttttcatatgagttcatttaatatgataaattttgattcgaagttttgatattttaaaattaattgtttttccctcctcatcccttcaaattttttcatcaccccttctcactcccctgtctagatacttttaccaccacacactctctctctctctctttctatcctttcccctcactctctctttctttccaactctctttctctcctctccactcctcctcgagcacggcggtggctagggcggcttggcccggagctagcggcggtggcgacctcgggcgggggcgccaccgccatctgctactcaccgccgccgccgacgacgaggaggaggtgacgggccagatccggcggcaggcgacctcgggcgacttgaggcagtgacctcgggcggcgacgccaccgccatttcctcctcaccgccgccgccaacgacgacgaggaggcgatgggccagatccggccgcgccggtcctcgtctcgcccggatccggaggcagcgggcctcgtcctgcccggatccgacggcgaccctgggcgaagagtgccgcggcgacctcgggaggcgggagcggctggcagtggaagcggcagagggcggcggcggcagcgaggcgagcagcggcgggagcggggtgggcggcggcagcgagagcggggacgggcggcgggggcgggaacgggggtgggcggcggcggcgggagtgggggcgagcggtggaccgggagtgggacgggcggcggtgggagcgggaacaggtggcggcaggagcagccagcgagctcgggtggcggctagggtttcgttttttcttatttttcgcatgcgggtgccctgcccgcatgcaaagatggcgatctttgccgcatgcgaaaatcgttgccggccgtatgtaaaaacgtattctgtagtagtgcatgctcctcacactgaaacattttattttaataaaaaaactattctttcttgaaagtagtgaaaaaactaatcccagccgtgataattacactggtgtaacctcctttggctaatatacatctaaagtatgtagtgaaataactaatctttctcaatacggtaatatgcctgccatgtcatcaaagaaatacagaccatattcaatttatattttcagcaagaatcctagagctgaagccattacagacacggcctaaggatagacaaacgcggccttgaatgattaataatttttgttttgtttgtagaacacaaagatatataatggactaaaatgcatttttgttctcttcaatgaaagggatgtatggcctggcatgtaaaacaatgagaaagtgcggtaacttctaagtaaaagggagccaaaatttattatagccaagtccatgcaagcacaccaagtcatggccctcaatttgtaacctattattgacaatattgagtatttccatataacggaataatttgttcaggaggggttcaatttagaaggaggatcgaattacagaattcgaatcctgagggatttaacatttggcaagatttgggattcacccggatggatttagtcaagatctttggtaaaaaaaaaaacctaaatgtactcaaagaaacacatgttctattgtgcgggctgggctaggcccttcaaggacgaaaaccagacttttccgtgaattcttttaaaataaactctttttacgattttagtttgtaatagggtttagatggcaaattcccactagcctttatttgtagaacaaatacaaaagattatttcttaaaaaggattttcatatattaattaatattagattttgtttataaaataacttcctccaggaattatccctgaagggggttttctttaaagattcagtaattgtagacattcgtaaaacaaatacccaaaaggggttctaaattatagaaaaagagtttttaggaagataatttatatttacaaatattttattattttataatcatggttcctttagtaaataatattttaatccaaattagattttaatttccgtccttgtggtcaagcacaacagaaaaaagaaagtaagatacaataaagaaatttggaaaaagatttttgactattccgaatttttttcatatttcaaattcaaaattttcaggtgttacaggtccccacgcgccttgtgagttgcgaatggctgaggccaatcaccggtcggacacacgctgcccgtgccacaagaaaactcggtgctagacctcaaatctttagaaacagatctcctgaaataactgtacatgcagttatgtcacttataaattgatctcactttactataattcacatgtaaatatctcaactgcgtagtagttaagttaaagtatcctgttcctaaaatgttgtatttcgttcatagtacaaactcaacacttttgaaacccaggtcaagggtgaagacatcactattagaaaaatcgttttttcaggcggcccaaaacagttttcacagacagagagaaggaccgtcggttcactgtcgcctgtcctccatcgccttcagccgcgcctcctctggctccggttgaccatccagcaggtcggaccggccgctgggaacacagtgacggaggaggaggaagacgagggatgtaatggctagcagcacgaaggcggcgagcatgaggaagtacccgaggacgacgtaggacgccgcgagcaccgcgcaggcaagcaagcagagcgagagggcgctggttatcctgatcgcggcgactaggaagaaccaccggttggctgtggcggcgacgttcacggccctcttcgacaacgtcatcgccgacatgccgacgatggcggtggagaacatgaagaagatggagacgtagatggccgtgaacctggtggttgcgctcactagaacagataccatcatctcaatcgggcggcaacccccatctcaatcgggcatggcgtccgttacaggctagaagtcactgatgtgaaaagttatctcaatagggtaaacggccgtcacagatgaacctatctcaattgggccataattaaagcccgtcaccgatagttttgacccagacgatcagtcaaactatagcccgtcacggatgacctatctcaatcgggtctaaactatagcccatcacagatgacccttatctgtgacgggcattaactatagcccgtcacaaatgagtcatctcaatcgggcctaagttaatgcccgtcacaaatgagtcgtctcaatcgggcctaagttaatgcccgtcacagatgagtataatcctaaaaaaaataaattttatttttaggcatgccgtctagcctctctcaggccagtcttttttgtccttactcgtgtgcacctgggaagaacttccccctatctcaatcgggccataattaaagcccgtcaccgatagctttgacccagacgatcagtcaaactatagcctgtcacggatgacctatctcaatcaggcctaaactatagcccgtcacagatgacccttatctgtgacgggc

SEQ ID NO: 56320 - DNA, 6149 bp, Oryza sativa
ctttatcggatgaagaaatgaccaaaataaaagttatagatcttgatgagttattcaactttgttgttgataactttttcagttgaaatcatttagtgtttaaaaatgttatttgaagctgtcatatttttaaattcaaattcaaacggttcaaaaattgttatatagaaaaataaccaaaataaaagttatagatgttgatgaattattcaactttgttattgataacttttttagttgaaatcatttagtatttgaaaatgttgtttgaagttgtcatattttcaaattcaaaattcaaactgttcaaaaattgttatatagaaaaatgaccaaaataaaagttatagatcttgatgagttgtacaactttgttgttgatgacttttccatttgatatcatttactatacgtaaaattattttgactcataaattgaattattatactgcaagttaattattttgctatagttcaacttacaaatataaacatttcatatgaaaaatgagaaaatactcatcgatgacgggctttagtaatgcccgatagagattaagtcatgtagaagttgaatttaaacttgcatatttgtgaagtgttatatcgcatattaatacaccttctcaattatttttaatttttttataaccattttagtgacatgcaaacaacaaaaagatatctcctcgagagattaaaataatttccccgtcacggctacgaggcacttggaggcaccgcgctggacgccggagacgagccgttggggaagcccaatcatggtcaagctgaggaaaacgaggcagctcccgctgacgcctgacggacgtggcgaatgccaacaggagtgagacaatgaagcgcgtgttgctcgcgtgcttcgcctcggtggggaggcagagcgaggcggtcagcacggtgaagccgaagacgacggcgatgccgctggccttgaggttcgccttcgccttggcattgcggagctcttcttcctccttcctcctctctgtcggagcaccgcgggcctcctcgtcctacattggaaggtctgtggatgaccaacggttaatttgtaaatacagtggggaaacaattttttttaagaaaaaggaaaaaaggcaaaagaaatgaaagaaaggctaaagtaataagttcaccggccgtccctcaactttatgccgagtctgtttgaggtcccctaaccacaatatccgaaatgtgtacccctaaactatataaaaccatccaaaaaaggtcccgaggcagtatagatgcctgattttgctgacgtggcatcctagtcagcaaaaacaattaaaataaatatgtggggctcatatgtaagtgagagaaaatagtgtgggccctctcttctctccgcttctctcgagcgggcattgtggcagatgggggagaggtggccagcagtggagcaggggcagcggagagacggacggcgcaacagtgagctcagcggcgaaggagaggagcagcgcgtggcgtggcggcaggagagacgagaggactggcacgcagaggccgagctgctgcgccatagcgacggcctcagcctcggctttgccgtgatggacgatagcgccacgatgctcggtgcgctcctccatgccgcttaccgacacagcgcccgccctccccctcccccaacccggtcatctgcaacagcagcttcaacaacagcagtgggagcgagcatttcgcccccctacctgcaggaggaggcttcctcatcggagagcagcagcatgtgttgccggcgtcctacgccgcggcaggtgtccgattcatggccacgggagaagaaacgccgcagagctttggctttggcagcctcttcaatggcgatctcctgcaggaggcgaacgggagcatgtatcattatcagcagcagcagcggcagctgggcattgtgccctcgtcgcagccactgtcagggactcgagtgggctgcacatgggccgctggctgcaccacgggctggtcagcccatcgccaagaagcccaagcaaggccaagctgaaaattatatgagcagcagcagcttacaggagatggatcgaacagattcatttggccaaggcggcgaacgacggcggcggcgacctagaggctggctggcctctttgtcgatctctcctctatctcccttcttctctactagtctagaagctactagaaccttctagcccttgtatccttccatcttccacctcagaaccactccactattgtaacagacttggttgttccctgtgttggatttggcactgctatttctgaaattacattgttgagtgggtctctaacaatttggtatcagagccaatccccaccaagctcatcaagcaagctgccatgggaagtgaggacaagtttaacatgcttttaaggatgctcgaagagtgcgagcgaaggcgggaggaggcagaccaaagaaggagagcagatttcctgtctctcaaggcaacaatagactcgtggatgccccaagaatagaagaaagctgaagaccttcagtttttggttgaggatgagcagtccaaggtgacgcccaccacctgttcaatggagtgccccaatggcagcagcccgagcacaacagcgagatccatctacgacgacgagggggctactccgacgatcatcctggagcttggggatggtgaggggaaggatcgcatgcccttcatcattagcaaggacctttccgagttgacgcctatcatgtgtttgacaatatgctcaagcctcgacgtcgagcctgatttcaccgtggctgcggtggttacatgctccaacactgccatggactccaaggagttggtagccaccgatggtgcaaccggcaccaccaacattgacccccgtgtttgttccaaggagacgcacaccaagtgtttgttgtttggccccgatgtcaacggtgtcactgatagaggtgtgattgtgttccaaagtaggatgggtgtgttcaaggtcgttccgatatcaagtcagtccatggagttgatggttgacgagaaagcaacctgcactgacaccactcaccttcccaaggtgatgcacccaagccatttgatgttgggccccaacgtcaacaccggtactatccaggctggggttgcgtactcactattgcttggcgcgccagaaggaatagcatcctcgggaaaggccacactagtcatggcacaaaagcttaactccaatttctgcctaaaatgggtggcgctcaacaggtgttcgaccaaatgctccaagggctacaagaagctgttgatgagtcatcccaagagaaacccatggccacctccttgctcaggtagagtggttagaagatggaaggagtggtatgtgccttgggctgcgggcaattatttggggataatattttatttcatgccaccatggccaccaccaactcaaattggaaccataatactttggctgctggtaaacacatggttgacggaagtagagctgaaaccgtggcctgacccacaaccaagtcaatatagcggaggcgtgatgtgaactgagcaagtcccatagcctgcaccagtttttgcacatttgatgggatatgatttttgcagtgcaaattgcataagagaccaaacaccttctgttgcactatattgtgcacctaaaggagatttaaatcatgaaaaatctgatcgagctcataaggatacattggtggcaatatttaacttggaacagttccattatgtgggtggtgaggaaaaagttatagagggaatgttatatggcctaattacagtaaactgcaactacttgatcattcctgctgctacaatgacaacaacatctactcaaaatatatatatggagcttgttggttggaggctagagaagggttaaatgatatagctaagggaagaacttacaaaatttgtaagtccatgcgcatgacacttaatcatgttgagagctggctacagaacccaacaaacatattatacaatggtcagttgtttaactgtccagtgggggtacattttggggtcagaaggatttctgagattattgctagaggtgctggtgagaatcagaataggaaggttaagacatgtagttatgattccatttttgatttctgtgagaataatcctagtgatggtagtgctgcagcaaggttttccattgatgggattgataccaggacagattcagagatgatatatgcatcaattgcaaacagggattattggtctgttaaattattcgaggtcataaaagaggggtgcccaatacgccacttgttactaggtgatgtcaagatagaacaattgctgcaatgtgagacattcagtacaagacagacaaatatagagcaagttatcaagctacagctgagcaattccaaggaaatacaagagctacaggtaccatgggatccaggaggttttcttcatcggcttggggacaagccaaatttcaagaagaggggattgtcaaggactcgggtgggctgcacatgggccgctggctgcaccacgggctggtcagcccatcgccaagaagcccaagcaaggccaagctgaaaattatatgagcagcagcagcttataggagatggatcgaacagattcatttggccaaggcggcaaatggcggcggcggtgacctggaggctggctggcctctttgtcgatctctcgtctatctcccttcttctctactagtctagaagctactagagccttctagcccttgtatccttccatcttccacctcagaaccactccactattgtaacagacttggttgttccctgtattagatttggcactgctatttctgaaattacattgttgagtgggtctctaacagccacatcatctgaatgtgagtagtgactcgacaggagcaaaaaacctaaattgaatctgacatttaccattgttcttccatcattcgtccagtggtaacattttacatgtcttgcatcaccgcctgctcgccggcctccccatctccttcctctctgcttctcgtgcctcctccttaaagcggcgttcgttgacgttggagctccctccttgccggtcgtcgacagtagccaccgtcgacaaccacgacagtcgtgcgcgggcaagaaagagggaggtaacatctgccgccggccgtatctggcgctcatccgtgcccgctgcgctgctcctctcccctgccggtgcgacacgcgctcctcctctcctgtcgtcgtcgtcgcgccggccgccacctctcctcctctcccgccactgccatcgcgtcggcctcttctctctccctctcccgccgttggccgcctctctccccctctcccgccgcctccgctccgccgctggccgcctctctcccctctgtcaccacgccaactcgatagaatcaggagagaagaggaaaaataagaaaggagagatgtggggcccacaccattttctctcacttatatgtgggcctacatatttattttagttatttttgctgactaggataccctgtcaacgaaaccagacatctatactatgtcgggacctttttttagacggttttacatagtttgggggtacacatttctggtattgtggttaggggacctaaaagagactcggggcctgatcggttcagttggctgcggcgttttggactgcagctgtccagcctagacgatcggctgcaacccaaaattctacagcaactgttatgttttgaatgtgcacactgctgcaaagagcagctgcttgttggttgttaggaaaaagtatatacgaagtccctcatctcgtcatcggattacaaaatcatttcccaaccacaaaaccaggtatataacatctctcaaaatacaaaaccggttcactctaagtcctttgacggttttaaccgatgtgacagctgaatcattgtgggacccacgtggaccccacatgtcagggtgtccatgtcatcatctctctttcccctcttctctcccttcctcccactcttctccttgtcgtccgccacgaaggggtcgacgatgcatgccgtcgtggcgccgctgccgctggttccgggtggcgcgggcaccacaagcatcggcgccccggcagcggcattgccacgttgctcgcgct

SEQ ID NO: 56321 - DNA, 1416 bp, Oryza sativa
caaccccgcctaatgggtggtaccgcccctgtccccggcgttctgctcctcttgcaccggaaccggctcctcggcgccggaagggccttgatggtgttcatgtcgtcctctgcgacgggagatgcctgtcggctgggtggttctggcgacggccgcggtagcatctgccccgacgccgccatggcgcgccatcacctccgacgagcggcggggacggggagcgcgacaggagagcgtggacactgccgtcgctgcgtcacccaccgccatgggggtcggtcctcttgctccagcgtcgtcgtccgcgtcacccgtcgtcggtcgaaagctgtcggacctcctctcccgcctcagctcgctggcctcctccccacccaccggccggcctgccccagatgaggagaaaagtgagagaggaggaatagagagaagaggggaaagagatgacatggtcgccctgatatgtgggtcccatgctgactcagctgccacgtcagataaaaccagggttaaaaccgcctaaggatccaaagtgatccgattttgtaagttgagggatggcatatatctggttttgtgattggtagatgattcgtaatctgatgacaagatgagggacctctggtgtactttttccttggttgctgctgcagcgcaaccacaagcgatcagcctctcggtgtaaagttgagggatgtatggtgaacttccacaaaaataagcccgtcattacacccatgttagatcaaggcccaatcactcattggcccagctagcggtttcacccatagcccgccaagctgctctgcttccgcacgacggcccaccacgacgtacggggtcacacagcatgtggaataagttcattctaggccccttaattttacaccgaattcgatttttatccttgaacccaaaaaacagatacaatcggtccctattaaaaccggtgcaaataaagtccctggcggtttagaaggcggttttggctgacgtggcgccaacgtggctagtttgacttgatcttcgtcacacgtggcatatgatgtggcgcttatgtggcaattcgatacttgaaaaataataaaaatcgtggccccatacgccagccacacacaaaaattaaataaaaatggtggggcccacgtgggccccacatgtcaaccttataccttctttcctctcccctcttcatcctcaccctcttcccgcaggcgagcgaggcgggcagccggcggcgccctcggagacctcgcgcgccaccgccgcactccacctccgaaccgccgctttctctcccttcctcccccggccctcgccggcccaccgcctccatcctcctccccctgtgccgcctctgcagcagcattgggaggtgaccggtgagtagggagccacggcgttccgcggcggcgg

SEQ ID NO: 56322 - DNA, 5763 bp, Oryza sativa
tactactttctgtaatgttgaaaatcagccatttaaggataaagttctcaacgaaaaacaaattagaagataaattagtaaagttacctctaaaacatcgaaatacatctcattcatttcatagctcagcatagcattgataactttagcacaagtcaaaactacagaatcatggttatcatccaatgacatcctgcagatattccagttagtgatgacacataagtagaataaacaatgaaaaaagcataggccattttaaggtctaacactggtgcaattaactcatataagcaaagaaactaattagatggcatatgagagaactaaataaaaaaaacctatagacaacagttaattaggtcacaccgcagttttctgagattataacttattagggaaaattccatctatagcacaaagttttcactggtacctaataataccatggatttttccaccctttcagaaataccacaactcagaacagaacaaggcggggatggacagtgccattttacaaagaaaatgcccagattaccacgaaggcaatggattatttggcttgattcgcagcaaatcctgccaaacgaggtgttttctgtggccaagagaataacacaaggaggaaatggatttaggcgttcggatttggggacatatgattcggatgcatgtgtggatgttgcaatggccgccggcaataagagcatcatggagacctgtgagaccaagtgattggatcacgctagagcaggtcagaggcatggccatggttgccagaccttcatcggttacgggaggagtgcggaagacttcacctcgagagccaacgcctcagcggcctcggcgctggcggcctccgcggctggcggcggtcgctagtcctcgaggacggattgtaggtaggaccgtgcttcattgccggaattcgtggccaccagcttcacttcatctcgccgagagagagagagagagagagagagagagagagagagagagaggagacgagtggaatcacggggagactactgaatgcagattgaaaaaggccaggggcaattttgtccatggtaatagttcaatttgtcatacgttcagttctgtaaaattttgtggtattttttacgtgtggtgtcacattgtggcatttctggaagggttgaaaattgtggtatttattagtacctatgaaaactttgtgctatagatggaattttcctaacttattatacatgaaacagccaacgtgactgcagaaaggaagacaataagggcatgtctagtgcacaccttgaccgatgctagcaagcggatttgaaggcttagtaatgattctaggcactagaagaggagatgctaggaacaaaatcgatgcatatatggtttgatgcgaagcaaaatgttttatttgcatacactaggaaagccagtttttaaaatttctagtggagtccactcaaaaactaaaatcgatgctagcacactagagaagaaaaattatccaccctgtgtatcacatggctgtgatgtgacaaccttagcttcacctacactagacatggcctaagttaactggatacatcttcttacaagtgctaactgatagctaatggacaagatgaccttatgctgttaatgcttgcctgctgtcatgaattcatgactaaaatacaagatgtggcagcccaaattttcaggcatacaattttaagcataggtgcagacactaaagcatgtgttaaggtttcttgattatttagtcttaatagaattgtccggtatatttcagttaagtactcttcactttggtaactaataaactcttgcatggaataagcaaatccaaattaaaattattattatagtttgaaaacaaccagtttaccttagagagagaaccaactcaggttcaggtccgatggcatatgcccaaaccgcttgccagtcattaaacttgtcatcatcatttgattctttaaagttatcaattagatccgtcttatgtaggttctgcaaggccctattaagaatcaaagcaaggagctgaagcgcaagcacgcgctgtccaggaacctatggtttgaacgtaaaaactgaattattacatttatttatcttgcaatattttggaggcacactttagaaatgatgtaagaaaaacattaagcgatgatggtgtatctcagttatgcatgatatgacatttaaaaaaaaaaacaacaaaatccattcacatgcaaaggttaatatctctaaaaatactaaagagaaactagatgttgtattgcattgggtaaagtccatttttagcccttgaactttactcaaaagtccattttcacactgaacaacaaaagaaagtaacaaaccatgctcctgctaagtgccactgcttcattaattgtgtacccaacagctgcgggatctccctctgttcgaagaaaatcacgctcacctacagtttccacatgtgctttcttgcctgtaagtgggaaagccaggttgacatgtaacgggtaccagaacactagaagctaaaagcaacacaagagcaaagaaaaatgatttaccatgttgttgctcctgacaagattgaaaccccaaaatatctccttccaatgtgaacctacaagacctgatccgctctactctctcactccatgccttccaagtgtgtccactatgctcaccagctgacaaccattctccaggcatagccttcgagatcttccctgggcctgaaatccccccacccttgccctttcccccatctttcctgctcccagacttctccttcccccgtcgtttcagcatctccacaaatgccgggtccatcctattcaggatctctgcctgtgcctctgcaatctccccagctgacatccctgccagcctagccatgttctccgcattaatctctgcggtaagagatggttccccattatccgattccataccctctcctcgcaattccacattcctcacatcatctctagcatcaacctgtttcatcggcttccttggcgccacatcagacatcaaagcagctccacccaattcttccttaccatttccaacttccagctgcataccaattcccccggagcgcttctcctgtgcggtgccacccgtcgttgcagccacgaccccggtgtcaattttctgcgcagtctgtttcttcggctgcaacggctttgcctgccttcgcttcgggggcgcatcgtcagcgacgaactcccgccacctgctgaaatccatgcccttcttctccttcctcttaacgggcccagctgcggcggccacgggctggtagtccgtctcgtccacatccatcccttcctcctcctcgccctccccctccgccatggcagcatccctcgccgccggtttccagtgctgcggaagagcagatagtcagtcagggagtacaaaaccaaagcaccacatcaaacctagggttccgagatagagggcggcggcggaggaggcgtaggcggcttacggggccgtgggagcggtggcgggcgacggggaaggggaggacggtgggactcggggcggaggagggcgcggcggcggccgcgccggaggagaagcccttctcgacgatggcgccgacgaggcgggaggaaggcggcgccacggcggcggccgggggaggggaggggtcgaagggctcctccacgaccttgcggcgcgcggggtgggcggcgcctggctgctgctgctgctgctgccgccgcctccgctccgccgcgtcgtccatcgcggtggtggggttttggttaggggagctcgctgtcgccgcgtggcgacgaggaagggaaggattaggagaggagtagggtttaaggggaggaggcaggagggggatggtttggtgcttttgccgatcaccaagtcggctgtcgcgccgccaccgctgtgttttggctgaaagcgtgaaggcgaggtcgaaccgtcaaacaggaaacccctttgaaacagattatttcctaacaattcctttgaaatttgcatcgaatggaccttcctagagcaattttagagaaaaataagtgtgaggtctcacctcatgttttcctcgtatgtctaagattcctacgattttcctgtgtgataatcaaacgctagtttggagattttaatgtgtttaaaatctcataggaatccaataagtgtggcattctgtttctacgtttttcctatttctctgttttctcaatcctgcaatttaaaggggcccttgggctgcgctcggcagccaaggttgtcgactaatcacttatatgcacggaaacagccgtatattagcgtgtgattagttaagtattacttcctccattttatattataagactttctaacattgcccatatttatatgtcattaattgtgggcaatgctagaaagtcttatataattgttaacaatgaaattcggtaagcccctgagagaattatcacgtcgccaatagtcggattcctactatattcggttatgaaaattaatctgttaaagaaagcttatctagaagtgaccgagtttaagaaggatgcggcatgacagtttatctattaattaggcaacatttgttagttttcttttatatttaggaaagcgtgtttagtgtcctataagaactttatgttttccttttatctatttatgttttccttaggaaagtttctttcttgtcctataaggactagtatcttcccatgggtataaatatgtacacccttgtgttaacgaccaaatttggtaagatatgaactaggttcggcattggaaacagagtggattcggcaaagaaatagattcgaagaacagagtatgcatcagctgcgaaggaatcggctggagtctgcatcggctgagatggatcggacagaggacagccgatatagccgattttgttgaagacagttgtaaaattgtttctagaatcaatcaacgtactacacaaggattgccacgatgcgagataagctctcagatagataattgtacctattaattaggatattttaaatagtttcgttagagatatgtttaggcaaaagtctgtcgtaaagacttatgtgtatcttagagatttagagataagagtcgtgtccaccaaggacatatcatgtatctcgggtataaatatgacccgaacccatgtaattaacaacaacagttcaataacactttcggcgcatcgccatccttttactttcgttctatttcgatgagttcttactttcgggttgagctgcatcggtttcgatcttcaactagaggtaaacttgtcatggcggtttgcattctcgggattagtgcttccatctttatgacaccctaatcttgtttatgtaattcgtcgagttatcatatatacttcataatctttattagttgctctatgtaacttgtaatcagctggtttttactgttagaaagtagccgatagagttagatttcgttattaatctagattatattgtgtatctaccatctcttagagattttcattatcttgtttagatcttacagttatctttatacttaatgctgcatcggttgagttcgatctattaagttatatctataattgtgatatctagcctgtttcatgatcatcagtagagatagtgtcggagtttcagccgatcttatctgatttagttatttttatctcatatgcttaattgttatgctaaatatgccctttatattaagatcttattgcattagagtatgggctgcaggaat

SEQ ID NO: 56323 - DNA, 1121 bp, Oryza sativa
attttggacctgcacaggagttaagcagatcttccaggccagtgtgtgtttttcgcatcaacaccggggtcattgtaaacaatctccacaatcaatacaattcggcgcatcgccaccttttaccttttctactttattttattgtccaacgggacttggcacctgacgcggggctccatcggtgttcgatctccggcgaaggggtaagtccaatgttccgccggcccaggcaattgtctcatctacgtcggcgttgttcaaggctgcatcagtacattcgacctcttggattgctctggtttggatgatatatttgcctacctatttatcatatgtgttagttaatctagtcttagtatcttaatttagctctatcggttgtctctcgctttagggtttctgccggtatcagctaaattgttttactaaattagattagctaaggcatctaccaccttaaagattagtcaagggcttgattgcctagatattacgtttcttttcatacttagtgctgcatcagttaagtttgatctactaagttgtgcttagaactataatctctagcctgcttcttgactgccaataagggtttcatcggggtttcagccgatgaggtatctggacgttgcatcggtttacaaggattgcatacatattggatttagccgatgacaataaaggttttcagtgttttatctactcttatggattttatggcattggacctccagccgatgtatgctttaaccttcggatcaatactcattctatcatatcattgttagccgagccgattggtttctactagattatattattgttatattgtattatcatcagctgattgcctttatattggtatttatatcaagtgtcagaatatacattggatatatatccggtagctccgaatcctatcactatcggctggtatcggcatcggctggaattactccatcggcttgtcagccgatcgactatttgatctgctatttctatatcttgtcaattgaggatcaaactgactggcacacccgcatctcatcaacctttggacctgcactggagctaagcggatctcctaggccagtgtgtgtttttcgcgtcaacacatcttt

SEQ ID NO: 56324 - DNA, 755 bp, Oryza sativa
ttgtcatattttcaaattcaaatttaaacggttcaaaaaatattatatagaaaaatgaccaaaataaaagttatagatcttgatgagttatacaactttgttattgatgacattttcagttgaagtcgttcactaacaaaaaattctgtttgaatttctcaaactttgaatttcaaatttcaaattgtttaaatagagtcggatggagaaatgaccaaaataaaaattttgcatctcgatgagctctacaactttggttttggtgacttttccatttgaaattatttattaaccctaatttttgttccaagttgtcaaattttgaaaattcaaaatctgaattattcaaatgaacttatttgtacaaaggaccgatacaatagttgtagatctcggtgagttatacaattttgttgtttaggatttttgatggttgtgtatgtgaatgaatgtatatgaatgagggatgttggggtgtgacgtcctagcctagggcttaataggattaatagaatactcataccgacaagttacaacttctcttccggaagctgatctccaaagaactttgatgttaagcgtgcttggcggcctgagagaggctagacggcatgcctaaaaataaaatttattttttttgggattatactcatctgtgactggcattaacttaggcccgattgagatgactcatctgtgacgggcattaacttaggcccgattgagatgactcatctgtgacgggcattaactta

SEQ ID NO: 56325 - DNA, 1081 bp, Oryza sativa
ccaaaaatccgagaaaaatcaaggaggagcgcgggatactggcgcatcctcgtgagaaattcaggctagatcgatggcggtagagggacaggacaaaataagaaaagaaatacagtagtcttctagcaaaattgttgtgattttcgtctgatcgagacggcctctccatctcgatttgtattctatgttctagccttcagggagctccagagcatgcatgcaggcgactaggcgaggcttccagggttcgttctgctttgaattccgcctcgataaggttactaatctctatccccttggtcctatgatgaggcagccgcaacgccacgctgcttgcgctgccgtagaacgcatgcgcgttcgcggccgtcgactccgccgtcgagtggctgtacatcccgtcgagcaccagcatgctgaggtcgcggactggacaagcgccgtctcccggtccgtcgacgaggggtcggacgcgtcgtgcattggcgccgacccggctgggttgcctgctgcccgtgctcttcgtcgtgaacagggcgagcgccagctgctgcctgctgcccgtgctcttcgtcggacatggcatctccgttcaagttcaggaagtcgggtcgccgtcgggagatgagcgggggcacctccggctcagcaggcaccgtctccccggccagtctacagtggtggacgcaggattaaaataaaaatgaggtgaagatgctcatctcaataagaacaactaaacacaaaaaaataccatatttatattgtaatcatataaacatatagtataatcaataaattaaggcaaacaaaaaacaaaaatgatattaaaatagagtaataatttttgcgccatacataattcatcatacataaaaatatactagtaaacatatcaatttgcaaatatgagttaattcataaagcatggttgatagatatcttttaaaaagtaaatatatgagaagatatcgcatacccagaataagatgattattattttgcttagattagaagggagagagagaaaaacattaggccctatagtaggggacgggggtgagcaatgttgaggaattga

SEQ ID NO: 56326 - DNA, 2617 bp, Oryza sativa
gcccgtcgcctgctccgaccgccccgctccaccgccaagcaactgagagagagagaggatggagagaagggtggcgcccgacggagagaagcccgcgtggcccgacatgcggccctccgctcgagcccgaacgatggcagcggccgccggaaaaccgcccgctcgtcttacctgcacgagctgattccgttacacattctggcggcggtgtcgatttgcttctcgccggcgagcccccggctagatgcgtcgtatccgccggtgaattggggatttccggttgcgaacacagaagaatgaccccatcatgtgggtcccgcgtggtcccacattttttattattttgtatgtgcctgatttgtgggtcccacagtttttattattttttagattagattgccacttaagcgccacatcattgccacgtggtacgaagacttagtcaaataagccatgtcgacgacacgtcagccaaaaccaggttcaatatcgccgagggacttcatttgtactgattttataagttggaggtaagcctgccaatgggctagattgaaatgggcccaatggattggtttcagctttgggtgtagtttggatggatggaaatggattgaggagtttaatgggctggactggttagggtggaggtggaaacggtttggattggattggtttttggtttctgatttttggatccaaattggattcagtccatggatttctttggatgcactagacagtccagtactctccaaagtccaaacctagcgtcatcagtcgtccacggctccactccttccgccgctgccgctccctccccttgcttcgcctcctccacctctccgccaccgtccgcgaatccgccgccaagccgtcgccggtcagattccctcccccaccaccattgcttttctttttccctggtttttctcggtctttgatatatcctggttgttttgtttgtgtttttttttgggtctcttcctgatcttggtggttgcgggtacaggtgaagcagaagaagaggaaggtgcgtgcgccgccgggcgctggcgaggatgtcctcctctggcggtccggccgcgtcgccaatctccctaagaagcccaagtaccacgacgtatgtgaacagtgtgattggtgtgatagtttctataagattttgttttttttgttggttttactgaggagttaacttgctcaagattacaatcttcgatgggtttatgtgcaggagttccaagatttcaagaagaagataaggaggtatagtgaatgcaggttcccttcatctcccaatgcaaattatttaacatatcattacagattgagtcctgatatgattttgagatgcaaattaattctatggtcaatcgaattttagtgtgcaatttttagattgtagcacatgtacaatgtgtgaaaaaaataattatagaccatgttctttcaactatcttgattttagatttcttcctctatgcagacaattgaacaaactcaataataaatatgtccatacaaatgtcagagagttcaggtactaatagtccaaataataatcaatcttcaagaacacgtaagagagctaaagtatgggaacactttcagcaagaggttgtaatgatagatggtgtccccaagactcaatgcaaatattgtagcttaagattgacagccaccaaaaagtcaggaacaagtcaccttattaatcacatagccgaatcatgtccagctattgatggtgatgctagaatcaacttccttgcaacaattaagaaacagactggggaaggtttcgtgtttgttcccaagagaagccgggagctaatggtcagattcttcattcatgcagaggtgccattcaagaaaattgaggatccttattttttggagtgggtggagtccatgcagccaactttcaaagttgtggggcgtcaaacacttcgtgatgatgcctttaacttgtatgagcgaatgagggaagacttgcatgctgaattacataatcttgattcgcacgtatgtctaacatccgatatgtggacttcaattcaaaatataggctacatggttgtcacagcacactatattgatagagagtttaacattaagaagaaaattataagctttaaggaattgaagtatccccacacgggattcgccattgaagaagctataatgagttgcttgacatattgaggcattagagcaaactgtttactataactttagataatgccagtaataacaattctgcatgtcaagagttgataaagaatcacaagaatgcattgatgtttgagggtcagcatttgcatgttagatgttgtgcccatatcctaaatattttggttcaggatggtatgaagataattaaacctataatacacaagctacgtgagttgttgaagcatttagattcttcagtatcaagaatgcaagatttcaattctatggcaaactcgaaaaatcttccttcgaagttgagtttttcttttgatacaccgactagatggaattccacctataaaatgattgtagaaggattaatgtacatatctgtcctggatagctatgcaaatcaacatggtgaagttgcacctactgaact

SEQ ID NO: 56327 - DNA, 13807 bp, Oryza sativa
cggcaaacgaaatcagaatttgccatatatttagaagaagatgttgaggaggatagtgagagtttcgatgttttggactggtggaagagacatgctcaaaaattcccagtattgtcatctatggccagagatttcctagcaatacccctcagcactgtatctccgaatcagcattcagttgtgggggcaggatacttggtgacacacgaagttcgttaacacctgaaatgcttgaagctctcatttgtgcgaaagattggttaattaaagccaacgatcctttgatcaatattccaggtgctgaaggtataatagtgataaatgattcctccataaatgttctgtgtatttcaatcatgaagtagtgatcatatatcatttacaggtggaaatttgtcctgatttattcaggtggtgaagtgaagaagatggaaaggtgactttccatatacatatatgcaactttaaattcaacttttcctttggcgtattggaaatttggaatggaatacttctcttgaacctgcatttttccaaaattgagtttaccactttgttgcctattctgtttgtatataaaatgttactattcattatttaccaattgaatcaatttggcacattgttttgataacactgcaaaggtcacattatttaaattgttattgtaattttgtatatttgctttcttaagcaacgaactcacaattttctagttattcctggatataaatttttgatgacatctacttctttcaggttactgtcatctgcaagaatgtgtggctgagaattggaagggtttttggttttggttatcttagaaggtaatctaaagattgagacatgaagaaattattggtgttcagttatacatggttctgaggcttgtaatgcttgatagctttttttgttagagattttctcttgagcctgttgctctagtagaatctctagtgataattgtaatatttagttgccaaaacttgttggatggcactacttaaagcatcaaaagttctaagtatgctagtagtgttgattgattatttttgcatcttgcttatgttatttgtaagtatgctagtagctgtatgcagcgtgagtgttcgccggctgctctgctctgctctgcttcctgccgtggattgggtatgggttggaaaatggattccacccgtggattgtgttgaatctggactgagcaactttgtgggttgggttgggtggggttagctcaaggaattcttggtatggattggagtgacaattttgctatagtcactttgggttgggttggattcggggtggatgccaacccattggcaggcttagttggaggatgtgatgtatctggtttttcggttcgaggacgaaaatcagattcagtgtcaagttaaggacctagaatgaacttattcccacagcatgtcgctccctgcgccgcctcgtggcctcgtcgccgtcggccgtcgccctcccgccgcgcgccggcgacgcgcatcggtgggcagctggaggcgcccgcggtgcggcgcagcgcaggatccatctccgaatctccactggcgctggtgtgaggaatacttgctccctctctctctgtccctgtgtcccgcacgaggtcatttaggtttgtttgggtgtagaaaggggatcgtcgacatggggagtgcgggcattcgtccggttaaacttccaactgaaaaattgatgccaaaatctgatgccgcgactcatccgatcctgaatgaagttgaatcacagcagcagctgtgctggcgctgtgaagagctcaaaacgagtcccaaatctgccaagggaacgagctatggataagcgtagcgtaccaggctagaactatattgtatgccaagatgctatgcaaatatcagcactataatttagcttttatcaataggaggacacgggagaccaatggaaactgcctgatctgatccactcttcagtcatagttggcattattgcaacaaaatattgcactttagttccagtactgttatttctaaaacaacacattgtgtatgtagtacataataattaataaaatgatacattcactggcttggacacatttatagtagtatagtagatgatatcttgcgagaaaatttaccacacagtcaaacgacagatctcttcacccagaaatagaagactccaacattgttcaaccggcttcatcaacagaaacaagcatctccaccacactttccatggtgggtcttctggctctgtcttcttccagacatgaaactgcaagctccatcatcactcttgcttgcaagttgttgaatcgagtgtttaatctggcgtcaatgaagtcagcaatccatgactgttcatccccatcagacgttagattctctgctagcattctaatgattcttccgagaaccatttccacctcctcatctttgtttgtttcaaggtccgaaacacgagctccttttagtagttctagaagcaccactccaaagctgtagacatcaacctttgctgttatcggaagactagaaacccattcaggcgctaaatagcctctagttccttggatccgtgacacgtttaaattggatcctcctctatgtagcaactttgcaaggccaaagtcagctatctttggctccaaattctcatcaagcagtatattttcaggttttatgtcacagtggatgacccactccaagcactcgtgatgaagatatgccaatcccttagccacacctagagcaatcttaaatctttgctcccattctagtaaggcttgtgattcctgactgtcaaacaatattttatccaatgaaccgttctccacgtattctgaaaccaatatcctgtgtgaatcatcagaacaaaatccccaaaccctcactagattcatgtggtagatcctgccaatcacactcagttcatgcttaaattcttcttccccctggtttatgtctagcaactttttcacagctactaccctcttgtccttcaagacccccttgtatacaacgcctgatgctccttgtccaattgcatcctgaaaccttctagtagctgtcaccaactctctgtaggtgtatctgcgaaaatggttggttatcatttcatagccaacctcagctagttctcttagttgtttgtcctccctttgcaaaataagtgatccaaatataatgaataatacctctacaacaaatattgctgacaagaaaccatagaagtaccaatacttcgattcattttgaccgctcttaagcttatccaagaaatccggtacaaaatatttgtcaactgtagtacagtatttgacatatttctgatcaaaaggctgtgaacgggggacttgatgatccgacacttttaattcctgaggaagcttaatatacatggtaccagtactaccaattaagcttacaccactaagaagagcagtcttcggatagcaataaccttttccttgccagtatgcaaaccccacacagttgctgtcattcaagcatatcttcttgcaatcgtgcaaagaaacatgaggataagcccttatatcattccctaagaaatcagtgtttgggagcctaaggagccttactttctgttctctagtgatattgaactttgggctgcagcctttgctccaatcgcttgggtcactgaactgataaccaggggcacacacacatgtaggcgcaggcctatacacacatattccatttataccacacacaccacgtacattgcagagctgaggaaatgccatccatgtgactgaccatgttccgcttgaatcgttcagactgtacaacctgagattgccatcataatctagtgttaatctcctcataatcctaggacccaaatcagcagctgtgaagtttgcatcatcacttccaagaaaatgtccctggctatcaacagcaccgtttgcagtgctattaaacggctttctgtgcttctcccagatattctgagttggatctggccagtagatcaacgagagatccttctcatcataaaacagcgaaagtagatattgatcatcaaagtggaaactaaagcgaccaggggcaagtaatctattagtagatatgagcttaattcgagcagtaatgttttgagtgggtagcaaggtatcagtaggaaaagcaaagctttcccatagaatggtgtcacctttgctcttcacgatgaggtttccagtattcaagagcttagcttgaacttgctccgcatttgaagagctcacgttgttggtccacacaacctggccattataatctttcaacagcatgccgccatcggatttcaactcaaattttgattcccatgtgtacacagggtggagaggatttgcgctccagacaacagttttctcggaggagtttgagaaccagatggagaaggtggaggcattgggggagatattgtagaagccacaggtgaaagtacgatctggtgagtagagcagatccaagctgcgttcaacagagagaggggagcctggcaagagggattcaagagctgaggaggagtacaaaagcagatggatcaatgtgaggagaagcagagaggtgaagattgcatccatggtggttgccgcattcaagctgatctttcaaatgacaagcaatgcaagctgttatcggaactagctgcccaaacttgcagaaaaaagtgagattctaacattctatatactactacgaaggtgataagactaaattcagtctgccagttattttgcgtcaatgggcagtttccttggaccaaactatgcaatgcaagtaccatgttggcaaatgattcgtgtatacatttccaacctgttgcacaagtggcactgtggcatgacgtgtccttgtcaggatccgtaaatctggacagtaaaataagatttgcaatatggtaatgagttcagtgtacttcaccagtccataggtccatcctaaacggctgcacatgcacatattcatcccccatttccaaagaagcctgacttctaacatgacggggaagctcaggctttgaacatttgaacacaaaaataatggcaattggccatgctaatttttatttacatgtggtacttcatgcattgtgagtttgtgattgggtccctttcagctttgagtatactcacgtggaatcttcaacgagagatttcagcaagcatacacagtaaggagagtttaataatatttttttattggctgaacaaatctgtgaagacatttcttccgatcaaatgcccattgcttgaacaaaacatttacatccttacctaaaataaacaaacttaatacgggacgtggacagattcatcgactttgttcgtttgttacctttttcagctcacatcccccaattttcacatgcacgctttttaaactattaaacagtgtattttttaaaaaaatttctatacgaaaatttctttagaaaaccatattaatcatttttttaaaaaaagctaatccttaattaattataccctaatgagtagtttgtgactgctacaaagggactcagccttaaagatataggcaacatatccagacagagtcacgaaggggatatcaatttacaccaaacaatgctgtaaaaacagcttctcagacgacacagcacagcaccagggttcataattccaataaagaccggtcaaatacagtgaaatttcgagatttcgatgaggctcgaaagtagtaagctgtatgagatttcgatgagtttcatccaaattcaaatctgaattgataaaaaagaaaaaaatcaaataaaatcttataaatagtatgatattcatagaacctattgggatataaatttttgaaaaaacatcaactgtcatagtaccacaccattgtacacgtacgcgcgtggcgcaaataattttgggttgcctacggctcgggcgcccgagcgatttggagtaaaatcgggcgctgacgtcagcaccgatttacgtgcaaaactactttaaacttatttttctcttaaattacttatccaaatcatgatccgattgcaccattaaattcgttgcaattaaatcttaaaaacaagaccacacatggatatattccgacgaaaaaaatagcttattattgaataattttaaatattgcacgatgttctaccaggtatatcggaattgtttcactaagtagatcgaaaatgtttcactcgtttagatcgggtgttgtttcaccttatataaaaacaatgtttcaacaaatatcgaaagaatgtttcagttaactgcaacagttgatccatacatagtgaaacattataagtacactaggtgaaacatttttcggtggaacaaaaaataaaacgaattccctaaatagggggttttcaaaatatatgggtttttttttgcaatggaatatttttattcaatgcaacattagatctatacataatgaaacattatgagtacaataggtaaaacattttttgtaaaacaaaaaataaactaaattcacttaatagagagtttccaaaatatgtggatttttttattgcctccagggatatgctaataacatcaactgaaaattttgtatcgatcttaaattcgtaattacatcagttgttcagggttcagctagctagctataggaagtgtccggcatggtaggattctccgtccttgggatgcttaatctcgccgttacagctgaagcagaagtccgtccgcgacggcgaggtgatctccgggatttccaccggccgaccggcgggtcgtcgccagcggcgaggccgccaactcggtcggcctcgtcgtccagggaccggaggcacgtcggtatccaaccttcaccgtcgttacgcacctcggcgaagaagagccgctcctcctgccgcaaggtgccgccgccactggcggcggccctggctatgaagttgacgtggccgtagtcggctctgcaggtgatgatgacgccgctgatgatggccctgacgagctcgttgacgacgccgccgccgccgccctcgacgacgagggcggcgttgtagtgctccagcgccgcctccgcgtacatcacgctctgccgcatccagtccggatcgtcgggctccatggtcggaaacacctcgtagttcggcggcggcggcggcggcgtgtagtgctgcttgggcttcttcttgtttttcttcttcttcttcttcctcctcttttcgccggggcgatgaaacctgttgtcgaaactagatttcggcaataataaaagggggtggctatcaagctggaaaagtgtatgggttttgagacaaaggatttatacaggttcaggccttcttataaaagaagtaataccctactcctgtccggggatgaatccgccgagtgtattattgattgtatgattcgagaaaaatcaacatatgcccctagaggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagaaattctatctacattaggtatcctgtgcccagctcgaataccatcgccgtgtagatatgggatacccatgatctccacagtagcccccgagtcctttgcagtcgaccatcgtagccttctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcgtacgcggcgcctaaataggcatgctagccgactgctttttagccacaataaaagaaatccgagtggtttacactctaaaaggttcacgaatgaacacacttgacaggcatccgaataaaaactctaaagattactcatcaagtattataaagattatggtaataaataagtcaaatagcctaggccatgactatttaccataaaaacaggcatataagacgccaaggaaatgactataataaaaacaagtcattcctagttaacccaaacagtttttgtagcctaaaaaagcttgcaaaaacagcataacgcctttctgtcgggcacctttttaatttgcattgcaataattccaaagaattatatgaccgcataaaaaggattttatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgcaaagctgcgcctgcgaactagggttcacaactccgaccaaatccacctccgaaaagtgcatcaaaatccttctcgtgatccaccgcctcaatccctcacctctcccaagccatccctcgaatcaaatcagcacatttgagtgaaaccgatggcggaagagggagaaagcttcgaaagccaatgggcgacatccgacgtaacggaggagaatcttaaggagatggtggcgcacggcgttctccctgccaaggaaatcatcgggtggcgaccagcgcacggtgaggctttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgcttgtgaagcctttttggggatcaaacctcactttgccctattccgccggatcttcttcctcaaaccccaaccaaacaagaacaaaccgtgtgtagtcgggggggcaggattccaactaaggggaactctaagccaaaaatatttctcgatgcccttcaagacttcgaacaaaggatggcatgcgaactggttctatgttcagaatcccgagcctgctcttcccgggtactcttgtcttcctccaatgtaccaagacacttggaactctcttccgatcggagatgaagcagtacaagccttggagttgttggatcgtatgttaaatcttaaagaacaaggcttacagggagagcaaatcactcggcacttcatcaaatgccgactggcgccaattaaggaaagatcccgcacagcattcgagttcgacggcaaacatgatcccaaccgtgaagaaccagactccttggatttcaaaatcatgaaggagaggatgtataaaatcttctcaaatgcaattgtagtcagctactctcaccaactgccggtcgtgccattcaacgcattcaatccgcctccacaggtatgcatcggaaactatcaaaccatgatcagaacatagttttatcttcatgctgaattgactaactatggaagcatcttgtgcaggaatatgcattgatgaagtcagatccaccagtctctcagcgccggtctcctcgccaacacaccgctcagggaggtggagggccaacgatcagaccagatccgcaacctcagacctccaaattggctggtcaaacaggtcctcgcaagagaaaactggtacttgatgatgatgaaggcgacgatgataaaactggggataagggctcgcctaacaaacccccaaagcgcaccatgcccaggaaaaaactggctggccgcgcaatgccaaagatcagaacatcttccaggtattagacctctcggtataattccgcttcagcatgctttccgatgaaaataatgctaaatactgaaaaaacactctgcaggaaaccatctgatatagatccatctggaaaagaccctgatccggctaagacagagcaaaatatatccaaggactccgagccgactactgaaaaccagccgactgctgaaagccagccgactggcgcccatgcttcgggagatagggccaatccgagtgacctgccgccgactggaaaccagtcggcaacaactgaaacggcaacaactcaagagcccccgactggaaaccagtcggacgcaggccctgatcaagaaattcccgaagtagaaacgcagacgacgacttcgcaaggaccagaggctggtaacgactcgacaatcgggtctccgggtaaagaacaaagatcacttcacgctcagccaggtacatttcaggttagttgtcttctcaaacaatgtcgatttaaataacctcagtttatctgtctaatggcttggaaacacatcaggaccatcaggagatgacggagaagaaatccctcgcataaaggcgaccgacgactctcgtcctcctatcttgatcaaatggtgggacgagaactcacaagccgcaggcatagtcataaaccgtcaaaaagaagatgaagaagtgtgccagctgaagaaagcgctcggagaagccactcgtattgtaaatgtaagtcttccgggtgacggccttcggtaactttgttttctttttagcagaacctaaccgtgaaccatcgtgcagagaatccatcttcgcaatgaggccaagactacaactttggaaaagctggttcctcatttgggaactcttgaagcggttagggaccagctacatgaggccaaggagcacgccaagaagacggaaaaggagttaagggaccgaatcgctcagctccaggattcaaactatgagctgagtggttcatccaaaggtaatcatccagatctgttccattgaattatgctgtcataattgcatcctcaaacacttggatttcaaacagcgcaagccaccagaatagctcagatggaaaaacagattgaagccttgaaaaaagacaaaacagagctggctgcagaaagggactcagccgtgaaagaagttgaaggtactgccggctgatgatctgaactttcctcttttaaatgcagtagattctgattataaatgtgttttgtagaccgtaaaatcaagtctcaagctcagtttgacgtcctggttggtaagatcaagaggcttgaaggagcaagagatgacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagcatgggagctggcatggccttggcgatgacaaaatccttgtacccgagaattgaggttgacaccattgatgggtttgcagacgggacaagtgaagaagctgcccttgatcttatcagtagtgcgcaaaatgcggctgacaaaattgcgagcgatgttgtagagcaatttcgcaacaacgacctccagccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagcttagttgagcctagaacccaaagaagctattaaaaactttcagtcctcgcaaactaagtagaaaaaccaaacaaggcaatgataaaccaagtaagcaaactaaattgataaaaaatcacactccattattatgatgatagcccccgactgacaacttcaaggagaaaacttgatgtttgacagtcaaaatagggaaatacagtgataaagttaagcgtagaaacgacgaagatgttcaatgttccaagaattgtcgacgagagtgccgtcttcgcgcttgagtcgatatgaacctggccgggtaacttcagagataataaatggtccttcccatagaggagataacttgtgccgatctcgtgtggtttgaattttccgtaaaaccaggtcgccgactagaaaggcgcgagatcgaacattgcgattatgataacgtcgcaacccttgtaagtaccgagctgactgaatcaaagctgcttcgcggacctcttccagtcggtgcaagtcgtccactcggtcttcttcatagcgttcttctcggaaattacggaagcgcaaagactcaaattcgacttcactcggcaacattgcctctgccccatagacaaggaaaaaaggtgactggcctgtggcccgactgggagtagtacgcaaagaccaaagtactgatggcagctgttgcacccatttgccggcatagggttttagccggtcaaaaatacgcgctttaatcccttgaagtatcatgccattggctcgctccacctgtccgttgctcatggggtgtgccactgaagcgtagcaaatcttaattccaaagtcttcacaaaagtctttaaaaactccgccagtgaattgtgtgccattatcggtaatgatccgattgggcactccaaatctgtgcacaatgttgatgaagaaatcgcgagcattatctgctgtaatcgtgacaacaggcttagcttcgatccacttggaaaatttgtcaatggccacgaagaggtgcgtgtaaccgccgactgcctttttaaacgggccaaccatgtcgagcccccaaaccgcaaacggccaagacagcgggatagtttgtaactcttgagctggcaagtgaatttgtctggcgaaaaattggcaaccttcgcacgtgcgcacaatcttgtcggcatcagacactgcagtaggccagaaaaaaccttgccggtaagctttgccgacaatggtgcgtgcagcagcatggtttccgcatatcccagaatgtatgtctttcagcaattgtctcccttcctctaaagatacgcagcgttgcaaaattcctgaagggcttttcttgtataactcagattcgtgcataacataaagtttgctccgccttgaaatccgctcggcttcatctttatcttgagggagctcttgagaagttaaaaatcgtatgaagggctctcgccagtcggcttcaaccatagctacatcatgagtgtccgcaacttgagtggtatctttgtgaggtaccgtcggcgtataaaggtgttcgacgaaaacatcagagggcgccgcctcacgcttggatccaaagttggcaagtctgtcggcggcttcattgttgtgtcgaagaacgtgactgagctcgagtccatcgaacttgtcttccaacttgcgtacctcttgtcgatatgccatcatattgtcgtcaaggcaagaccactctttcataacttggttaacaaccagctgtgaatcgcctcgaactattaaacgctttatccctagggaaatcgcaatccgtagcccatgaaggagggcttcatactcggcaacgttgtgggacgccgaaaaatgtatccaaagcacataacttagtctttctccagtcggggaaattaaaaccactccagctccagtgcccgaaagtctttttgacccgtcaaaatgcatggtccagtgctctattttctccacgggggtatcctcttggcactcggtccactcggcgacgaaatcagctaacgcttgagatttgattgaagtgcggggcttgaatgatatgtccaaagacatcaactccaaagcccacttagcaatccgcccatt

SEQ ID NO: 56328 - DNA, 2318 bp, Oryza sativa
cgccgccatgcatccagtcagcttctgaacatctttctgagtgcttggcggtttcatgttgaggatagcagtaactttctccgggttggcttggatgcccctatgagacaccataaaaccaagcagcttccctgacggtactccgaaggtgcacttttcaggattcaatttcatcctgaaagcacggatgcttgcaaaggtttcttctagatccgagatcaaatcatccttttgcttggtcttgacgactacatcatccacataggcttcaacgttgcggccaatttgtgttgagaaacatctctgaatcatacgttgataagttgctcctgcattttttagtccaaacggcatggtgacgtagcagtatgcaccaaaaggcgtgatgaatgaagtcttcaagcagtcggattccttcagtcggatctgatgataccccgagtagcagtccaaaaaactgagaagctcacagccggcggttgagtcaactacctggtcaatgcgaggcaacccaaaaggatctttgggacaagacttgttgaggtcggtataatcaacacacatgcgccactgtcctgtctttttccgaaccaggaccgggttagccagccagtcgggatgaaggacttctttgatgaagcctgctgctaacagcttggtcaattcctccttgatcgcgtccttcctatcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtcgcggcttctgtttccccaccttttgaaatcttggcagcgggcacttcgccttcgctcaccgtggttgcagccagtcggatttcctctcgggcagacgccatctcgcgggtttgggccatgtcgcaactctccttgtcgcatgtgacggcttgcttgatgtcgctccgtagggataggactccacggggaccaggcatcttcatcatcatgtacgtgtagtgcgggacggccatgaacttggctaacgccgggcgtccgagtatggcatggtatgctgtctcgaaatcggcaacttcaaagctgatattctccgtgcggaagttttcccgagtgccgaaagtgaccggaagagtgatctggccgagtggagttgcggataatcctggaattactccgtgaaaaggcgcattgcttggctttagctcggagcgaggaatctgcatatcatccaaggtcttggcgaagaggatattgagtgcactgccgccatcaatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttttgcttccgtttagactcataagccatggggccgccgaaaatatggttgagctccttgcggtggtcttgaaatccagccggggtgtcgccgtcatccttcttcctggacgtgctttgctcttcgtcggagttcttccgagtagacttggtgtactgctccgcgaactgcttgtagatgaagcactctttggccacatggttggagtttgggtgatgcgggcattgggagttcatgatcttgtcgaaggtgttgacgcgcgaacgctgtcgagaagagtgagcggcggtcgcaacaagttcctcaggcttacgcttgcggtccttatgattgttacttccacctcctcccgtagccggcgtatttttcggtttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggagatgtcggagatcttgttacgttgttcagaaaatcgtcggatatactctcgaagggattctccggatttctggataacgttgtaaagatcatattgtgtgccaggacgctcgaaggtgccttggaagttggcaatgaagtggtcgcgtaattcggcccaagatccgatcgtaccacggggca

SEQ ID NO: 56329 - DNA, 8811 bp, Oryza sativa
cgagtgatggtagcctcgagctgctcggcgctgtatgattgtgtcgcgaagatcgatggggcggcgacgaggtggtgagcgaggccgttccactcggcgctccctatgaaagtcgggaggtgagtgaacagaccgctcgtcgtgacccctgctcctgcggttggatcctgcgccggtgatgctgaggcttggatgacggtagtcatgagatcggaagtgggggactcggctgccagtcggcgtgtggacgctttcggagttaactggaaccgaggccgcaatcatggtctttgtctggttcaagatgttgacgacgtggtcggaacgattgagctcgttttggttgaggagggtgtcgaggagggtgatcgcggcaaccgcattctgttgaggggtgcggaaaaccggtgtcccttcgacgtcttgttggccgatgagatcacgcgctcggcgccctgcttccaaagctcgctgacgtcgatcttcagcctccttggcgatccgctcacggtcctgctgctcacgccgtagccgctcttgttcttgtgcttgatgctcctcctccagtcggcgacgttcttcggtctcccgggcttggcgttgctcctccgtctcattattggccatgaaaacgccaaagtagagaggggtgtagttgtcatcaaggcttccgtcgaagtcgtcgaagtcgttgtagcgagaactaaattcgtcgtactccacgatgtcagtaggacgtgagtcgacggtgggagagctgttgtagtcatctagttgatccgtcgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggactggtgggtaagccccatcatcttgatctggtgtcgttggagaaggtacgatctcggccgagtggtttgaagccgactcgattgagatggtcttgaagtaggtttcagccgcgtttgggaatccaaacgggactgagatccggttctctcccgactggtccgattccgagtcaaggagagaaatcttgccgaagttgttggtgacgaagtcgaggctgccgaaccgaaacgtctgcccgggtgggaagacgaggtcgtcgatgccggagaaaggacccattgcactgatcggcgaaaagcttgacgctacccctacctggcgcgccaactgtcgaaactagatttcggcaataataaaagggggtggctatcaagctggaaaagtgtatgggttttgagacaaaggatttatacaggttcaggccttcttataaaagaagtaataccctactcctgtccggggatgaatccgccgagtgtattattgattgtatgattcgagaaaaatcaacatatgcccctagaggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagaaattctatctacattaggtatcctgtgcccagctcgaataccatcgccgtgtagatatgggatacccatgatctccacacctgtagcgtgggccgttgtttatgagggcgttcttgcgccgcggccggagctccacaagatatgcggtggacagtttctgctccggcagcggcagcggggaagagacccggctcggggacagcggtgagggtggctcctcgtccaactgctgctcgtagtcttccgtgacgccgcagtatcgcaccggcggcggcgcgacctgctccatggatcgatcgtctctggatcagcactactaggaagatcgatctgatgacgcgtggcgacgaatgaaatatatagacggatactctgatccagtcccaaaccgtctcggtgtcggtgtccgcgtcgcatcaggtcacgcgtgcggaacagcggaacgcgcgaacgacaatgcgtttcttcggaaaagactccgcgtaggacgtcaaatatcggacgccgtgcatcatcacaccacctacgtatgcagcatgaaaaagttgaaaaatttatgtataggaaagttcgatctgacgaaaaagttgaaaagttgaaagtttgaagaaaaaagttaaaatctaaacagggcctataatacatgcagttgtagttgaagtagctagctagctactccctttgtcccaaaatgtaaatatttttaactatgaatctatataactgtatgtccagatttatagataaaaattatatgtctagatttatagataaaaattgttatattttggaatggacgtagtagatggctacaggaagtgtccggcatggtaggatgttccgtccttgggatgcttcatctcgtcgtcacagctgaaccagtagttcctccgcgacggcgaggtgatctccggcaggtccacctgcgggtcggcgccggcgccgccgactcggtcggcctcgtcgtccagggaccagaggcacgtcgggatataccgtttcttgtccttgcgcacctcggcgaagaagagccgctggtcgcacgagctgccgccgccaatggccctggcgatgaagttgacgtacgtggccgtaggcggcttgcaggtgaagatggcgccgctgaagatggccctgacgagctcgtacttgacgccgccaccgccgacgtcgacggcggcgttgtagtgctccagcaccgcctccgcgtacatcgtgctctgccgcatccagactgggtcgtcgggttcgaaggtcggatattcctcgtaggggcagatcggcgaaggcgggctcggcctcggcgttgaaaaggcggcggaggcgtgtggtggtgcttggacttgttgtgtttcttcttcttcttcctcctcctcttttcgccggggcggcgaaacctgtagcgtgggccgttgtttatgagggcgttttgtcgccggagctccgcgcggtatgcggcggacagcttctgctccgcagcggcagcggggaagagacccggctgggcgacttgggcgagggtggctcctcgtccacctgttgctcgtagtcttccagaacgccgcagtatcgcaccggcggcggcagcggggaaggcgcgtccttctgcatggatgtcgcgcctctcgatcgatccgttgcgtgcgctttaatttcctcgtggcaacgaatggaagcagcttctggcctcgcctcggcccacggtccaccccgccaatatatagaccgatcgattatggatccaattccaaaccggcttggcgtcggagtccgcattgcattaggtggcctagcgttgacggacgcgtttctttcccttctgtctccctcctcctttgccgcgccagggtttgcagttacaaacgtttttttttctgggcgaaagaaccgaaatttcggaattttttcttccgaaatttttttaattcaaatatgaaaatttcgatcgaaaatttggagtataaaaacttggggcgctccgagcacaattttgcagtcagataattcatgattttcaaaaaaaaaaataagtcatcttgcaaatcaatcagtccattacaattgcatacaccaataaatccattacaagttcatcacatagctttgacagtccattacaaaggtttcaaacattccaaatgtgcttaacaatatatcaccagtccaaaaattgtctcaacaagtcaacatagcaaaataacatcatccaacaggtagtttgtacagtccgttacatagtaaaataacataatccaacagatagtttcaacatcttccaaaagtgctccctccgtcagaaaaaaaaaaaagccaaatcctgagttttcgtgtccaacgtttgactgtccgtcttatatgaaatttttttataattagtattttcattgttgttagatgataaaacatgattaatactttatgcgtgacttgtcttttttaattttttttcttaattttttcaaataagacggatagttaaacgttggacacggaaactcagggtttgtcttttttttggatggagagagtagttattcatggacatccatctcctcattctcagtaaattcgtgttggagttactctttctttgtctgatctgaaacaattaaataaagtatatatgtactagtcagtgcacattccatgtgatttgttacaagcaacatcatatggtgtttttttcttctaaagatgaagataaagattaagttttttacgcaaaataaagtggtattaacgtttgattgattgggttttaattattaaaaacttgaaaaatatattaatataatattttagagtaactttcatatagaaagttttcacacaaaacataccatttaacagtttgaaaagtgtgccacgaaaatctttatcttcatccaactcttgttggagaaatgaacgggacatgtaggtttctaatttgtccatcacagagctagtgtaaaatacaagttttatttcttattttctaaaaatacaggaccagtgtgtggatgttgtcatatgcttaattgctgtcacatcgaatgtttgaacacatgcatggagtattaaatataggaaaaaactaattatatagcttgcgtgtaaattgcgagatgaatcttttaagactaattactccatgatctgacaatgtggtgctacagtaaacatttgctaatgtcggattaattaggtttaataaatttgtctcgcagttcaaaggcggaatctgtaatttattttgttattagtctatggttaatacttcaaatatatgtccgtatatccgatgtgacacgtcaaaaacttttcaccctagcatctaaacacaacctaaatacactcagaacgcaaagtgagctggttttagtgattgagggagcctctctatggctgattttacagttaaaaggatacgaatagttgaggcagtcgaaatggattttcttcaaaagattgctccttattttgaataggacaaatgtttgcatcagaatttaactggacctgggatccctatatgagcttctcttgggcctcggttgggcccaccgtttcttccaaccaaaatgggcccatgtaaaccgatgttagctcaaggcccaactagcccagctgacggtgtcctcctcctcgcgttgccagcatttcacaccgtgcgccgccgatcatggccgccgcccgccctcccgccgcgcgccggcgacgcgcatcgctgggcagccggagacccgcgccggccgcggcgctcctgttgcagcaaactccatctccgtttctccactgcaacggtacgagcaatagctgctctctttctccgtctttctgtgtctgcacgaggtcgttagggtttggggttagaaaggggatcgttgagatgcgacatcccggcgttcatcctgttaaattccaatcaaattgatgccgaaagccgatgctgcggctcatctgatccaatcaagttgaatcacagctgcagcagcggctgtgctggtgctgtgaattgccccaactgcgtctcaaaatctgccatgggaacgagcaatctaggagcgtagcagggttcgtaatagtaaggtgcgatgcaaatatcagcacgattcattctaccataggacaccaatgcacactttgtccaggactccaggttctagctataagttcgaatcattgcaacaaaatatatgtagcatagtaattgcattactaccccattatttctaaattgatacattgcacatttcagaaagcatagtacatgaaaaatcatgcattcagtacacaatggggcttaagcagttcctcttaatgcatcagaccaaaagacattttcttaagtagatgatattttagccaattatgaaagactacaagatatattctgtggatgtcaaatggcaaagctctttaccagaattataactcctaaattgtagaactggcttcatcaactgaaacaagcacctccaccacactttccatggtgggtcttctacctctgtcttcctctaggcatgaaacagcaagcttcatcattgctcttgcttgcaagtcattgaatcggccatttaatctggtgtcaatgaactcaacaatccacgattgtccatccccacctgacttcaaactttccgcgagtgtcctaattatcctcccgaggaccatttccacctcttcatcctcatttgtttcaagatccgaaacacgagctcccttgagtaattctagaagcactactccgaagctgtacacatcaacctttgctgttatcgggagacttgaaacccactcaggtgctaaatagcctctagttccttggatccgtgacacatttaatttggatcctcctctatttagcagcttcgcaaggccaaaatcggcaatctttggctccatgttttcatccagcagtatattttcaggtttcacgtcacagtggatgacccactccaagcactcatgatgaagatatgccaatcccttagcgactcctagagcaatgttaaatctttgcttccatccaagtaaggcctgtgagcccttagcaccaaataatattttatccaatgatccattctcgacatactctgaaatcaacatcctgtgtggatcatcagaacagaatccccaaaccctcactagattcatgtggtagatcctgccaatcacactcagttcatgcttgaattcttcctcgccctggtttatgtctaacaactttttcacggctactgctctcatgtcctttaagatccccttgtatacaatgcctgatgctcctcgtccaatctcatcctgaaactttctggtggctatcatcagctctctgtaggtgtacctacggaaatggtttgttaccatttcatagccaacctcagatattcctcttgctagtttgccctcccttcgcaaaataaaccatccgaatacaataaatgttacctctgcaagaaatattgctgataagaaaccatagaagtacaaatacttcgattcattttgaccactcttatgctcgtccaaatttttgttagcattgcagtcaggaccgtattttggaccaaaaggctgtgactgtgggattgaagtcattgaatgctccgacagttgtaattcctccaacacttcttccatagggagcttgagatacatggtgccagtactaccaatgtgaggtaagcttacaccactaagaagaacggactttggatagcacttaccaattccttgccaatatacaaaccccatacaattgcagtccttcaagcatatgttctcgcaagctccaagagaaacataacgaagaggacttaaatcagaatctaggaattgagtgtttggaaggctaacaaacattaccttctgttgtacatcacaagtgatattgactcttgggctgcagcctttgctctgatcacttggatcaatgaagtcataaccgggaggacacgcacaggcaggcacaggtgtgtacacacatatgccatttataccacacacaccacgtacattgcagagctgaggaaatgccatccatgtgactgaccatgttccgcttgaattgttcagactgtataacctgagattgccgtcataatctagtgttaatctcctcataatcccaagaccccaatcagcagccatgaaagttaaattttcactttcaagaaaatgccccgagctattaagagtaccggtcggtatgatattatacaacatcctttccctccccgagatagtccgagtcggatttggccagtaaataaaagggatatcattctcttcataaaacagtgaaagctggaattgatcattaaagtggaaactatagcgaccgggaacaagtaatctgttagtagatgtgagcttaattcgaacagtaatgttttgagtgggtaacaaggtatcggtaggagaatcaaaactttgccataaaatggtgtcacctttgcccttcacaatgaggtttccagtattcaagagctgagcttgaacttgttcaccatttgaagagctcacgttgttggtccaaacaatctggccactattatctgtcaaaaccatgctgccatcggatttcaactccattttggatccctgagtgtagacagggtggagaggatttgcgctccagacaactgttttgtcagccgagttggtgaaccagatagagaaggtgcaggaattgggggagatcttgtagaggccgcaggcgaaatcgccattcggcgaatagagcacatcgtcttcagatagagatgcgcctggcgagaggaaatcatgtgctgatatgcacaaaagaggatgaatcaggagaaggagcagagaggcagagcttgcaaccatttttgctggagctggagagcaggtgttcgtctttcaagcgttgctgttaacttattataagaatccatactggtcagtggtttctggatccagtaaagaaaagtgtacttctttggataacaggtttttgaagcttgaacttcgtggcagatgcagcctctgaacaactgtgcacacatgcattccttaaaaattcaagggtgtagagatctctactgttaaaaaacaagtggggtacagtgtattgattagcatacatttaggctcccccaccagtaggcattaaccttatccgttgttcatatggcgttgttcaaataagaaccttcaattgccaaaaacaccaga

SEQ ID NO: 56330 - DNA, 4047 bp, Oryza sativa
tgtgtgctcagtccaagtcagtgtgcaagcttctttcaaaccaggaataggattttaggagtatgcaagatttcaagttgcacagcaatgcaatgttgcgagtaattcatggttttatgcatacatttccaacttgcttgacatacactgtatatggcaaatgtggcatgacctgtccttgtcgatcaggaaccgttaatttaggcagtaaggtaacatctgcaacatggtgatgaattctgtgctactaccatgcttcatggctgcacatgcacatattgatctcgctttttcaaagaaactgacttgtaaataaacaagataattttgctttcttttttaaggtttgctcccaatgataggattcagagggagtgcaaatttgaagtgttctcagcaggtcaccacgcctggtcactgtcagcaatctaacacatactgtcaacgaaatagcggtgcagccgacaggtcacacatctccaggaaaccgaaatgtactactgctatcaaccaaaaaaatagtggattacagtgtattgagcaatgcattggttttcaacaagcagttgtgacttgtgacttgtgattcgattttttttggtcggtaccattttttaaatacaatattgaagtttttataggaagaacatatttagtaacttttttttgttcatagggatacggtattgtctcaggtataatgctagctcatccaaatgatccttataaagatcactcccatgatgtgtatatatgcacagcttaagatctctgtttccacattccacattgctgatgcactcgacgaagaaaccttcatttggtgaaacccaatttttggaggaaacgctccgccattgcttcgggagacgctgagacacgatatcaaccccggccaaccaccggagtaactcaccgtgctaaaaaaaaagtatcttctggttgcatctactccctccgtcccaaaataagtgcagttttgcactattcacgttcaacgttttactgctcgtcttatttgaaaattttttatgattagtatttttattgctattagatgataaaacatgaatagtactttatgtgtgactaaatatttttaattttttcacaaaattttcaaataagacggacggtcaaacgttgggcacggatattcacagctgcacttattttgggacggaggtagtacacaataattataattaattaacttcatattttcttacaaactttagtgaattaagatattgatatatatactccatctgtcaaaaagaaataatcatgggtttatatccatattcaaatttaggattgggtttttttttctggatagatgaagtatatgtcacaattctcgtgacatgtatgtgtgcatccccaacataattttttttgggtctggccatggtttgaaagcaccattttgtagttccgggcgtccgtcgtcagtttaagatcaatgcggttagagtgggattagagcgaccatcacacctttggtagagctgacactttcatgtaccagttgcatgtatctagcacagccatttcttaaacgatacgagtgactgtgaagtcgaagcttgcagcattggaagacgtgatgtgtgatgtgtggcaacaatggcatgagtttagttttttttaagaaaaaaagggtaaaagctttgcctcatatatattttgatagagcaaaaagagaaaaaattataaatttttatttacagggcatcaaccgaggctcaggtaagcttttttttttttttgttttttaacttcccaaagcggtaagctcatggcatgagtctagtggagttgctgggtgttggtgtgggccgagttgctgatcttgttccataggttttaatgttttatataacagcgtattgtaagatttgataacaatttttaagtaaaataagacactcttctttaatataacgcgtcgggccttaattaattgcggtggtcttgatgtcgaggaagccgttcagtccccggatgtcgtagttgcatgacacaactgtctcggttaatcggttgaggatcacaagtatcacacgatcttgatcgattgcatgatagattactatatgactatatatataaggcaatgcatgcatagaaactcaagcctcttttagcttactcaagcccttggtcatcaaatggcaaacaacaacggtaggtacatgcagtatttgtgttgattagttgattatggctagctagcttagtttattctctcttgaccatcagttagtataatccatattgtcagttttttttttttttttgagaactactcatatcttcagtcagcatttttatacatggtaccaagtaattgctaccctaatttccaggatatggggatggtgatgatcagctcaccacatgcaccaagctggcgttagaccacattgtaagtgactagctaattaattaactgctatcatgcatgtcatctctagatctcttgatatagatcatcatgcattgaattgaatattgtcatttccaatcgattatatttgtgtgtatgcataattgatcagagtgatatatgctcctgtgcaggacatcgacctggagaatgtccaaggcttcgacagcaacgccttcaccatgaagctgttcgacgacaacgacgatttgatctacttccacgtcgtgtttaccggcgagacgccgggacggcgcggcggcggcggcaagcgttactccttcgccgagatcgtcggaaaagacaagccggaggaggtcagaatgtggaaagagatggacgaagaaagtgaaagtaagcaagcacacatatataccaccagcagctaattaactgatcaataattaattagattcatgcaactgaagcgttttcaatatgcatctgggcaactaattaactagctaaatattaatcctgtgtgttttcttttgcaattacagattgcaccgtggagaactgcatcttctgcaccgggatgtggcaccctctgtcgggtggcttctgtggatacaagaggaagaagaagaaccggagataggctcttctgcaattatcagccactgaagctgcatgtctcgtcgtctcatctttcttctaactttgttttctagaaataaattgggtaccaattaagtttagttgttatcgatgagttgtcgctttgatagatcgcgacgtagctggctgccgtgcttgcttgcattgcttagtatacatatgtgcccaaattaatttatatgtaatttctgttgcttgcttgaagaattaattacttcatcagtgcgtttaattaatttcatgcgtgtgctacattaatttctgttgagcttttctccatttcattatgcttgcgaatgtgaatatgtgatcggttaagtagttttggcagctgtcatagacttatagtactctcaattccattatatttggagtaatacatatggtatatattaattaacgtacccttgaaccttgatttctacttcccattgagcaagctacatgaaacatttacctcttaatttttcccttttttcacggaaatcttgacctcttaattaatcaagtgatcacaaaatatatttatagatccatgatactgttaaagtgaaccggtaactttcgatataattcaaaactgaaatcgttaagtttcgatgctttagaaccaaattttgtatgcgtttttttttctacaaacctcattcatctatcctccggattttggattttaatgtggacaaactatctccatgactcaatcccatcatgcattcaacctgcattttattactccctccagcatacatttcatgtttggttcacgtactgtaagtttaattgatgttctaactaccaccaactacctcagagagaagatgtttggttacttgtacatagtaactcacagtttgccagccattgcgtcaacaaagtgagactaccaaaaattgccagagaagtgttttgtgcaatttttgcatttctttagactacaaacaacaatatttaatttgcactaataaatcaag

SEQ ID NO: 56331 - DNA, 2208 bp, Oryza sativa
acatgatttattacacttatttacatcatagagccaacaactgtgactagcaagaaatttcagaggcaaatacattcaatcgcagtcttttacagcatgattattccagttatttataacattctattacatacattactaattgtcccaactagcaaatacattcatacaaaaaatctcacgaccgaatctaattttcaccaaaagttgaatagctaatgagctacagccaagaacatccccaagaacagccgcaagaacacatgaaacaaaaaacttaagagtatagttattaggaccggaccaaacagactagcaaagaaaaaaaaggaaataaaaaacagaagttgagccttagttggtcccgtttagttaaaatgaagggaccagaccgataatccgaccagaactaaaatggaaccatgcaaactgatggttgggaaggcagttccttaccactacattgcgttgatgttagtgtgatagctatgaaatctttaatttcttaaaacatctttagaccagtgatccaaccggttgtaccactcaaaccgtgaactaagaacctaaaatttcagtacaaacaccctcaaaccgatggttagacaaaacaaattaaacatatattaattagaggatatgtcgagagcttatgccttagactttggtgggacttgggataagagttggccctatgcaggattttcttacaacaacagctatcaagatagccttatagatagccacattcgaggcattgtgtaggagaaaatgctgcaccccctctcctttaattgggatcaaacgagagaatgtcggctctttgggagttgggactggcatccaaaacgaagcagagaaaaaagtgaaaatcattcaagaaaggctgagggtagcccaatcctgccagaagagctaagctgatagtcgttaaagagatttgtgttttagtgaaggagattttgtgtaccttcgagtccccccgtttcgaggtgtaccctcttacaaaccaagggaaaattggcaccatgctatgtggggacatacaaggttttgagtcacaaaggagaagtggcatagaagtggcataccagttggagttaccccaagtggcataccagttggagttacccccaaccatggttgtcatatatgatgtattctatgtttctcaattgaagaaatgcttaagagtgctcattgagcaaattggcctggatcagatcgagatacagaggatctgacttgtggaaagaaatccatccgcatccaaaccagcaaaagaaacacacaaagacgagtggtcagtttctacaaggccaaatgaagcaatcattcaaagttgaggctacatgggaacgagaggataaattgaagtccacccatctgcacttcttagccagcacctccgaatcttagggatgagatttcatttaatacgggtagatttgtaataccctgagtttttcccctaagtaataattccattaatagtacatttctagaaattgccaaaaaaatcttataggaaaatctacaacaataaaacccttaaataataatctattctagttgggtgtaattttcttaaattccccatgctttaaattactcacagtatttttgcttgattttttttagagaattggagctacttttaataacccataaacaaatatcataataaataaattcataagagcttagaaaaaactctcatactcttgggtccactctcggtgcatccttcctccccttccgcccgcgcatgctagcaagtcgccatagccatatcctcttcacactcatgccagcctagcctcccatgtagtcgtcaccctaggacactgtgtcacgtcctaaaatgaccctaaaaatatatccttaaaattatgctcagaataattaaaatccaagtgaaagcctccaaaattaaaatgtgcaaagttaaaagtcaaataaggcttgggggattttttatatttcctaaaagctaaaatgtgtaaatagattttagtggaattttcagagcacaaataataattatcaagaaataaacaaagttaaaaaagttttataaaaagaaaaaccctaaaaatcccctccctctctctctctgggctgaattcggcccatctccctccccctctctctcttcccccgcggccccactcggcccctccccgtgcggacgtcgctgacgggcgg

SEQ ID NO: 56332 - DNA, 17512 bp, Oryza sativa
cgtcatcgccaggggtgagccgtggaccgctgcctcctttccccccttccctttcccgctctcgaggcgtggaccaccgtccaccacctcaccagtgaccataggggcacaggcgccgcctcccgccgaccgcgccgacgtggccgcctccgagcgcgccgtgtggccgcgtggggctcggccgtcagccatccgtgccctcgggtgcggctgacgcgtggggcccacggggccgaccggtgtgagcccgagtgcacccagtccaccgtggaccgtgaggctgccgcatgggccccactcccgtggacccggtccacgcaccctctcccctctgctgacgcaataaaccctatttttaattaaaatttaaatgaagaaattcgcaaatattcacattaagagcatataaacttcaaatggctatatcttggtcatttgaactcggaattggaccgttcaagtctctaatttttccttaagaagtcaagaacccatttatgtactttgtttctgcttgttatatggagtttattaaagtaaaagcctttttttctttctgttggtcgtgtagacgctgcagcttcggaagatccgctctacgtggaggttgaagccgacgtttgggaaagcgagcaaggcaagtcacatctcctttgaacatattgttgtcccatgctttaaaattattttgttttaaattaatgcattatcgctttattcaaattcccacgttatcactgttttatttagccatgcctatttacctttgttatgaccttattattattgttattgttattaaccctagagtaactaaaacctcactggtgtgtactgtattatggtctcactagtaccaattttaggtagatgcttcgccatttaaattagacaaattttaggtggttttataattctagactttgggagttctcatatcagttgtaccttgtggaatggttggcttatgtggaattggacacacaccttctcctctattcaaaaccctcaaaatggttttaggctgggctcgaggtgcatggttttgatagaagcacctcggccactataaggaccggtcttcgggcctctgttgcaaagcactaccgtacttccacatgtctagtgggtaaggcgtagtttgtggctcagtctggtcatgggcaaaagtacatggatagggatatacgaagtcgaggcttgatggacatctcgaggacaaatgaaggctacacaagctgtggcccgatagtcgagatgtcacggcacagggccggtgtcttgttgctaggggctcaaccttggttacctgtctcgggattccggccatagccagggttgggtcggtactcttgtttatggctaggatgggttgggaactatgtcatgtcttccgtctgtatgccgtggtggtatgtggcacgtggttacacgtgaggaagacgtgtcttgtgggtaaagatgtatacctctgatcagagtataatctattcgaatagccgcgcccttggttatgggcaagcctagcaatgtacccaagttagtggtttattttttaaaacttgcttaacaactaaaatgtgaaatggttggcctgggttggcttgggacgaactgggacctgctgggtctggttgccagttcggtctgaatcatcataggccttgggttaaggcaggttcgtgggggttcatggccttgattaataacactgtgtagttctaggatcgtctttacaaaatggccctgagcaactaaatgtcttctaaatgctgtttactgcaaatcctaacccctatattataacccccttatactccttcacatttattctgcaattgtgggtgtgtcttgctgagtacggtggttgtactcaatcttgctcattttttccccaacctagaagaggagttcctggaggatgatggcgttggtgtctagctcgtgcctgccgtcaagtgcctgtggtcgtcgccctagtcttccactgtttttgtttatcttcgtgtgtgctgagccttcgtcgcccatgtaataaattaactatttacgcttccgcttgttaaactctgaattgtatcaacttttggtgtaccttgcctcctgggacaaggaataatacacgcacttatggaatgcctgttgggttaattccggtcgtgacacactgataggtggggtctacttgtcgggatcatccctaaccttggccatgtcgcgatcccttgtcacgccttcccacccacgattgctcattcaaactcacgaggacgtgatcatcgcccacttcccctaccttcttcacccactcgctcacaatagctagcctttccacccactctatccttcacatcacctccacgtcaccctagccaccgcttgcctctccttaaccctgcctcccaaggctaaaaaggggcccctagcctccactactttttttccaccctcacctcctaaaaccaagcttctggacctctccattgctatgaaaggtaagcattgctgtctcttccattcttcgacatgtttcgacgccgttagggactgtagcaaccgccgctagcctctccatgtccttcataggttcaggtgtcctcggccatggcttccccacagctgaggactggtggagcattgtctttgccggtgtcccgtgagtcttctctccctgctgacttttgaccgtcatttctcgcgtctcatggcatcgtggacctccttaaccaccaccaccaccccctaccttcgcctggtcaaggagatgcttggccactcttcatcttcaccaactgccagtgaattgctgtcaatatcacttacccgaagcatcttgccgcttcgcgccccgccgttggtttcctctctatgcgcaccgccgtcttcaccattgtgcactcggcgaggacaccatcctattatgcttcctttttttccactcccatcgccacgtcgtatggtcgctaccggcaaccatcaagtcacacatccggttgtctggcaagccgacccctcctcgccccgtccgtccaatctgtcatcctcgtggatcatctgtggctgcctatgtcagtgccgtggtgacaccacctcaatgcacctgactaccatgcccgccatgtgcactgtcgcatggcaaggacacatgaccgtgcaccagtgatcccgggcttcgatatgtgctggcaaatcccggtcattgacctctcgtggaccacctcggcggatttggtccacgagagctggcctcccttcctcgctgaccgtgaggcccgcctgttgacgccaggttccccactactgacatagtaatcttgttataatgcgtcatatatcagtttataacttctacaaatgattacaatggttaaaatttctaagatttataactaattcattttaactaggtattgaacattcaacatgcacatttgctctaaaattttaaagaaatcattacaaatgttagatgtattgttttatgttgtcttatgtactattttgcctatgggagtatctaaagtgaaaaaacttctagaaataactataatataattgaaatgtaattatactgtaattacactgtaactacggtatagcttatataaaacttgtattcaattatggttttgttggttagcagcggaatattatacatgacatgtgtggaaatttctttctagcaatttttttccttcatgcacaaatctcaaggcaatcaaatggctacaaatttgaatgttcattgagcaaaaagaaaaaatttacgaaagtttttagcaatttcgtttgcgtttttgctttgtttctcgcttccaacgctcccatttaggccatgtttagtttctactcaaaaacttttcaccctgccatatcgaatgtttcgacacatgcattgagtattaaatatagacaaaaagaactaattacacagattgtgtgtaaattgcgagacgaatcttttaaacctaattgctccatgatttgacaatatagtgctatagtaaacattcgctaatgaccgattaattaggcttaataaattcgtctcgaagtttacaggcggaatctataatttgttttgttattagtctatgtttaatacttcaaatatgtgtccgtatatccgactgacatgtcaaaattaaatttgaaaatatattgtttatttattttttcctcaaaatattcgggatacaaatttttcttttttacaaatataccgtcctcgctagtttagagtgagaaaacgatacggtatcgtataactactgcacgagaatgacgtagggtgatgacacgacacggtttcgcgaggggtgtcgcgagagcgtacggcctcgcacagtcaatgtacgagaccgcacggcattagctgccacacccaatgattaatgtcttaatcacattgattagcaactaattaatcatcaattatcattaaataataattaattatagtaattaatcattaattttgtacaagacattcggtagcactgtttctttgtgcgatactgttcggtatcgttacttcattgttccgtttcgctgtttcattatgcgagaccgtgctctcgtacaacggttgtgcgagatcgatatatatttctgttaataaacttgtaccccgaatttttttagaaaaaaaataaataaacagtatattttgaaaaaaaaattaaactttttacccatgaactagagagggcctttgtacgagaatatcgcagaagtcccaggaggccagcaaggcaagttatatgctctttttttttgaaacgttttatcctttacaaataaactttcatgttttataattacatatggatacatagggacacctatgtataatagcgacagcaaagaaatgatttattatagtaggtgttaattagctttaggtgtctttgttccgcggccggcggcggcccaccttcagcagatgcagcagctcgcacgcccttgtggtccggtcgcggccgcgcgcggcgcaagggcggcgtccggagaccacccgatccgcagcttcaccgcccaaaaccgatgctccgcccgcctccacgtccgccactcgacaggtaagtcccgtagtagaggatggggaaaagtggctacttcgcgctaccgcttctgttcttccaactgaacaatctatattgccaagtgttttgggtgataatcgtccgatctgggaaatgctactagtagtacatgatctattattgttcattttattgcacacagccaccgtgtggacgtactgtatattagttgctgcgtcagtcaaggttgctgtagacgtagacaagtagtattgggcattttctttccaagatatcgagggattgtagtacttattatcttgttaaaatgttggtttggttcatccatgtgtttgggatggacaatttctcctctctgtcctattacacgattgagcccagaactgctttggacattcaatttgtggtggtgttgcgtctattagttatgtagcacagaagctggtcttaaatctgcccgtagaaataagtgaaataggtgaaaatttaatacatgtaaaacaagtaattataaaattatctctcaatatcagcattacacttttcactgaaagaggcatgtctatgaacatgtcaccgacattcccttgttctggggcacactttccagccttccagttattgctggagtttttacaacagatatagcatgattattgtgtaaatattactagttacagtagtagttagctattgcacaaatattacttcttctatatctggaccctcttcttgcatagactttaataacttattagtgatgaagttctggttgaatgtggttcctcacttcctcctgttggtgtgctactgacttcatcaactgatacaagtttctgcaccacacattccatggtaggtcttctgactctatcttcttcaaggcatgaaacagccaattccatcatcattcttgcttgtgcgctgttgaattggccattcaatcgggtgtcaatgaagtcggcaatccaaaactgatcgtcgccatctgacttaagttgctctgagcatagcctgattacccttcccagggccattttcacgtcctcatcatcattcttttccaattctgaaacacgagctcccttcagcaattcgaggagcacgactccgaagctgtacacatctaccttcgctgttattggcagactgtaaacccattcaggtgccaaataacctcttgttcctcggatccgtgatatgtctatgttagatccatctctgttcaggagctttgcaaggccaaagtcggcgatcttcggctccatattctcgcccaacaatatattttcaggtttcatgtcgcagtggatgacccactcagaacattcatgatgaagatatgccaatccttttgccaccccaagagcaatattgaatctttgtgtccatccaagtaagttctgtgagcccccactgccaaacaagattttgtccaacgaaccattctccacaaattctgaaaccaatatcctgtgtggaccgtcagaacagaatccccaaaccctcactagatttgtatggtaaatcctgctaatcacactcaattcatgctggaattcttcttcaccttcgtttacgtctaccaactttttcacggccactaccctattgtctttcaagactcccttgtatacgacgcctgatgctccccttccaagctcatccttaaattttctagtggccaacaccaactctctgtaggtgtacctgcgaaaatggttagctatcatttcatatccggcctcagctggccatactcctctgagttgtttggcctccctcctcaaaataaaccatcctaataaaacaaataatacctccgccagaaatatcgctgataagaacccgtagaaatacaaaaacttgatatgctctgcccactattaagtgtatccaaaaaatctgctatggaaatgttgtttgttgtattacagttagggccatatttaggaccaagaggctgtgaatggggaaatgaggaccttgacacatttactccctcaggaagcttgagatacatggtaccagtgctgccaaagttacttagtgttacaccaccaagaagaacagactttggatagcaatcaccagttccttcccagtaggcgaaacccttacacctgcagtctttcaagcatatgttcttgcagaatccaagaggaacaaaacgataaacactcagatcataccccaagaaatcagtattgcggagtgcaacaaatttcaccttctgtccatcacaactgaggttgacctttgggctgcaacctttgctccggtcacttgggtcgatgatctcgtaaccaggggcacaagcacaggcaggaacaggtgtatacacacatattccattctgaccgcacaaaccgcgtactttgcagagctgaggaaatgccatccatgtcactgaccatgttctgtctaccttatcaagactgtacagcctgagattgccatcataatccagtgttagtctcctcactgtgccaggaccccaatcagcagctatgaatgttgcattatcacttccaaggaaatgtccccagctgtcaagaaccccatttgtggtgctgttgaatggacttcttagctttgcccaaatagtcatactagggtttggccagtagataaaagatatgttcttctcatcatcaaacagtgaaagtaagtactgatcatcgaaacggaaactgtaatggccaggaacaagtaacctatttgtagacacaagctttgtagcagcagtgatgctctgagtgggtaacaatgtatcagtaggagaatcaaagctttgccacagagtgttaccactttcgcccttcacaacgaggttcccggtgtccaagagctgagcttgagcatactgggtatctgaagagctaacgttgttagcccacacaatctggccagcataatctttcaaaaacatgccaccatcgaatttcaactcaactttggatccccaggtgtacacagggtggagaggatttgcgctccagacgacggggttttcggtcaagttggagaaccagatagagaaggtggaggcattgggggagattttgtagaagccacaggtgaaagtgccatccggtgaatggagcacatcctgtacagacagggaggagcctggcttgaggaaatcttgagctgagatgcacaaaagtgggtggatcagagtgaagaggagcagagaggcagagcttgcaaccatttttggtggagctgcagctttggagttgatctttcaagagttattaagaagccactggctagtggccgctaatggagtgagcatcttggaactgcaggtttgaactttagtggaagacaggggcgaagctatagccatctatcggggtccactgaccccgacgatttcttgtgtacgtttcttactccacttaattttaccgtgtatgaccccggtcgataaaaacactagaccccggtaaccatgatttgttatagcctgattaattagcaacttgaaacgacacgtttgagattagcaagcaacaaataggaattagctagcgctaatgattatacgtcagcccaaaggcccaatatacattttggtaatcttagcagtgagtatttgtgcatttaatgtctactttgtttacatattaattatgtccggtttttaatacttcctccgtttcaggttataagactttctagaattgatcacatttatatagatattaatgaatctatacataatatgtagattcattaatatctatatgaatatgggcaatgctagaaagtcttataccctgaaacggaggtagtataatttatagacatgtccgtgcgttgcaacaatctcctatgggccaatggttgctcgtagcattatttaggatatggattttcatccctcgaggggatatcccctcattgtttgcatgtcatctaaatagttataaaaaaattgacaacataggttgataaggaatatatcactctacaaacatgcaaaatcaaatttgacttctacaagttacaataaaaaaataaactgaaaatagttatcgtacattcgcatttatatttgttatttttgtttcaatttgtagaagttaaattttaacttgcatatttgtggagtgatatatttcgtattaatctagctatttagatgagatgaacgaaacgagggatatcccctcgagggatgaaattactttccccgttatttagttttctgttgggtctggtttttccccgtattttttctttcagggtggatgataaattctgtttttatgtagtagagataaataggcaagcaaagtattatggagcgattcttgaaaaaaaaacccccccgctattttagaagatctaacaatgtatcatacactaaattagtattgaccccgtcgaccatttatcctggcttcgcccctggtggaagatgcagccattgaacaagtatgcatatgttttgcttaaagtcagggtgtgggtcgtgttactgtcggatgatcagttgattattggaaccacttgtgcttcatagagcactaaatcaatgggggaaaatatttagttattttttgtggtgatgcaatatgtgcaagagagactggtgttgttacttacacccttcgtcccaaaaaaaaaaagtccaattctaagtgtccagatttatctctagaattgggttttttttggacggagggagtaaaccccaatcataaatatttatttactccctccgtcgtaaaatataagttcttttttatggacacagttattaagaaagtatatagaattaaatgtgggaaatgtataattggatgagaagtgaatgtaggtaaaaaaaattgaatggttgagagttgtgattgattaggaagagaatattggcgaaaaagttgttatattttaagataaattctaaacactaaaaattattatattctggaacagaggaagtagattttatgaacttattttaaatttatggtcagtgtttaaatatttctaactggagtgtaatatactgtgtaattagatgttaggggaacgagcgtttgttattgtactagcgttttaaacaaattattcaccgaatcattatcgcggattatatattttattattacaaggataaattaaatattttaaaaataaatttcacagaacagaattttttaagaagtacccagaggtccagagctgctgctgagaggatcccctgtgactcgtcgattcagcgggagagggagtgcagtgttctcagcaggtcaacacgccaggtcatcggtcagccaccaaacatatttttggggggtggagttcaaagatgcgaatggtaagccagctggataattccttgtaataatgtacctaatcctcatccgtattcgcctaactcctgtcgggtgcccccactgaaatgccgcagcagtagatccacacaaacgacactgggatttattccttaatcatgaacttccaacagcagcttcccatatacagcgcatatacaccaccaggccatgcatcttttcgggagaccaaaaatttatgtcacgagacaactctattgcagcttcccatctctcctgtctcagaataatacaaaatgggaggtacataaaaaaggaaaaaggaaaaaacaacgccatgtacgttttaacatgttctatggaagttgaggagctgcaacaaaatttccaaacaaagaatggggggtacagcttggctcgaggagggaacccattttctaaggacgaagatctacataaaaccagacgcagcagagaggaacatcaacagcgggagttaaaaaaaaaaagatcaacgccacgattacaaaaagtagtcgggggtcttgcgcgttgtgtccggctctatttgtcgtggggctggatcgaactgtaggaagttctgatccatgttctccccgatttctagaattgctgccatgttaccacagcggtaacagtagtttggggcgctgaacaccgtgacaacgttcttgtcctgcataacaatcattgtcattaagtatcaagctttttgttagaattttccaatttggtgctcaagtgcaggtcactgatggtaaggtaaggttctatgtacatgctcctatgtgatgatacatgaaaaccaaacatatagtaataatactaggatcaacaacaaaccacataccatacatccaaaccaagaaaagttctgctcatcttatagaactgtatcaagcgttgcattctttatgtccgccatagattgtaaatatgttatgcctcctagataataatcagcaatcactatacagcataaactatgtgggggaagggccgaaggggttgtcattgtttaacagatcactgaagggttgaacaagctactaaaacttatataatgcgaagttcaggtaccataacatcataatgattactagattcagcaatcagcatcagcatgcaactatgagtctataacttagctaaagcaccagaaattattatgaataccaaaatggattagcctaacatagtaagaccaataataattatgtgaacagggctctcagagtgggacgaatgaaaacaagcaaatggaacattttataccaacctggcaccaattgaagccttccatcacaagttgatgggcccttgaaataagggtaaggccattagtatggttgaattgttgtgcaatatcttgcccaaacgtgtatcctgcccctcttggagaaattccccacccacatcgatcgtccgggtcagaccacaaaagatcacacatgggcccttcatgagggacctataaccattaaagagaacagggtgcataagtcaaaacatatgatttccataaactataaattatcaagacaaaaaagtgtgcaaatacagcacatatgttctacacaaagacggtcactattacgcacaattgctcaatgagggccacctttagttactagtttaagctatgtacgaacaatggcacgaaccaacaaatttgatatataggcatagcaggtactaacactaaaccagcaagcataatattatttgtgaatggtcatggcgagtgaggtcctgtttagtcttaccaaatgcttggccaacaataaagtaagaaatatctgtaactacttaagcaaattgtacaggaatattgatcttttagtttgtttaatttctgagctcttctcccatatcccattgcatcttgtaaaaaagaacacactatggtacatcagaaaatcgcgtaactggaacctattactccctccaggttgataatagttgtcgttctagacaaggctgatgtcaaactttaaaatctgactatgaataatttccaaaatatctgtctcagaaatatgcagaccatatgtatagattagtcttaaaaagtacttcaatagaatcatatatttgttgatatttctatatatattataatagaaaatagtggtcaaagttgttttttcgagaccatgtactcgtccaaaactacaagtattatcaacctggagggggtatatcaacctttgtatatcatttgatcctcacccagaacattttatgtatattaatataaagttattgtgtgagatcaacatatatgagaagaatgccattcgagccatgcacgtgaaacgatgcagataaattattagagcacaccgaatcatccaatggcaaagaatggtatatgctatcctctaatataggttcaattatttaacactcctggacctgttctcaagctatcatgaatgagcattacctccagttcaaaaggagggtgcctatggactatggagacatggcaagtaaagacgatggtgcaaaatgatgcataattagatcactagctcaaaggtatgggtgaagtgttgcatacctcctgtatgcgatcgagggcacgaatgttatccaatgtatccaatgacggcgagagaccgccatggaggcaaaagacctacaaaatgaaatttttcctcttgtcaggtatgccatatacatggacaagctgagttcaatgtccatattaatagaacaaacatttggcaaaaagagctaacctggttttctacaagagctgtgagaggcaaataatcaaacaagtccgtgaagtacttccaaacatttgcatttccatacttccgtaagcattcgtcatagaagccatacctgtatccaaacactgcatgtcaagaacaccctagcacagtgggtgtgcttgcattttacaaagtagaatgcagcagaagaaattggcaaaagttcatgtcatgacaagaacattataaagtaggattcttgctacatcaatcttcagacccagagcaatcataacttttttactttaagaaagttcatggcagcaagtcagcataaagttgagatctattcatcatattctaggaatttggcttaaacctccagtagatcattggctgccaatacctaaacttctatgtggggttgttagatcagattagggagtcagaagctgggagcccttgtaaattatttctaaataactctgcaactcaaatctcatgcaacgcataacccaacttacaaagtcccaaaacatacttacgcagctaattatttcaaaatataaattgatgatctttattgctaatttgcattatttctttctttaggtttctaaccaaaaaaagtcatgtaatttaccaaactttatgatttataaagcgacatcaacattacatgatctaattcttatgatatcatgctagctaaaaactacagtaccagataccgtgctgagtccaagaaaaataaatgtgttttgttccatgacctcttaatcaagagtggttagcagggatgcctttggccattttggatcaccagttcagataacaaatcaccttttgttgttttctccatgaaatggaatattcagagttcagttggtgtcgtagcctggagcccgagtcaaccaaataagccagcaattggtgattactttccatgccttttaagaacaaggaatttgtttcttaaatgattgtttattgtcattgatatatctgttgaaatgcaaatcgttgtttaaatagactgcctgcataataagcaaccaggttgttttttacgggtgttacgttgcaagaaattattttaactttgtaagtctttctaaaagtttttgctgttgagggttgtcaggctcctacaaagtataacgttttcatagtcatctgcacacataaccactaaaataggcgatccgtgactctgccactgcataattttaacaattcatcaatgtttgaattcctctttataatcaactccagattactattttaactcaatccacaattccatatctaataagatgtagactgagaatagagtgttgaattacatggcatgaatttccataccaagacaagagacagattccttattcagcttataggatttctgacgtttggcatgacaccatacagccattatgttacccctattagagggtattcaaccatatggaagtggagtatcatctatgaaaactagaaacaggatgcaatcctcctgattctaaaatcgaacaagttgactaacaaaatacccaggggataggccatggggtaccaaggaaacaattgaataaccaaatataataatgcctgtgccagaatttgcatcttacagatattatgtggccacagaatctagttcaactaatatgctagttcacctttgcaaggatattgctatgctcaatatcaaaacaatgtatttatataagacaagcttttgaatacaactaatcaaggaagttaaagctactaaggtcacaatgtttttcttgcatgttaactagtattgcaaataaaaaagcgcacaaaccaaaagatatcgagacaatgtaatcgtgatcttccaacagaaaaaaaaaaactgttactctaattcatgcccaacaaaaatatattctttgtctaaggaggcagaaaagatcaatttcaagcataatcatttggtaagatttgcagcatggtcatatatgttttgcaaaaaattgcaatatagagatactgtgctgaaaattggcaattggcaactattgaagacagttcagagtttttttcatatcagaggaatagaaactcacacttgggtgatttgtctgctctcgtgatttcctctcaatattgtgattctgtctctataacggactttaagagccactagtaatgtaacagtctccactgaatagtaaccacggtctgcagcaagcgacaacaaaatcaattcaactacaaatagaagaaacaaataaacacaatacaggaaaaagtaattgtgatagaaaaaaggcatatcattcaactgcttatctgaaaaggcattccgtacaaattgtctaatccttaactgaatggtgccctgtttgtccgacatgttgtattgcatacagatttcagatcaatacacatcatgagcatgcaatgaatacacatagacaaccatagtcatgatgacctcaagtttaagaatgcttgacatgtacgattaccaaaaccaacacggcagcagtgtagcggaaccaagcgacaagatccttgtatgttagtgtaccggtggcaacaagctatacatgccatttatgttgaaagtacatgcaagctctccgtttccatgcaaccttgaaacatttaaaatgaagcaaaccaaaaccttggctaacagacatctcatcagttccctaagacagtaagactccatataatccaaggaataaacactccaaagcccaaggacgttcatcccatcaagaaaaaaaaaatccaacatgcctaatatgtccaatagcaataaatactcacataaatttctacttgattaatatacctaatccagacgaacaacataagaaaggctagcatcaaaattctagcgatccatgggacaacataacaagaacatgatcatcaattcagcacattaatcagaccaaagcactgcctcaaagctcccaaatccgaacacctcagcacctcaacactgcatcaggatctaacgaattcatcccctacctcacacggccccatttataccagatcgattggtcgaaccaccacaccaaacccgcagatcggcccaaaaggggaacacacgcgtccgaggccggaggagaagagagagagagaggggtagcgagctagaaacttaccgacgtagtcacccatgaagaggtagttggtgtcgggggagtccccgccgatgcggaagagctcgatgaggtcgtagaactggccgtggatgtcgccgcagacggtgacggggcaccgcaccggctgcacgttccactcctccatgaggatcgccttcgcctgctcgcacagcgccctcacctccgcctcccccaggaacttgcactcccgcagctgcgagatctgccggtccagatccgcgtgcgacggcatcgtcgcctcccccctccccacctccccctcctcctcctccctcctcaccagggcgccgccgcaggggaggtggcggtggggggcgcggtcgctagggtttgcgggggatcgggggaggtggcgatgcaggaggaggtgctcatgccgccatctctctctctctctttcttctgcgaccgcgtggttgctcgcgtcgcctgtataggatgggggaaggaaaattgtttttttttttagggtgtttgttttggttttggctttgatgggggtttggtgatttggattggggcgaaaagtataaataaatttttgcgagttgtttaattaattcggggggaaaggtggatgggggagtgctttccaggtgtgtagagattagagaaagacaggatgtttcgtggagggatgtctgcgggtgcttttcgtatacaattgctcaattagcagggttggttggttacattaaatttaaattttatattgattttaatgttttattaaaaaaattttatttacttttaaatcgttaaaaacatagttttacacaatatttttattcgcaattttttctaatacatcgtgtcacatactatcagtatatagtcaactaatgggaccatatgttctaattgtagcttacggcatctgtatatctttcgaaagaaatttaaggttcagattggtataatataatgatgtgatttgtgggagataaaaatatatgtcatatgccactatatttgttgtgttataaatctctggctataattagtgattggaaattagccatgagtcatggcatatggcttgtctagttttcactcatttgtccaattgtgcattgttcaccaggaatgattgtaggaaaatagtttgtggctttgaatatattgcctgatcattaggatatatttaatagcatacttgcattaagaactagattgaggcacatcaatttatcattttggttcaa

SEQ ID NO: 56333 - DNA, 833 bp, Oryza sativa
aataatctttctttatgggagctcaaacacatgtttaggtgtgatgccttttctcagattttggattattgccataattattgcgcaactaatcaattttactacaaagtacaaatagttgttgtttattggtggagtcaacatgtaaacaaggaaattgcggtatcaaataggcatttctagttttatcatgtacaacaacatgagcttcatcctcaacatagtcactatgtgaaaataaggcctgatataaaactgtcgttggggagggtttggggatccccgtgcttactgttgatgaaaaatccgcgcttggctgatggtgctagaactgtattggcgcgaactaagtcgacgaacacaacggcctgagagatctgcttagctccagtgcaagtccaaaggttcatgagatacgagcgtgctagccagtttgatcctgcaactgacaagatatacaaatagcagatcaatgagccgatcggctgataagccgatggagtaattccagccgatgccgataccagccgatagcaataggattttgagctatcggctatatgtttaatgtagaatatgacacttgatgtaaataatgatataaagacaatcggttgatgatgatgtaataaaataataatataacagtattccctctattacagattataaggcattttgtcccatcatgattttttttcctttgtcctattctgattaaatcacgtccgatatctttattccaaaactaccgtcctgattaagataggagccaaaacatctcttgcctaccgcaagaccctatcttgcatcttcccaactcgtgtttgtgt

SEQ ID NO: 56334 - DNA, 2334 bp, Oryza sativa
ttaatagtcaatctgtgcctggacacaacaaatacattgcacgaacatggcatagctttcaggacagtagagggcacatctcggagccgtaatatcctgaaaaaggtaacagcaataccatttaacaacaacagtggatttggcaaaagtggccagaaatcgatttacatttacagagatgctcattaattttgcttatgagtttaaagttgacaaataatgaagataaaaatcccccgcattaaccagctaaagtgactaatctatttatcagcatcatgaagacaaactgatgttagttgcgctggctcttaccaatatctgtggcttcctgggtcctaattactcaaaaggcataaatgcgagaaaaaaagaaacgaatgtcaacagaaaaaggaaagtttaatcaagatatatgtacgtgcacacacctatcacctttactcagaacaagtgacaccatcccaaaaaggggctcaatcttcccttttttttttctgaaaaactttttgtcccatatacacagcatatctagtatgcactttccagttatttttatactttggggggaataaagctatacaggtaagaacaaaaatcccccttatccctatcaatctatcattggtagttgaattctcaaaagcgaaattctaacctttactagtagttgggaaaggagatttgtcacccaaaataaagtgaagaggattatatttttcaaaaaaaaaacaattaatctagtataccttttgaaccagttgagggaggtggatccaaccacgaggttgcggacgccggagtccgccgcgtacctgaccagcgccgccgtgacgctcggctcctccagaatcaccgtctccacctgcaggggaggaggaggaggagggggagctcgaattttgaggcgcggatcgagcaaaatcggcggagattttcgaggaggaggaggaggagacttacggttgtgcgggcgaagaggcggcgcagggggaggaagacctcctcctgcgcacgcgcgcggcggtcctccgcgtacatctccaccgtctccgcgtccatcttctccaccggcaccctctcccccgctgcgcgcgccacgcagagaaaaacccatcagctcgaaccgaatcgacgacggcgacgacgaggaggaggaggaaggaggaggagagggcttacagggggaggggacgaaggagacgggggggatgacgtggacgagcgcgacgcgcccggccccggcgccgtgggcggcgaggttggcggccgcccacctcgccgcgcggcggctggcgcgcccgtccccgcgcaccgccaccgccacgacgatcgcgcccgccgccgcagcagcagaggcagaagcagaagcagaagcagcgtcgcctccacccgaggaggaggcgagcgacgacgaggaggaggaggaagacgaggccatatgctcttcgtcggcggcgccaaccactcgacggcggcggaggcggaggtgggtggcgaggggggagggggggaaggggagcgagtcaaccgcgacgaaataaataaaccgcgggggaagggaagcaagcgaggcaacggcttcgcgcagtttcttcgggtgggacgaggacgagtcgagtgataaactaacgctcttttttttttttttcgcgcgcgaggcgggggcggctcaacggctgtgtgggggtgggcccacacgtgtgggacccacactcttgttgttgtttgactgtggcggcgaagtcgctggctcgctgctcactggaactggaatgtttaaccacgtgtggatatatgatgcttttattatccatcaggcccgccagatttttctggctaggctgatataaacagataggaggagatgggagaagaacgactctgtgtgtttaaagtagtaaagaaataaaaatgatagtattaggaagaggctagtaaggcctttaaaatgaagattttttttataaatttcatgagaattgaaatagtttatgtatgaaaacctggtgaaattttcacattcaaaaagaactttcataaggcatgtcaaaaggtcacacttgattttcgatgcatcctactctagttactctagttagattctcggcgtagctcgaagcgggaagatgatcacgaacagcatgagggtgtagggatggcagcgatcaaaaacgacaattgactacaattgagctatgttccccatgctgcttgtacacattgacagagatggactgattcggctattcacatacgtggacaagtttgagtgagcagtcatttacaacaaattaacctttgggggtttgaaaacaagagtgacaattgagg

SEQ ID NO: 56335 - DNA, 4935 bp, Oryza sativa
ataagtctttctagcattacccatatttatatagatattaatgaatctagacatatatgtatatatagattcattaacatttatatgaatgtgagccatgctagaaagtcttacattataaaacagatagagtagtttatatgaaaatctcataattaaaattataacattcaaaaatgcctaaaatataagttgctaatacagagcaaaacttcatatttattgaaagcatagccttacacttgactaacagaaaagatatcttcatcctttaagagaaaaaagagagatccatgttgtaaacaggtgttagtgtgtggatatatacataaggaaaacagtccaaacaaccactaaacttttgatggaagtacatcaagcacctttaacattaaaaccagacatctaacgcactaaacttaaaaataccgttcatactgtcagggttaccgataagacataccctctctcctagaaatcatgaaatatacggatacgatatatcctcaagtatacggaaaggactcgtatttaagataaggaaatcaatgagtccgtatggaaatattctttaagggtggaaagtattagagtactacttagagaggataaggagtgtgtcatattgtacgaggtccgacgtctccgagttctattgggagacaaaggtgatatgaggtacaaatgcatacccccaggaagatacaaggcatcgaatcttagtgcaagacacccgccatcatagacgcaatccggacgacttgaagcctattcaccaatgatctcgtcagtaatctcggagttcaattgttctcttttgtaccacaatgttttcttctataataccatataaactggattagggctattaccttacagaggagcctatcgtgtagattctcgtaccaacgtacctcaataccctcagattataatccgtggtatctcccgtcggcacatattatcctgagatagttttgattggtggtttgtgtatttgaaagcttaaatgggtggctttgaataactaatataatgtttttatatataatcaacggtactcccttcgccccaaaaatataagcacttataatgttcaaattttatcccaaaatataacaacttatagcgtaaaaatttatcctaaaatataacaatttttccaccaacattctcttcagcattcaaattttccagcatcataaccttccaccattcaattttcctcactgcctcttctcaaccaatcacaagaatcctaatcctacctacttctttctaagtgagagtgaacatgaggtaaaaagaaatatttaagtgaagattttaacacatatatccaatgcctatgtcatgtgatgtgatcaaactcatctactgtataatacaaattagaaaaaaaaaatactatgcaaagctatattagagggctatataaatggtattgtaaagtttaaggatctaaatgtccggttttaaaatgtccggttttaaagtttaggtgataaatgaacttccatcaaagtttaggggtgtatttggactttttctttttagtaaataaaacccatcctaaatttttatcaaactttggatgttggaggtccatctttactttcctcttcccttagcatgtggttaacattagtaatctttctaatggattgaatattatgcatcacataaatgatatatcctatcttttgcacaacgacatttctcatatcaatgatgggaatggctatatgaagtggggattatatactccctccatcccaaaatataatgctcaaccacttttctctcatatctctaatataagacgtgcatgcatacatacattaactagcacctcttggtccaatagaattgatttgtcttaaatcctataccatcaaaccacccaatcacattactcgcatgcatcaaggtgatccaatcaagaaggtgattaaatgttttcttggtttttgtgttatgagtggttgagtcttatattttaagatggagggagtatcaaatatgcttgtctcaacctattacatgcatgtatagtactctatactcaagtaaatttatggggataagatgactagaagcactttatagaccttattatatggtcatgaccaatctagctataaattctcacatggttatacgtgacagcgggtatatatatgaaaagccatatggtaaaaagacagttgatcgaacaagtttgtgtattggtcgttctcgtataaacaacaaagacccccgaaaaccaaacatccgtagtcaagatcggaagcaaaatagtagtgtctcatttccattggaaaaatccacaaagggcttaatttcgatcaatctgcgggcgaatttccccgtgtcgtgtagcgtgtacaaggacattaattctgaaagctatatgcattgaccaatgaattctctctatctgcagttgtcttctcctcatcggaagcttcagaattgaccgctcgatcataccagtgccatgcatgctgcactttgctccgatgtgtgtagggatgaaaatggttcaaatagtattcagtttttggcttttttttccggaaacaaaaacagcgggtctgaatattattttcagaaagtttcgaaaacggaaacaaatttaaaatattttttttcttcttggaaacgagtatggtaatactactatccttttgaaactggaattagtcaaaaactttccggaaacgaatttgaaacagtaagctggttttcaagccgtttttcaccctacccgtgtgcatgtgtgctcattgctctttgtggcagtggcgcatggcagcaaacggccggcaagggaattaggttgtgtttagatccaaaatttgtattcaaacttccaacttttctcatcacatcaacctatcatacacacaaactttcaatcacatcgttttaattttcaaccaaacttacaacttcaccatgaactaaacacagccttaggctacgacgtgtgcaaaggcggcgcagcgcccttgtctcactcgtggtttctgactttgatcttctgatttttttaaaaaaaaaatttgctgactccgttcgtagcttgttcctgctcgtgtgtccccctcttcttcggttcttttttttttcttaaggattgttctttgacatgatcaaattgactgaatatggctggtgttttttttcttttaaatttccccttgacgaacagattgtattttgtctgacagagagcatgtcgcgaaaagatcgatggatttaattattggaagggtatgttctagaaatgcgaaatgaaaactctttttttttcctcatctcggttgctaattaatgacaagtgcggcgatgtacgggctgatctactagtcaatatgaaactctctagtagagtgcagtgcagtcatttggctcaattgtccggtttgagtccaactcgcgatcaaaataactgttccgagtccaacacggtcctagcagtatccagtcggtctcgaatgaaatatgtagttcttttctacgcagtaatataaatatttgtgaaaggagagagtattacgtccctccgtccaacaatataaacatttaaagcatttaaattttattcaagaatgtaagcatttctacactactatttatcctctcccaactaaactcccacctctctctcccaaaaacaaaactcacctatattcatctcttatttaataagttttttttcatcaatctcaattgatgttaaacaacctagaaatatgtttgatggatggattactattgattcgtacatagttagctagctgtctggttggctccatggggttaatggcgacaacgccgaccagtagttaggtatagcttggtttgacgtcaaagtcagtctccatgttgacgcgttgctcaaaacgtagtacgtggtatccgtactagtcgctgctgggtctagctcacggtctactcccgggctggagtagtgaatcatgaattaattaggagtaatcaatcttgtcccgggctcatgattggtcaggactcacaggccatagccataaaaattgggttcatgacattgcattggaggagtagtagtagcataagagatgaaactgcttgtgtttgcagaagaagttggtagtgatcgtccacatggaagttggtgaagaagtacccagccatcttccccgatgcctctcgctgatctacttgccaatttggtcccattctgcttgaactttccaaggtgacaactgtgacgttgatcgatctgtgaagcttcagaccggcgagaaccgagcatagtggagtagtacctatatatggagttatactagtacgtagtacatactacaaatgataatggcagaacttgtttgttttcttttgcaaaattaaaaatggtgtagtggtggcacgcattcattctctagttcgatgtgatcatgtgatgtgaagttacatcacataactctttcatcatctcatgaataaacatgcaaaaaaaactgatgatgcattcaacatatactccgtactatataaacagaatgaaatgagacaggcatgctaacagacgagacgacaatttttcaaaaacaagaaaaagtgttcggtactgcatcaggattaccaccagcgacaccaattgatggttcttgtcctcaaaatgtaatccacaaatccataattctgatggggcgaaatgggccaagcgtccatgtaacagttctagctaggccttcagcatgttgttgtcagttttatttgtagcgccaggtttgtactcgtcaaccgcaactatgattctctagttgtttaatttgtcgttggcacatattatgttatgtacgatcgccaagacttttgcgccttagcgcatgtgaaacgtttttaattgggccatttatcgatcgatcaatcgatgtctttaat

SEQ ID NO: 56336 - DNA, 13925 bp, Oryza sativa
  unsure (1)..(13925): unsure at all n locations
ttcggctttggctcgagggcttttccctgattctttcgttcgctgctcgcggcggcggcgggttcgcaggctgatacatggcgtggaggacggtgctggtgcacgtctcgttggtgcaggagatcgccgggcttcgaaaagctccattgccacaagtctcctcctttcttttttctttcttcagctggatgtccagaatttacctgattatttcatccggttaagatagctgtgcacttgattgcagattaagctactgaacggcctgcagattgtctgatttggttagccgtatgttgattgttgatgttcgttttttagagaatgcacattgcatttgcttggctatttgatgttcatcgaaggggaaatttttctgtttctgggaaattctggtcgtgttcactggggactgattgttgtgtatttgatcagatgattagtgcttagtactgtcagtgatgtaatatgcgtgggaattttggatgttataatgagaaattggaaacaaaaattggaacttgagatacagattcagagatgcacaccaagcttgtaaagtggctgctgccatcccagctgatgtttcttgtaaattgagatagctagtctgtaaacagagtattcagacacagagcttgtaaagtggctgctgccatcccagttgctatttcttgtaaattgagatagctagtctgtaattatatcaaaggaccattgacagttcacaccattgatcttagataagcttagctaatgtgttcatgtgaaataaaaatactaataaaaaaatcaaaggacatattcaggtccatatatcctcctgctttctcaaaaatcaaaggacatgttctgcacagaatgactgcacacatgggctactttctagaaaaagagagaaaaaaaagaaagcctccaattcattctgttcagatcaacaacagcaccaacaatttcagatatcagcaacagcagtaacaccaacaatttcagatatcaacaacagcagcaacagcaacagcagcaacaccaaaaatttcagattagcttagcagcaatttcatatccgcaccctgctgcagcaacaaacaaattcatatcaggtatctgccatggtcctgaaaaggagtaaaaagaatgccactaattagcacacatcaaactagttaggcacatgaagcgattttcatgaaaataaaatataaccaaagtagtttacctgagataattgttagcattatttactgacttagcatcacaccttagttgcaaaggaaggcgaccttgcctttcaagcactcctttttttatgtgtggaagatcataggagttgtcaccgagtacttctatgacttccctcatgcatgcgtgaagagacaagaaaatcctgtttgatagcctcactggataatcttcaaatgctcgatcgatggcggctacaagttcttctgttgttgttgaggctgatttgtactggatggactgaatggagttgaagaaacccagatccaagacattcaaatatggggaatttgccggctggcaaacaagtttgatgttaaagccgtcttgcttcgcggcctcacaaaacattctgtcgtccggtgcaatatgaggccgagcattatcctgctggatgtatataggtttgccagcgtcttcacgaggccacttagcccgaacagctggcaataccttttctatcatgaagcttcggattacctcctttgtgattgactcaatgggcttcatctcgattgtccctgcaggacggttcacacttgacctctttgcagctgtgtatgtcacaaaaggaaaacatccaattttcatttgagtcaaaccttggtctggcgagagctgttaagatcattatttttgggatgaagtttttgttttgaattgtcctgatgcgacgcgaggcagttggagctgcgtaatatcgcacagtcttcctcgtaatgttgaaccacttctcatctatgaaaatgaaatcaaacagtggtttgaagacaagattgtgaggcacactccttgggtcaagcatttcaatacaccacttcagccgatcaattttgttttggtctgtcaagtggggatccaatgagctagatacacgctttatagcaccctcttttttcattctgtagaccttactcgtgctaacaccaagttgagtagctacatcttgtattgtggtgcggctcaatattgaaatatcttcgagacaggacacatccaccaccttcttctttctgccacacctagatcttccactcgcaacatcaactgaaataccttgatccaaacagcttttgccttttttccatatccgctgtactgtcctgataggcaccgagaatttagctgaaacctccttgctctcatggcccttcaaatatccttttcttgcctttacaagcatggcgtcaaagattgctctccgtttgtcattatcaagcacgacattcttgtgtgtattctcctgaggaactaggatagcatcatcaacatcagaatcgaagaaaggatcaaactgaggctgtacattctcctggccagggtcaacacctatctcctctagagtgactaggacatcatcatcagcatttgaatcgaagggatcaaatccagcctctccattgccttgagcatctatggcagcactgtgatcgaatctagcctctccattgccttgagcatctttggcagcactgtgatcaaatccagcctctccgggatctgtggcagcatatgtatctcccggttccaaatttaaatcaatatccattgttctttgctctcgaccttgacaaattccatgggttgtagcagaaggtgatgttcgttgttgtatagaaggagaccttatccgtatgctaggggacagtaacattctgctcaacggggttctaaagaatggcattgccacgcagggagacttcctttttttgcctcttttccctccaacattggacccatctagtgtaaccctgcaaaaggtgttgcaacgaagttgtcatgaatgcacattttggattataagttgcatcaaatgttaagagtgaaaagcatagtaaggttctgagaaaagataaaagcatccattctgtaagacatctagtactggttgtatagcataactggacagacaaccatgtgatctaacaagaaattatacaataacaagaactccaatttatgaagcaataagataaggaaaagacttatgctaaatgtttgcataaactagaacaaccagcaacagctccctgtaaatagaaatacagtgctatttccttgctctaattaatcgaattttgcacaagcagtagccatgaactgaactatgtgaggttagatgtgaaaattcatttaacctcgcaatagtgagcatctatagagttttcctgaaaataacacattttaggaacacaaaatacatcatcgaaaaaaaatcgaatacgaaccttggagagagagcagttgaggacaaagccgcggcagcgaggcgctcgacacgatcctctgcaccgccgtcgccgacctcctgagccgctttcttccatggtgtgacaaatttgcgacgtctacctaccctgccctcctccttcgtcatgaccaacggcgtccaggaagaacacccggtatcttccatacaaaatcaagaacggacaagaaatgaacaaccaaataaacatggtaaaaaataccagaagacaagaaacacatggtaaacaacaaccgatcaattcaaagaaactactccgtaaaccatacactgttgtccaggaatcagatagaatttatcattttaatttagttctgctggtgtagctcaactatagtgtcagcattacattaggcacaaataatgttcagataatatctactttatccactgatctagctcaactgtggtgtcagcattgcattagtcacagattacctaggtaaaactgctaattacaagtgaaatattggtgccatgatggtcattgtcacactaagcattttattagaagcaaatcgttcctgcaaaatgaagaattatctgcaacacaccttgcaaaaattcagagcaaatctacaagtaatattgcgaataatcaaaagatcaaaagctactgccacatgaacaattcaagatcaaaccttaatcaccacccactaaaaccttattaaaccaacatcaattcatcatcatcatcatcatcatcatcttgaacgtgatcagcatcatctaaacccaatatgctaaacctccaacgagccgccggacttggcagtgccgcagtgtgagtactaccctgaccaaaatctcagtacgccagcttcttgctgggctccggcgatggcgagccggcggcgctgcccagtggtggcaaatcgcaaagaacgccacccgccactacactactctacagcttcggaggagaggatgcgtcggccagatacccctagtagccggagagcggcggcgggatgcggtggccggcgacttcgccggcggcggtgggcgcaggctcgcgaagagacgggagggaggtgagagaaggtgtgggaagaggggaaagagaagggtgtgctcaccggcggggggaagcaggatgccggcgccgctgcccgtgggaaggggaagccgcgacaggggtggtggggaagagcaccgccgtccccgccgtcggccctgccacgacgctcgggatcgggatggggcaccgccgccgtcacgcgtagaagggaaggggaatgaatcagtgaagaggaagggcaaaagggtaaattcacgtcaaccttaatctcgcgaagctgtcggaaacgacaaacaaaacgaaacggagggagtatataaatgtgggcaatactagaaagttttataacctgaaacggaggtagtataaattaagcaaacttctaaaacgaaatttacgcagttaattatactaccaaaaacgccaccgaaaagacaaagcaatgaaanaacttaagaaacaaatacctcaagaagctaagtatccttggacgtcaccaatgcattttttccagaggaggtaattaataacagttcaagcacataagtattagacagtagtgcattccaagccacaaggcgaattgtggattcaacactccgatgcaagtaattaatgtctccaaatgggaacagctagctgcaaattgctcaataaggctatcgacaaaaagtagtatagctttcatgaatgttgtcttgaaatctgagaaaaatatcgtaatatttttaacataaagcaagcatattatcaaaatatattaaattatagttttaatgaaactaatttggtattatatatagatgttgctaaatttttctataaatttagtcaaactaaaaaagtttgacaaaaaaaagtcaaagctagttataatatgaaacggaggaggtagagcttatatattcttacatgggcctggtttagtttccaacttttccatcacatcaaaactttcttacacacataaacttccaactttttcatcacatcgttccaatttcaatcaaacttttaatttttgcgtgaactaaacacacccataattatacgtgacaggggtatgaaaagctagctatgtgataaaatgtacggtgatggaacatgtatatatgagttctcgtaggcctgtttagatcccacctcaaaattttacaccctatcatatcgaacatttaaacacatacatgaagtattaaatatagggtaaaaaaataactaattgaatagattgcgactaatttgcgagatgaatcttttaagcctaatttctcaatgatttgacaatgtgatgctatattaaacatttgctaatgacagattaattaggcttaataaattcgtctcgcagtttacggattctgtaattagttttttttattagtgcccgaacacctcatgtgacaccccacataatatccgatgtgacacgctaaaattttacacccctgaatctaaaacacactctaaataaataaaaaaggacccccacgaaaccaaacatcgatagtcaagattggaagcaatacagtgaagtattactccctatgtcccaaattataaggcatatatttttttacacggtcttcaatgatatactttgaccattaatttattccatattatgttactaacgaatatgaaattagcattacatgaaagtactttaaaatatgaatctagtgatataacatgcataatacttagcatatatatggttagtgtgattgttagtcaaaagttatcgggtttaatttttcttaaaaagagagcgccctatattttgggatgaagggagtatttcatttcctcgggataaacgagaaaaatccacgaggccccctttccattgatctgcgggcgaatttcccaggtcttctggtaaaaaaaaattcccaggtcttgtactaatgaattctgaaagttacgcttacgcacattgactaatgaatactctctctctctctctctgcgtagttgtcttctccttatgggaagctttagaattagcagtttctaccgcacgttttttttcagactatttaacagtacgttttgtgcaaaaaatttatatataaaagttgctttaaaatacaaatatattcattttcaagtttataataattaaaactaattaattatttactactacatccgtcctatataaattgcacttctatctaatttaggacaaaatagtaggattgaaaaatgactataataatcatatttaatgaacacaaaagatgcacacattctatatatataaaattgattaaaggaagtttgagacaattaaggaaacatttttagattaaaaggaagattgtggaatgaaatgttaggagactatatgaaacatatttagattaatcaatttgctaggtcttacgtgattagaattatagttttttgagacaaagcctgagagcatagttgcagtttatatgggacggaggtaataataggtttcacgttttacgtacgataacttactctttattttcatcggtttcaaacaccacattactagtgccaatgcatgctagctgcttctttttttaaaaaaaaaacaactacatgctgcttttctgcgtgtgtttccttgctctgtgtgtcggtggttcatggcagctgacagccggcaaggcttagctaagacgcgcctgtctcctctcctctctggcgatggcggcatcatcttcaaaccgcccgtatttgagtccgaggcatcatcttcgtctctccttctatctcctaccttcacaagtccagatcactcgtggtttctgacttttttttgttgactccgttcccaacttgttcgtggcttcgtgctcgatcgtactacgtgtcccctctcagcctcttgtgctcttcaattagtttaaaggaaagaaaaaaaaagggttattctccgtgtcaaattgactgctgttttttttttctttcttaacgaacaaattatattgtctgactgacagagaacgtgccgaaaagatcgaccgacgacctaattattgcaagtgtttgttctagaacagccaaactatgttctttttccctctgaaatgcatggctaactggtaaactaaagacaagtgcggtgcggcaatggcgctgctctgctatagttgttcatgctcaaggatactataatcttcctaattgtccatttgaccctgatgacgtgcatttatccggtttgagtccaactcgcgatcaaaacaaatggtggtccctgatagcggtcggtctcgcttgaaatagttcttttcacgcagtatcagacgagaagaacagaacaagtcatgtgtgctcacatttcttaatctcatgataaatgtaaaattaaggatgtttttcttcttggcacagcacacgtacgtaaactcatgtctcatcaagatgatcaggggcggtcctggcggagataagtgtggggcaactaactatagaaataactatagatgccgattgggaaacccttatatgtgccggttttctcaatcgacatctattggtcggcacttttgtgattagaaaaaaagggctcgatgcatcggctcgaaattaagccgatgcaccgagccaactctccatcatcatcatcatcgtcacaaatcaacatcatcccatcaactaaacacaatcaatatcatccaaacacaatcgcaaaaaatgtccaaacacaatcacaaaaagattacaatcacggtaatcccacggcctcccatcgtcgcgtcgtggcggagaggaggccgcacccaccgtggcggagaggacagtgataaccgaagatctaggttgccccccaagtatttaatgggacgacgttggtttgtaagggtctgtttggttgctacccgaaaaagttgtgcttctggatgtacggatttaggatttatttgactcttccattgcgttctctcttttttttttcatgctttttctttcaagatttcaatcctcgtaatgtacgcaagatttgtgcttgtgcatgggaggttagagtaatagatggatcttagttggatcttgtgccaacgtcccattaatacttcatttagttgtataatgatcaaaggcataattgcgggcttaattattcactttatagccaattttatctttttaaaatttggcattgccaaaattttagcaaattagcaacattagtaagttttgataaaattggctaaatatgagatatgaccaatatttaataacaaactaaacgccaccatatatttatcaatttaccaaacaataatatggtttaaaatattgtttaaaatggtattaatctgaacagacggccatgcatatttgttgctcaggcagcaataaccaaccaaacaagcacatactcaggctgcctgaccaggctagatgcattgtcttctcatatgccactcaggcacacagaaatttcaggcatgttgctcagggtagcaagcaaacaactcgtaaagctccagggcaaacagctcgtaaagctccagggcagactggcagtgacagccggagatacatgcggcaagtgataacggcaatttatttcttttcttttgcaaagaaacaggtatagtgctggcacgtatccatgctttgatagttctacgtaacttgcatcacataactcgttcctctcatgaataaacttgtacagaaaaacgtatgatgcattctgctaccgatgtatgcaagttagcatgtataattctttttagataatgagttagcatgtatatacaaacagaatgaaatgagatgggcatgctaacagataaacaccatgaataaatgtcttctttcaagaacacaagagagggagaaaatgttggatactggagcataaggttggagttagcatctctgtaacaccagtctgtttcattgtcctttaaaatgtaacccacaagccacaaccgggagcactcctacacacactgatgttttcctttggttggtttgtaatgcaaagtaaactcgaacaatgcaactattctctagccatttgtcattgacacatgttactatttacaatcaccaaaaaaattgctccttctctgagtgcatgtgaaatgcttttggggccatttatctatcaattgatgtcttcagtctccgaacctcagctaaaagagaagaattcatctcacaagcatccttcatgatttcaaatcgtcggctaacttcatcattacgttgtgaatcttgcgcaatgccttgtagaacaaaacccttgagcatatcctgcggtatagaattttccaaacatcaaggatggttcatgatttatgaaatatatgactaatattccggaaagcacgagggaattacctcgtgatggcgcttctggccatagcaccggataagcgatttaaccagcttattccgcactttgccagaaccgctgcactggaagacgaagccagaaaggtgatgccttgctactgtgaaagacattgcatcccgctgaaaagctttgtcaagggcaccagaagtccatgatttagcataagactccaaaattccttcgtcatcctacaaaattattgtgaaaataataatcagaaaatctgaaactgttttatcacacagatgcaacaaagtacaagcaggtgggaacatgcttacaaagaatcatggcatgtgctcatgtatgtaccgaaatcaaatagttaagaaaaatagcatgcattgtttactctttgcatactctatgtaatgtgcaaccccaaaagcagtagtataaagcaaacttctagacccaaatttacattgttactacaaaatgccaaccaaaagacaagcatacaagaaactaaagagacaatacctcaagaggctccaagtacccttgaacatcaccgacgcatttgtctagtggaggtaacagttcaagcacataagcattagacagagcgttccaggccgcaagccgaattgtgggttcaacactccggtgcaaataaatggctacttgtcgaccaaaaagagcatcaccatatgagacagctgcaaattgctcaataaggctctcaacaaaagtagtatagtttgcatggattttctcctgaaatctgagaacttcagtcctggtcaccttttcttcgtcccagaggctgatccttctttcttgacagagtgagcactgtcatatttctggcataatctatccaaatgcaggccatacagttcttgcaaagcatgaaaaatatccctacttctgtcttctagaagcaaatccatgctactgcggatagaggcagaaagtgcatgcatcttccaaaccaaaggagcatgaagacatggagccgctgaaatggcttccagacctaaaagaaagaagagaccagcttttgaaacatcaacagcataactggttgataggttggcttttggatcatcaatgcaacagactgcacttagaatccagtgcacaggaaggggcaatctctggtgtgcccactctacagctaacacactgcaaggtggatttacagcttctgctaactctgtttcttcttgaatcgtctccaatgtctctggtatttttggcacatttgtgccattgttatttcttgtaaattcatctgaatgcttcttcttgatgaccaaccatctggatctgaaatgtgaattcagtacactgctaaaatggagatactcatcttcagttatgtcccattcaaaagcttttgctaatttcatgtgtgagtctagtactgaagatttgagaaacttcagaacagaagggtggaagaggatatcaaaggctttctctagtgtagatatctgcccaggtcctgccatcaaagatacactgaggacagaactgattctctctgaagtgatggcaactgaatcagtcacattatttccttcttgcacaattggattcacacttttattgacggtgacaaggccttctggccccgtggacaagattttcatcaattctagaacaaaatgtgaatccaattgtgcaagaaggaaattcaaagaccaaaatcctccaccatatgctccccaaccaaaaccaacaccaggtgctggtcctcctctaccaaacatctctatgttttgtaatatggaccactgtgaggaaatcattggcaacaatgaagttagcatgtccaacaagttattacgccagaaattgcaaataccttgttctagtatcctgccagctatccctgtttttgattctttcagatgctctgtacaatttgttgtggcgttctggattactctgtcaatagagcaagatagctgcaataacctttggaagcaactaattgaacacaatgatgtgtcaacattaccctgggatctcaaatgaaaaagtccctgcaccaacgatgaaccatggaaagatgtatgttgctcaagttcaacggcattatcatccaagaagttgaaaaatccattagtaataactcccaggccaattttgggtacaaagtcaggtatccaaggcaagcagtaacttttaccatcatgtgtactatctggagatatcctttctagtattgaatcaagcatgcctagcacagaagaaataaccaaagcaaagtagcttccctctagtatattcttactttgcccactgattagcaaacacacataaggaatatcattcaggcatagccaagatagcgccaaatctaccattggaactgcatggctccacgaccatgtctcaacttggataccagaaagtcccatgtcttgcttgttaagctgctcaactgaatgaagaagtggaagcctttgagccagagctcctaatacaagataactctctgttgcaatggaaataaattcagctacaacatgctttcacttagcttctgaaacatcgaagggctaagccacaggcataaaataggaaagaaatctgtgaaatgcgttatacaaaacccgtaagagatacaggtcctccaaaaccgcagctgctcaaccattaatgctgaagtaagcttgcagtgctcctttccagatcttatccaatcctcaagagtataggcttttctgtaccagtgccacatagcctgatgaaaaactccagtgttcacaaaattgaagcatgtttgcctgttgtacttggacaaaacctaggcaaaaggaacaagaaattagatgctagtgaaaaaaaaatctttgacaaatttagaaatagaagtaatgattttttttagcataatctgaacattcaaatcttatgactatggtgtttctcatcttaccataataatgaattaatggggcaactaaagtgcccgcaggagggggggggaccaaacagttgtgtgttgacagtgaaggcattgtgcaaggagtgtgattgattcagataacagcaggcatggctaatacaattgctatgtgttaagatatcagaagcagcaaacaaaaaaaaaactcataatgatgctgttggtagctaattaccaacaaaaggaaaccatttcagatgtacaatcagcaattgcaagtggtattactggcagacttgatctagttatccttcagaaggaatccttctgaaggataactagatcaagttattatcaaccaatgatatagaagaaaaactatataataaataatctgcaacttccaaaactacacaaaatcagcatactcctataataaaagattatttatatcaccagaagataccttcaagagattgactcctttaatttgcgaggagtgaatttccattgatccttgcttgactaacaacttaacaacactttgaacgagccttgggcagttcaagatagcatcagcagattgtggagagtgtctcgctaatcccaaaagaattgaaacaagattatcttctagaattggatgtgggtccatctgaatcaacaaaaacttgaccattaagatccgtaatcatgaccatcactttctcgtagaataggaaatgaaaacataaataaaaagaagaccaactagctcaaatgatgtttactagtgaagtaatagaactgcaatataaagctatcactataaaacaaacagtcaacaagcaagagcaccaagggtgaacagaacaatctacgagacagtccaataaccagataagaagtttgaaagattacgggtatcagatgacatgacatcatagaactacaaaatacttaaaactgcaaatggataaggcccatagcttcaggaaataaaaaatattgctaaaaatgaaaggctatacacaatttatcatagtttggttgttgaatatcaaaattgtaattttccgatggtaaaagaacaatcaaagccagccacaaattctgctgcaaaccagatttcctggtgaaaacaagtgatgtgtcaaccaggtaaggaggcatttcactgcca

SEQ ID NO: 56337 - DNA, 818 bp, Oryza sativa
gtgcaggcgaggacaccagtcggcggcgacgaaggcaagccggtcggtgaagacgtagacgcccaactacggcggcataaaggccagccgtgcaagcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcatagaggccagccgtgcaggcggaaacaccagtcggcggcggcgaaggcaagccggtcggtgaagacgtagacgcccaacaacggcggcataaaggccagccgtgcaggcgaggacatcggtcggcggcgacgaaggcaagccggtcggtaaagacgtagacgcccaacaacggcggcataataggccagccgtgcaggcggaaacaccagtcggcggcagtcgaggcggccggtcggtgaagacgtagacgcccaacaacggcggcataataagtcagccgtgcaggcggaagcaccagccggcggcagacgaggcagccggtcggtgaagacgtagacgcccaacaacggcggcataaaggccagccgtgcaggcggaaacaccagtcggcggcggtcgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataataggccagccgtgcaggcggaaacacc

SEQ ID NO: 56338 - DNA, 770 bp, Oryza sativa
tcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtcgtcgccgggagtggaggtaggtgtgggctgtcccatcggagtgtcattcggacagcaaccataccaatctccgtccataaagagaagaaaagtccagtttggaaaggggaggggtgcatgtggtatccccttgaagtataaaaggaggaccttgcccatagagagggggttgggtggattcttttccagatttagagcttagaacggggggggggggagttggctcacactttgtagctcattcatacacaaatccacaaaaacacaatcgggtcacccataaccctcggtcaccacgttcccggcctggccagtctcgacatgcggatctccccaggcactagccccgacccgcgcttttcgaggactgggacttgggcacgggcccttatttcaagctaagacacaaaaagaccacggcacagatcatcctcatctcatatatagcaaaataaaactaatacaaaatttttttcatcatttctcattgcagattaagttaaattgtacaaaaaagaggcatgaaggccttagaagaaagaacaagaaaaaagttaagattggcgggggcctgggggctcattcaaatgcgcccgggtcgccggcctcgttgccaccgtcgtcctc

SEQ ID NO: 56339 - DNA, 730 bp, Oryza sativa
ccagtcggcggcgacggaggcaggccggcggtgaagtcgtagacgcccaacaacggcggcataataggccagccgtgtaggcggaggcaccactcggcggcgacggaggcaggccggcggtgaagatgtaaacgcccagcaacggtggtgtgaccaaccaaccatataggcgaagacaccagtcggcggcgacggaggcaggccggcggtgaagatgtagacgcccaacaacggtggtgtgaccaaccaaccgtataggcgaagacaccagtcggcggcgacggaggcaggccggcggtgaagatatagacgcccaacaacggcggcataataggccagccgtgtagacggaggcaccaatcggcggcgacggaggcaggccggcggtgaagatgtagacgcccaacaacggtggtgtgaccaaccaaccatataggcgaagacaccagtcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagttagagaa

SEQ ID NO: 56340 - DNA, 26825 bp, Oryza sativa
ttgacgacctcatgtcacaaaagagagagagagagagagagagagagagagagacaacgatacaagattctcgaatctagtggttaattagtccacctctaatctgcatgttggtaaatttctgactcatttgctacttggattgtttggttttgctactgaatctagtgggttggaatactgatttttgcacatggaattaccaggacgaagttacacaggtcacagaatacaattactcacggtgttgacaaaaacacctctaattcctactctaatcttgtcgcgtactacttccactgtttcacaatataagttattctagcattttccatattcatattaatgttaatgaatctagacatatatcaatatgaatatgagaaatgctaaaataacttatattataaaacggaggaagtgcgtacagttacagcaaagtgcagaacaacgtttaacatctctgcgtgcacggttgaagaattattacgagtgtgttgcacacaattaagacacaatcagttgaggaggtgttcgttttcttcaatccgtcaaagaaattacaacgaacaacttcgaaatggagacatcaattttacgcagcgaagtacgccgtgccaaagcttttacggttaggcgtcacgattactcaacagggggatctctgatccgccataaagcctctcatgagccgatgagcccgacaactaataaagtcgatttgatgttcataaaacggtgcactgttcccgtaaaaaaaaaacaaccttagaagtcccctcccaggttaagcaaaggatgtgtttagttcacaccaaaaattaaaagtttgattgaaattgaaatgatatgatggaaaagttgaaagtttatttatgtagaaaaattttgatgtaatgaaaaagttaaaagtttgaataaaaaggttagaactaaatttggctttttttttttggactgtccggtgcatggtaatactgtcattcgagagtcctctctgataagcgatggattgtccaatgaactggatagtcacgctactccctcgtctaacttctaactttctatcacatcacatcacatctaaaacttttctacatacataaactcttaattttttttaaactaccaacttttcttaaatttttaacttttttcaggaactaaacacagcctaaaaaataacctagtactcgctccatcccataatataagagattttaccattttgcttgcaccatttgtcctattcaattttttttacaaatataaaaaacaaaaagttatacttaaaatactttggataataaagtaagtaaaaaaataaataataattctaatttttttaaaaaaataagacaaatggctaaacaatacaagtaaaatgtcaaaatcttttatattagagaaaggagggagtactacatatcctagtaaaaacaaatttagatatagagttatcaagatccgttataatagaatatgtcacctcataataataagaagttattttttttaaggactgagggtgtatatcgctagcagtagcaagaaaataaaaaagcagagacgagagaaggagacactagttgactgacgtggccggatgccacgtgtacagagatccggatcaacgtcggccccaccacgtggacggctgctcttcttcttcctttttaccccgcttccttcgtctgggctgtttcttcttcctttgcgctttctctctctccatggagtatgtctgcttgaccatttgctccagatgagatgagattattgtcatctggtctgccttttttccggccctcccggctacaattatcgcggtcgtctcagaagactcggcacgcactcccatgctcaaactccggcttgatccgcgccgcgcggggtggagagtttttttttcctttccttttaacgccttggacttggacctgatcagagagtgctgggcttatcagctcagaagtgagagggaagaagaaactgagttcggctttactccagcttcttagtgaaggcccaaataatgccatcacaagttgatagtttttgataaggaaaaagtatatttggactccctcaactaccgcctggagtatgattcatatcctccaaccataaaaccagatatatcggctcctccaactatcaaaaccagtacaaacaatgtccctcgatggttttcgaggtggttttggctgacgtgacgcctacgtggtgatcttaactcttaaccgagtctttgtcatacgtgacgcttacgtagcattagaataaaaacaaaaataaaaaaatgtgggatccacatgtcattcacataaaaaagtattgtgggaccactgacatgtgggacacacatgtcatcctccctctccttcccttcttcctccccgtctctctcccttatctctttctccggagcggtggcggtggggacaaggcggaggggagcagtggcggtggggagcggcggcgggcaggaggaggaggagaaggcggaacggatgtcggccaaatcaccgatgctgctccatcggaaggacaagaagaggcggccgatggtgttctgcttcaccgcgtgttaacgaccaaatttggtaatatcagcatcggaaaagaggattagatcgaagtggagtagaaggcaaagatcggttcgagaatagagcaagaatcggctgaagtccggatcggctatgaacaggatcggctgggtccgaatcagattgtgtgagccgatacggccgattctgacaatatgactcgatgtacaacatcgggttgagttgatatgcttcaagatgattgccgcacatggatagagtcctgagaaggcaattgtatctattaattaggatattttatgtaaattccttagagatacgtttgggcaaaagtctgccgcaaagacttgtggtatcttatagtttgttagagataagagacgtgtccgatatggacatagtttgtaattttcggatataaatagaccccgaaccccatgtaatcaattaacatacacgttcaacacaatctcggcgcatcgccgccctttttgctttagttttatttcgacgagttcttgatttcgggttgagctgcatcagtttcgatcttcaataagaggtaaaacttgttatgacggcttgcgttctcgggattagtgcttccatctttatgacactctaatcttatttatgtaattcgtcgagttatcatatatcttacataatctttggcaatatcgctatctaacctacaatcggctaacatctatcggtagagggcagccgattagattaaacaccgacgttgacttggattatatgagatatctactgttctataaaacttccagcggcttgattatcaagatattgttctttttttcatacttaatgctgcatcagttgagtttgatctattaagtcgtgcttagaatatcaatctctagcctgccttctggttgccgattagggtagcatcggaatttcagccgattttatctgatttaactatatttactctacatgctttgttgacacgttaaatctgccctttatgttaagatattattgcatctaagtatattcagcttttgtttggtatattctgtttgttttaacatcttaacatagagttgtatcggagtattagccgatacatgctagatctatctgatcggctatgctatgaacatatataatcctgttattaatatatatttcgatctaagtgatttatactgtctcggcatggcgaccgatctatcctaatcacttgatttaagtatatatcgatataagaattatatattgctaatatctacatccgatcgagtagatttagttctttattatctatttacaaccgccgatcgatttacatatgacatcggctcaaagataaatgatatgtcatcggcacctagccgatcgactatcgtttataggtttaaccgcggttttctttgtttctatttcttgttgattgcaggatcaaatcaactggcacgctaacacacccaaaggcgagctttggacctgcactggagttaagcagatctcccaggcctcgtgtttttcaccaacactgtgtgctgcatcctcttctggctgctcgtcatcgccatcagcgtggccgtgctcatcatctttctcatctaccacccgcagtcgcccaagatgcgggtgaccactgccaccctgaacaccgggtatgtcgatgagcttgacctcgtcggtggcgcccgggcactcaacgccgacctcaacgcgccgacctcaccgtcctcgctgccatctacaacccgaacaccaagctccacgtccccaccgccaccgctcccctctgcctcgtccccaccgctacagccgccgctcctttttgtgtgtgaatgacatatggccccgcgtatttttttatttttttttattctaatgccacgtaagtgccacgtaggataaagactcggtcaagactgccatgtcagccaaaaccaccgaagaacattgtttgcaccggttttgatagttggaagagtcgatatacccggttttgtggttggaggacatgaattatactcgggcgatagttgagggagtcaaagtatactttttccttttgataaggccgataaagagaggtcatgggccacggcccatttatgcaggctatctcgtgtgggccttattgtggtccggcttcgtttcattctgcgccaaggagcatcctcgggtatgtttgtctgcaagtagaccggcacgctgctgctactaactgtcatcaaagatggctgttttattctggtgatagttttttttttgttgtagataatagaatttcatttttctaagtcgagtgtcctgcagatcatggcacgggaaagccctttggcgtcttccgcgggcaccacggctttgcctagctcatgtgctctcgtgaccctactaaaataaatgaaactatatatggggatcccaaaccgttcgactagtattattttttttgggtatcacacaatatattactcctactctactagcaattgtttgttttgaaaaatatgaattgcgtctactcctctatccggaacatcgtcgacgtagatgtaacctatttcgatataacgggattgaaactcctatcgatgttgatagtaaatgggaatgggaagaatatatggacggttacgatgtcattgtcctggctgttcatgtctgcgtttacattctctttatgattgatctttgcagtaagggcagtcccaaccctccatctaggattgtgtttatggcattaactacattatcatataggacttttagtttacgtggcactatattaattaagagagagagagagagtgaagagaggaagcaactgggtctcatgtaagacacagcttcaacacaagaacctatgcagtagacactatcaagttttgcattggaagagaataatggctttataatagatgaagaataaatatgattggtagagaagagagatgatatatttattaatggcccactttaagaaaccatgggatgtagagtgtattttctattgtgatgtcttatcgacataggccctgtttagatcctccaaaatggcaaaagttttgccattttgtagcactttttgccattttggatctaaacactagtagcaaaagttggcaatttggcatttggcatttgctagtccatagtagcaaattgtgctaaaaagtgctttgggaccactccctctctctttctctctctcactttagtgctagaatggcaaaactttaacatgcatctaaacaccaactattacttttgcaatgccaaaacttttgccacaaaaacttttgccatttaccatttgctattctaaatggatctaaacaggccgatagtaccatagacactgcttatgtaccctacgggttagactatcctaaatgggggttacgggctccgcaccgcgtgatcaacagcttccgccaatttactgcccctccgggcctacttgtgtgatttattgggagcagcactttgcgttttgtgtgatttgttgggacggatcaagcaagtactacctctgtattttaaaatgtacgacattgttgacttttcgtttaacgtttgaccattcatcttatttaaaaaatttacgtaattattatttattttattgtgacttgattcatcatcaaaatgttatttaagcatgacataaatatttttatattttcaaaaaaaattttaaataaaataaatgatcaaacgttggacaaaaagtcaatagcgtcgtaaattaaaatacggagggagcaggtactcctcgttcagtttgcgagtagatagatcagtgacagcgtgcacaggtgcgtacgtgatgcgtggatgcctcgtcgccgtggccatgtccatgtgctcgcggtcgcggaggaaaatatgccacgtccgtttctgcgttgctgggctgcaggttggcaggcggcggcacgaacgaacgaacgtgcggcgcaccactcgcgcacaccaccccccgcacgtcgcagaagcagatgctgatatgcggatgcccaccggagcagggggggctttttgtggtggttgcgttgcagccgtgcagcccgtgcgatttgggtttggggcgtgcaatcatcatgatgcggcatttagaacggatcagtggatgagggtacggtgatgggagtgcggcggtggttgccgtggcactgccaatgcccaaaagctcgttcattcattttctctaaaccccgatcattatccgcttgtactatcattactgattcaagagcaacagtatggtcctgtttgcaggttctctccgaattagaaactctcccaactaatacagtgtttattccagattctaagaaactatagttgtagaatctaaaaaaataaactaagccataagctataagccataagctagaaaacccagctttttctagatttttataaactggctactaacaaactgtttctcaactgtttgtcagaatattaaactctcctaacagactctatctatatatgttaccatatgctctagcaccaggcagccactatcactgatatgctaatggttagtagtagtaggttttctctcgataatgatgccaatggagttggtagcggcatcagattagtaaattttaccgcggtcacgtgagatgccatgcacgatgaatcgaatccattcccagccagctgacgaggtgtctccgtgtgtgaatcggatggtagaaaaagctttgcaccaccctccaccaccgctagattcgctcacatcgccgccattactgttgccctctccttcccggcgcggccactccgtccgccgccgccgggggcgaacccgaacgcctctccaccgtccgatccgccagccggatcagatccaacacctaccaacctaccttggcaccttctccctctcgtctccttcctcctcacctcgcccactacacctccacctccggagctcacaacacaaatcgatttctcccaaaccccccctaaactccccaccgaatctccaatgcaggtcctgctgctgccgctgctcgtcgcggcggccgtcggcctcgcgcgcgccgccgccaccgacgaccccttcctctccggcggtaagctcactcggatcagtgggaatggtttgctgaaattgagcttgagatggtagtaatggtgatgggtttggttttggttttgtgttcctcctccagcgccggggaaccacagctacaacatcgactgcggcggcgcggcggacttcgtctcggtgttcggccgacggtggctcgccgaccagttcttctccgccggggggcaggcgggcatggtcgcggagccgcaccggttcccgcagccgcaggagcgcacgctccgcttcttcccgccatcgtcggcgggcaagtccagctgctactccctcccgctcccgcccggccgctactacctccgcctcttctccgtctacgacaactacgactccaagctccgcaccccgtccttcgacgtctccgccgccgccacgctcgtcctctccttccgctccccgtggcccgagccggcatcgcgctacggggcatactccgacctcatcttcccctccgccacctcgcccacctccgacatctgcttctactcgctctccaccgatgcccccgtcgtcgcctccatcgaggtcgcgcccgtgcacccgctcgcctacgacggtgccaccaccggcgcggacctcatcctcgtcaactacggccgtctcacctgcgggaacaacctcttcggcccgggcttcaccaacgactctgacgccttctcccgggtctggcagtccgacatcgatttccggaacaatgacctcaactacgacgccattacggccggggggaggaagattttcggcagcaaccagccgcccaactacttccccaccaagctctacacgtcggcgatcaccaccggcggcgatgcctccaacgagatcgagtacctcatgccggtcgacaccaggatgtcctacatggtctggttgcatttcgcggagatcgatgctggcatcggctcagctgggcagagggtgttcgacgttatgcttgccgggaagaacgtgacgaggattgacattttcaagcaagtgggagggttcaccgcgttcaagtggacatacattgtggagaatttgacgagctccaccatgagtgtgaagcttgtgccagtagtaggacggccgatcctgtgcgggcttgagaattatgcaatggtgccacttgagacgaggacagtgccaaatcaaggtgacatggtttgaagattgcgctctcagccgagaaaattggagaccagcaaaaatttcctcttgtacattctctaagcttgttttttattcatcttggcagtggctgcaatgaaggcattgaaggattccctgaaaattccagcaaggatggggtggaatggggatccatgtgcaccaaggacatgggatgcatgggagggagtcacttgcctccgcaaggacaaagggcttgtgatcacccaactgtaagtaccatttcgttgctccagtgcaattggtatccaccaactgtttttgtggggatgtttctacttagatgtgcagtactgatttgataagtttgccatgaagtagctttggcaagtacagccacctttttattttcttcagataattgatagcgttttcctagaaaacaacgatgatagttttttatgatgaccagaaaagaaatgatacatatgtacctcaatttcacagctgaatattactctactagttaccactacctccgtcccaaatacaagggattttgtccttgtattttgggatgttggcagtactacacaactaatctgaccgaaagcttaattgtcatattcaaatcgcagttaaaagtttcttcttaattctgctttggttgttttgagttaccattttttaaaatggtcaaactttagggcctgtaggtttgttgttgcacatttcttgatatcctttatcgcagtaatttatgactgtcagtattattgtgtgaaattggaagcaggggcggagctagcacaaaatgaaggggggttccacttgcttactttactctagtttgaaccaaatttagcttgatacgggtgcctaaatttgaactgacagagtatatatatggtgaaaatggacaaactatagctaaaattttttttcaaccgggttcctgggcacccccctagctctatgtagctccgcccctgattggaagggagtcagtggacttcctttctcgtaaaagctctattgagcaaacacatattatatatttgtgaaaattatctaaaaaaaatcttgtgacattgatatttttgctgctacaaacttataacctgtatgtatgtggtttctatgtcctttacagggatcttgcaagtcaaggactaaaaggttacatcactgatgaaataagtcatctgacagacttggtaagcttgtaagtatcattaaacctactgaaagtcgatttttcagtttgttcattatcttctttgatatttaaagtatctggatatcaacagttggttttgttatcggtatcttttgcactacgggaatatataaaaccttgaattatcaaagttaagtctcaaatagctctatagactggtttgcattgctcaggttaatagcaaataaagttggagtggccactttcctctagaagataaaaagagcaatgtatcaactagtgaagtacttcccggcttgcctatccacattttctgaacattgtggagccaaagacaaagaaattcccttttgcttttctccaacgtagatattttttcatcctgttaatgatacatttgcttcaccaggaacttgagctataattctttgactggaagcttacctccgggcttagggcaaccttcacttgctacattgtgagtatagctttctgttccataacatgcaatctcgtgattcaaattagaaaatatcttcttctttttttttaaaaaaaagaaaaataggcctgggtggccctgctttttatagaaagcaaaattagaaaatttcttgtgttcagatcacagttcaaatgcttgtcatatatacatgatgctgacagaagcaatgatggccactttaagaaataattttgtgaaatcaaccttctttatacatgtatcatttcaaagagaacttatgaaactaggatgatagagcatgagttttattttattatcatggattgatgactcctgagacagcgtctttcatttgaggaataaattttggaaaaggacatgatatgatatgccaaattggaaaattttaactcaagttcaacccaaacatttggaaacagaaagaaaaagtgaaatcgtgtacttttattcatgattttttttattttccaatgcgtggatcgaatttggtttgagatttttgcaaactggtacatgatgtaatcttacatttctaaacagtatctgaaatttttttcatgaccgaaagagtatgtctatggagaatgataacatgttaatatggtaacatcagatattccttcttccttatagacaatgtgttagcagatcctctacgaatttgagtgatggaatgatgcttttcagtttgcagctatcctaatgataccttatgatcttgtagttctggttctcttgtgagtaacctttatgtcttgtttttagggatctgtcatcaaaccagtttactggaggaattcctggcaccataggttcatcaaaattacaaacagcgtaagtacactgtttgacattagcaattgttgtatattctcaaagcaacacaaacatactgattaccatctcttgtacagtttactgaacaacaatcaactcgatgggcaagttccagaaagactttactcgattggcgtacatggtggtgtgatagagtaagatacctttagtattttcacataaacaagatcttcactttctcctgtaaagtttactagtagttagtagtatatccagttgtcagatatctcatacaaagagctattgttctcaggcttagaattgatcggcaggctcctctatttcatcccatgctccctgctgaagtccaccgcttaagattttaggttccactatgtgacttatgttatgttgagtattgtttagatcagtggtagagcctgctactgggctggtcaggcagccgccctggctcttttttttgtgttcttcactgtagatcactgataagcatggaaaaaagttgtcagagcaagaagcagctcttcgctggctgggttcattgttgctggctccgccactggtttaaatttaacaatgccatgtttacaatatgatacactgatgctgagcgatatatctctgaggttaaactgagtaaaagcagggtgttgttagaaacgtgagaagtatgtactaggccttgactaactaaattggagattttgcatctaatggtgcttaatttagcaaattttactttcttattccttgcaagcaaatgactggagttcaaacatgcacactgtgatcagataatagatcaatggtagatatattgtgaaccatgatacttgcattcattttatctctctatttacaaacacccactgttttaacagtttgtcaggtaataaaggcctttgcggggtgcctactttacctgcttgtgcattattttgggagaaaggagggctgaacagaactggtaaaattgcactaggggcctcgcttgggtttgttctacttgtcacactcatagtggtctacatattgtgcatcagaagaggaccgtacgattatgattttgagttcccccaagatttgacttgtgagtataccacatctcaccttcatactgtgggtcaacctcatatatgactttaagattctttagttttgagtgattattgttttccattgtaagttagtggtagccgttcttttcttaaactatacctaaggccattcatatcagttgtcatgtcatttgaaaaaattatcagtgttcctatgttcctattaacgcaagtaacaatgtttcagatatatcaacctagagtttagtatcccttttatgaacaagtaatcactgtttacaaaccaatttcctgtcttcacaaatgtctaccatgtttaaatttgctactttctcatcctacacagcgatatcagcaatctctgcaaaaaggaataggtatcagagggcgaagtctgtaatgcttgccgagatggaggcgcacggcccggacggttattataccaacgggggcgctcactgaattgatgggcaccggaaatggatatcttcacaggttgttgtatttctacttacagagcaaacactcattgacaattgctggcctgaagcaaggacagttgtgacttgtgactcgtgaacacaattcaccagcatcatcaacatgacgtccctgtaacttcagtcaagcatccatggcattattttgcagttacactcacagcttaattacaatgtaaaatatgtgcatgttttatgtgtactataatacgatgaagtggtggtagggtggtagtagtagtttggtaatagtagtaggggtgccttattttttgcagaggctttgctgtctcgtattagctttagctttaggcgtgtgcactccatcagcaatgtaaatggaaccaggttgggtcaggacagattcaggcgttgaaatgcttggggggtaaaagctggtgtactcataggtgtattctttctgtataaaacctgacttcgttggcactgtctgacttcaggagattgaaaacattagctttggatcagagtgttgttagccacttttgattatctgttgcttacttgcgtgtcatccagagtcatagacgactcaaattctcacctgctagtatttcaattgtcttcagaatgtgctctttaaacttaatttttccttctaatcgaaccatttggtctggatttagatacttgcattatatcgaagttgtactgcatgaaaccttaagcaatgatgtaataatatcgagtcatctgtaatgtctgaaaccttatttagactatgcagtttgcagttcatattaaagcccacgtaaaataattctcagcccaacaaaatacaaagaataattctaagcccaacgagcccaactgcgcttcccaactatcaaatctgcaccatccattcctcatcggatgccttcacgccgccacgtagcggagagcaaagcaaaaccctagctagagccacacccagaggtatagattccccaccccgccgcctccacgcattccttcgcccaccaaaaccctagccgcgccgccgccgccgacgaccaggtaaggaaggagatccgccgccggcgccgccatgaagcgcaacccacgcgtgacgagctcccggaggaagtgccgcaaggcgcacttcacggcgccgtcgtccgtccgccgcgtgctcatgtcggcggcgctgtcgtcggagctccgccacaagtacaacgtgcggtccatcccgatccgcaaggacgacgaggtgcaggtggtgagggggagctacaaggggcgcgaggggaaggtggtgcaggtgtaccgccgtcgctgggtcatccacgtcgagcggatcaccagggagaaggtgaacggctccaccgtcaacgtcggcatccacccctccaaggtcgtcgtcaccaagctcaagctcgacaaggaccgcaaggccatcctcgaccgcaaggcgcgcggccgcgccgccgacaaggccaagggcaagttcaccgccgacgacgtcgccgccgccgccgggggtgccgccgccaccggcgcctcgctccaggagatcgattaggctcgtgggtcggatctgctggtgctcctactgttccccccctccttatctagcttttgtttcgctatcaactgcttctgctaggagttcatgctacctgaacactgcttgctgctttatcgttgaaaatgtctccatgagagttttggatccttgatgttgatctatatctacgatgtggctctgtctgggattttgagttatgaagaaatcattataagtctaaatgctcccgttttgtttgtgttgcctagatatactgaatggcatttcatggactgtgttacctagatataccgaatgattctaggttgataagactctggttttctggatgatgtctagtcccttaatttgactctgagtcacgcatctcaggttgtaacacatcatatatgcttagttttactcaagttgagcatttcaggctgtaacaaatcatataggcttagttttactcaagttgagcatttcaggttgtaacaaatcagctaggctcatagtcctacttctaaattgagcatttcaggttataacacatcactgtagtttaattcgacatggtgttgcactatcatactgctttccttagggcaactggcatttcgtttggatcctacgtgaactaggaagtatctggttgagtggatgactgttgattataccttgctatgagtgtatgacttcctctatattatattcctatattgaatcgatttgaaatgatcttattgttggtatgatatgatgcatacggagcatggcgttagtaggctggactggctggtagcatcttgctttcacatgatgttttgttggcaaagttttttctgttgattcatcaaattttctactctactattgagctttgtttgaaactttgaatggttatatagtactagaatgtagttcaccttagctttctagtggtgacccttccaatacggctacgcatatgctctgtttgaattgctcagctaagacatcagggttaccgatgcatgagttgtctttcgatcaatgtggttttcctgtgctttcacggctgtgggagtgaatttcccttatggtccttctattgtcatgttgtagcaacattttcaacatttctgtgttgatgattgtgcgttccacctttatttaccgcgggattcaggcatttggacacactacatagctagagtaccagatagtctatttgttcttatttagcggctgacatgttaaattatgtgaaaggtttcttacacaagcgcatctgtgagggatggcgttttgattcctcaataagctggccctgtttatgaagtaggtgcattgtggatttgtgatacgggtcgcccctcagtctaatttagttgctgttgtgcattatgatggtttctagtatgcgggggttattaatggcaatgtatttccatggaattttagtcgatccctatgtttatgcgtaagcatgaatattgaaccgtatctgtcaatcgaatatttggtttgcatcagttttgaaaacggatgttggtgataaaaacggtcgaggggatggaaaacgagatcatatggctgtgctctttcctgggcatgtctccgaagtccatgaatagaccaaatgggtcagctcgacgccttatctgtggtgcgagcagatcaagtccactttgactccctcaaatataggtgatatcttgaaccactaacaagctgatgtggcgtgttgactattctaatcactattctaatcgactgaatcagaaaacagcgcccagatatcagcatcacttcctctttcttccccatctctattctctcgtctgttgacgtgcatactcgcctactctctcggtcccataaaaaacctagtatcggatgtgacacatctagacatacatatgtccagattcatagtactagaatatgttatatcttattctagattccttttttagggacggagggagtagtcgcttgctccatcgcccatatgttcaggagagcttctggcagctggatattcttttagaagccacagttgccagaagctttttcaaacagtctagatttttatctggattctgagaagttgtaattgtatagaagccaaattttcactcggattttctagattctcaccagctacttctcaaaatcttaagtttcctcaaatagaggtgacgacgttggctcaccacctttgtcggagacctctggagatcagttgcgaacaggatatacgtcgagcaacgccatgccacgcaacaccgccaccttcactagagacctatggagatcgagctcctcgaccttacacaccgttagcctcccctcctccttcctttccgcctcgctctagtgccaatagcgtgggtgcttgaggaggccagtgatagcttggcgaatcacaagcatgtgatgcagatcgcttctgcggttctgcccttggtctagaaattcttgataccccaaatgtccaaacgatttcatggataatcccaaaacagatacagagtgcatccagagcaagcacctcgatcccctatcgcttgcatcggttcttcaccgacgtcgtcgagtcttccttgtcgatgcagcttgacatcgggggagctgggaggttgtcaatgccgctcctgatgagcttccactttggaagggtcggtcttgatgtgttctcgtcgacgtcgacctttgtcgccgccaactccgacctatcccagaagcggtggtgggagcaagaattgcagcaacatcaaatggccgagtacatgtagaagccaaattctaggcatgatgtggatcgtgctagttgcatgagtgccatcgccccgttctttacccacaagtggctcgggcatccatgtcctctccatgggtgctgctgcagaaaagagacgggagaaagaaagagaaaagataggatgaggaagaagaagggacattgacatctcacctcacatgctaacttagtcgcttggactagttaacgagccacgtcagcggaaatgactctcaaaaccgctaaggaagtcaaactacatcggtttaaatagtttgggggttaagatatccggcatttcggttgagagatattaggatgaaatcggttggaaaaaccctctaccattttcatttgcatatttttttctcgaaaacggaatcgaaatagtagacctgaaaacaacaacaatatcattaatatcgttatatcggaaacaggaccatcgaaacagaatctaccaatattggttggaagtcacgacgaacaatataaacaaagttcaacaatacttcaacatcattgaggaaaccgaaattcaacaaagtccacttgccacaccttagggttaactgagttttcccctagccagttcccattactaataggttgcaagcctaccagatctcctttattcatgggcttccgatgggttgggctggctaagccgctgcggagttttttattttttttggaattttgacggaaattattggacaaatacgattaccgataaaatggtcggaaaaacctccatcccattttcggaagatattaccgtttccatttgtgacactgacaattaccgatatcgactgaaacggtcgatgcataccggaaacgataactagatatctcggaaatttccgtatatttttcacccctagattgatacaaatcgcacatgttcgagggaattaaagttgacttattccccgggcagttgctgttgcaattggagacgagggacccaagaagccaggccatgtccgtgtagcgcccatggtttgtgaagacatgacctcaccgatcgattgatactttgggccctcggcgtcgcgttaacagtgagagcatcatatatagcaagaccataattgccaagttgagccgcctacgtacgtctgtgagagttgcagttgtgttgtacaacaactacaagcctctcactgcttcacgtcatgcatcacgggctcattgtaacatcgcctgcctgcctgattttcgcctggctcggtacgtcggcactgcactcctgatcctgaatatgaatgaaacgtccttcaatttccaagctgaagtaaaaacgaccacacgatttttggtttggctgtcagctactgtgctcccctctcgccgccgtgtcattcagacatccacacacccatctcaactggaccccttgtgtcccactcgatcgatatgattcaggtagcctcagccagccagccaatcagccagccgccgtagcgcccaacactgcagatttccactgtgctaccacatgtacgcacgcatctcatcgatccgtccagtccattcattataccgaccgtcacctggactggtgttaagtagccacacagctgctcgagattccgagaagcagccccgacccgatgagagcccatcccggaaaatccttagcatatgtactccagtttcatgttttgaattctaacactatagattgttagtagaatcttgatggggatatatatagctaggctgttttgaagaggtagaggttactccctccgtcccaaaaaaaaacaaaccctggtttccgtgtacaatgtttgatcgtccgtcttatttgaaaaaaatatgaaaaaaattaaaaagacaagtcacacataaaatattaatcatgttttatcatctaacaacaatgaaaatacgaattataaaaaaatttcatataaaacggacagtcaaagttggacacggaaacccatggtttgccttttttcgggacggagggagtatataagaaactatagcttcagaagttcagcaagctaagcctcagctagctgctatagacatgtactccctctgtcccagaatataagcatttttagagttggacacggttattaagaaagtaggtagaagtgaatggtggagagttgtgattggtagggaagataatattggtggagaagttgttatattttaggacaaattttgagagctaaaagttattatattttgggatggagagaataatacatattgatcgatctatcacgtatttattgatccagccattgatatatatatataatcgatcgagcacgagcactagtctgttctctgttgacaagttgcaaggcaacaaccataataacaataacaatgataataatgttttaagaaaaagccatcactccaggattctaggtcgagggtcagtacatcatgtagcaagacatcagatgcgcaaatactagctagtagtaacatcaatctggatgcaaacacgcagcagcaccaacattatttgtccttgcagcaagtaggtcgagctatagctagtcccatgcaaatggatcattgatatcgttaatacactcacactgacaagtgagaaacactacgctgaaaaccctgcacattgccatgttgcccctgcctatactgctagtgcgcgcgccacctgtttttcgatccccagctactagcgctgatcgagacgacggccaatgatcatatgcaagtaaaaatttgcaagcaaaagcgcatgtagtgcaaaaccatgggcgggctagccgctacacggtgggctgcactgtgccctaactacttggaactctgtccattttcaaaagatcgttggcaacttggtactaggaatgctgctaggatcactgtgctcattgcgtccgattattgctttcgttgccatcaacagaggccaaacactgtcgactacagtctgaatgtcgacacccccctgatcatggattcaaagctagctagctacatgatgcacgcatactccttgtcagcattaatcctagtcgtctctgcttgtctgcatatctctccttgtcagcattaatcctagtcgtcccctgcttgtctgcatatttcaatatccatgcttgcaaatgcaatggttcatcagatcgagatactactactccagctagttaaatttccaatttctttgcactggtagtagtaaaaatgaattcggagctttcagctaacgtactgtctgattaataactcgatcgtgataaaacattttgatggcgtgaccagtgaattaaagcagccgatctggacttctggggactgtttttatatgagactaagctattggaagctgtcgtcaccgtgttcagagatgcacaacatcatgtttctgcaaataatagtgctcctcttccttacagtggcccaggcctgaatttgtccaaagctcaacctctgcagctagctaccgctgcattactgcgcaccataaagttgcacttgtacgaccatccaatcagcttctctcaagtttcctgtgctgtgctcatatggttttatatctagaaaccgttcctgaacatttctgtcacattgcttgtctgtttcgctgagaatcaataaagaagctcactggctgctcttgctcggcccagctccaacagggatctcgactcatggatgccaaaaatatccaagaacaacatcattgatgtctcttaggccctgttaacagatcccaccccaaaatttttcaccctgtcacatcgaacgtttaaacacctgcataaagtattaaatataggctaaaaaaataactaattgcacagattgcgactaatttgtgaaacgaatcttttaagcctaactgctacatgatttgtcaatgtgatgttacagtaaatatttgctaatgacggattaattaggcttaataaattcgtctcgcggtttactgacggattctgtaattagtttttttattactgtccgaacaccccatgcgacaccctatataatatccgatgtgacacaccaaaactttacacccctgatctaaacacccccttactccagattgagatggctgcatgccggttattttactgttgtaagtggacaattctactatccgtataaaaacctgtttactataaaaaaaacctgtttactagttcatttttctacatgatattttaaatttttaaaaacaaaataaactagaagtaaaataagcggacaaaataatcctacttttgcccgctccacttgcattcctatcggttattagggtacgtcttgattaacaattcagtttagcggtacttgtacaaaacaattcagtaaaataagtcttgattaacaacttacgcaagtgtgcatcgtatatatgatttagaagctgaaatatttattccattatcttaaaaaagttatcctaaggcctggtttagttctctatttttttttccaaaaacatcacatcgaatctttggacacatgtatgaagcattaaatatggattaaaaaaactaattgcacagttaggggggaaattgcgagatgaatcttttgagcctaattagtccataattagccataagtgctacagtaacctacatgtgctaatgacggattaattaggctcaaaagattcgtctcgcggtttccaggcgagttatgaaattagttttttcattcgtgtccaaaaatctcttccgacatctggtcaaacatccgatgtgacacctaaaaattttcttttcgcgaagtaaataggccctagaagccttgcaatattgcaagatgattgtgtactagtacatcgtatctgatagagtgaataaatgcgcatcagggtcgctgcttcaaaggagaacctacaatgttggtgtagcagtagcactcaatcctagcgcattaaccagcgacctactcacgggatgcagaatatgctcttatgcattttattgcatgcctatacatgttgctatcacgctaaaaataattacttaagaatctttagctctccagatacatatacatttggtatcacaacctttatcacaagtttaatggaaagctagctgaggattatggatatgcaggaatgatgcccttttttataatagaatgattgattctcctttgcaggttatctcattggttctgtttctaggctatccttcaaaagtcgggtttgcagaattttattgccgtggcatgccagcaattggaaagggtggctagggagtttttttttacccaagaacataagtgacgatctagtctatggattgatagctcttaatcattcctgtcatttgcttacttttttcaaatccagtgtgtgtttagctgtgtgcatcttagttatataaaggccaagagtgtttaatttcattacgattgtatcgtgatataattgattgagtttaataaatcttccattattaaaaaaagtactagtttcaaacggtgaaactaataagcacctggtgtagaattcagaaatgaactgatagacagaaatttgtttgggttcataggtttacgcaccaagtacactgttctttctgaaataaaaggactgaaatgatcgagtgcccggcccgtttgtggtatacggtggtgatgtactattttgccaaaacaagtatacagtaccacgaaattatggaagggcagcagcagcagcccgggagcctcggatgctgtaccatgtatagctggcattggaatcagccgtcatcgtggtcctttggattctttggacggtgcagattggatttgattggtcgagtatcctgttgacactggtcaatgcagagcacgccagttccaattgccaaaaggtgggcttcccacttgtcatgccccccccggtccatccaaaactgtgaaggttaattgcagatttttgcaaaaaaaaggaaaacattaattctaattctatgatgcatgtaaaattgcataagcaggagaaatttaagaaaaacatacgagttacttcgttagtacccaggggcggatccaggataagaaacgagctagcgtcaccacgcactactactttatggatcatatatagtatttacatatggatagtaaaaactgtaatttacatggcatgtttgaagatgcccttacacatttgtttccacactgcaaactatatatgctctgcaaatatatccaggtcccctacggttgtgcctcctccactgctgataccgagttgcaagcgggctggagtacgtaccaacttgtagtagttgccccagcctcccaaggctgccactatatatcaacaaatgcaaacagttatgctctataattggatcttgccatatcaactgtcccatatacgatccaacgtccttttcatcctatgtcatcactgcaccccacaaatggtccatatcccattttccacacataggaaatctggctgaaaaacttggaaacttccaaaataacaaatttatatatatgcgcacataaaaagaatattttgattaatgaagagatgcgaaactgatgagaatatattggttgtttaaataagattgttattgaatatatattaaaatagtagtatgcatgttaggatgaaagggtaaatatatggtgtaaaccaatatatacgtggaaaccatgcaagctacatgatggaagttctccatacgagaatgtttttttgatttttttcaggacttctatgcaaaagttcctaaaactttttgtcatagtttccactgcatattttttcatgcggaaaacatgctagtttcagaaatcaaatggaaatttcgatcaccgacagatgccaaattattacttcaaaagcatcatatcaatcaattactagtaccatataagaacctcagctgaaggggactcactatatattttttatctttatgcaatttagtattatctcagttgcacgtgtaccatgtagataccagatgagatgtgctacctaattaacttttttttttggaaaaacaacatatatgtgtataaattgtgcctgcaatgtgaccacttaatacatcagaaatgggcccaattaaaggctcttgtacgtagggggatgaacctaattagtaaggctcatgtccattcgtccaggtcactctccgtcctctgcttccacttggccaattgtttcagcaagatttcaagtgcacccgatgctgaatcgttattggttattgcaggccgtacccccttgattttaatggcaatacacaactgctatctactgtcacaaaacacatggtatcggaggcgataaggttttcaaatattaatgcagctttgacaactaaattttgtcataacatacttataaaactcgacaaaacatactataatgtacactatttttggggcgaacacagatactattttcatacatccaatcttacaatattaaaatattaagattgatgtttcacctctagaatttttagtgctctttgtgagtaatttttttttgctctttaattattgaacgggtatttgtaataagtggatgtaacttctttgaagcaaagtatagtccattatctcaaaagaaccacacactcacacaccaccaaatgcatcctctaacacacggcaaaggacagtggtaaatctctgccccttactaaacttctattgaaatcacaaccacatgtatgcttatattggttttgagagtcccttgggtcaataggactaaatggatcaaaacttctggtcaattatattattcggagtttctagatgtaaacaggaaaaaatataacttgtattagtaagaactatgctcaacatcaaaaaccatttgaaccaaacgatagaatgcgggctatagactaagaaaagtaaaacacccactagctcaaactaccacatgcatagattgagtcaagagaagtaataacggtacagagagaagccaaattttttcaccaaagttcggatccgacgatcctaaatattgagggactcataagagctaggtcgcattcgactggtctaaatgtgccaaacgaccacgaagataaagctcggttttgactcaatttaccactttcccttgtggagggggagtagatcattcacaatttttctcgggctctccacatgggttggaagtgcgcatgataagactaaacctaggggtgggcattcgttatgaccgaaaattttggtatcggtcttcggtctttcggtcatttcggtctttgaaaagtgaagatcgaatttcaacacaaaaatgtcaggaccgacaaattcggtctcggtctcggtctcggtcctgaccgaaatagaataacattttcatatacgcaaagaaataatggaaattttcaacacaaaaatcacaaaaaaaattcgtaagcatgtatgagtaaagactcttattaggttgcatgcctataagaagtagggatgtgaaaattagagtttaatcctattgaaattagtggattataggttgcatttaggcatattttgttaatttggtcttttcggtctattcgtttacccgaggaaactaaccgaattgatcgaacaaaattcggtctttcactatctaggaccaaatttcttggtctcggtctcggttttttcggttcggtctttttctgcccacccctacctaaaccacctagagccctagaaaggaaggcctccaagagtaactagtatgaacactagcttggcttcgaactcaagtgctcaagaatgaagctctcaaatgcattcaaatgcccaaattttatccaatctcacaaggatctctcttaatgcaaggtggagagtgagtactgggagtgtgtttcaaagaatgagccaaccaacctatcaaaggaggggaataaatatcccaactggccaactagctgttactcacaacaatttaatccatgaacttccaccctcctaggcctagaacttgtggccttttttgaaatatcagacaaaaactctttgccagaacttctggctacatcagctgctatacataacacttcaaatggatacccaacccctttgaacttccgaccaaccctgtcaaccccgaaagtgtaagtgttgtgaattttatatctcatcaaatatttcttgagcacttgagacaacgcatactacaccatatgcatgagagcctcttaatagtgggacattcctagactcaaaataaagagaaaaccgacgcttcggtgtcttgagtccattttccactagtcgtttcttttgtagggttcattgttgtttcaatcaacatctccgttgaagttgatccctatacatgtccttaataaacacgttagtgtactaaccgctttgtcatcaatattccaaaacccacttaggaggcctagatgcactttcagatttgaattgtggtgggtgaagtcatgcacctagaactccaccatcatacaaccaatgcttccaagaaattttgaaattttatttaggcaaaatttattacgggccactgaaaaagtgtggtctttgctagtggataccaaaataacgtgaaatttgcccaaagacactccaaaagtacgataatttgctgtaggacaccaaaaacattaaaatacaacatacatccaattgatgagagagaaacca

SEQ ID NO: 56341 - DNA, 3304 bp, Oryza sativa
ccatataaaatatcagttttgcccccatcttcttcttccttctcacagtcttcttcaagcaacatgcatcaacggtgaagctgctgtggcagctagagggcatccaaatccggttgaccgtgcatgctcaccccgtcatgaagtcactgccaccaggcgctgaaacccgatagacgatgcatgtgcgtgctgccgtgaactcgccactattgcaccctgccacctcgcagcctcaccacgaggtcaccatcgccccctgctgcgttgaggtcgcaggctgcgcacgccccgccacgaggtcagcgccgctgtgccgccccaccacgtagtcctcaccgttgtgctgccatcactcgcacacgtgccccatgtttctcgtgacgttgcagcccccccccactctgtagtcataagcgttgcaccgctcgccgatccgccgcaaggtcatcgccaccacgcggtatagttgcatcgctgcttctcatgccctccctccctctgcgggttgcgcatgagtggaatggatggaggaataagatatgggcaaaaaagtcattttatataaattctcaccaatctagtgaaaataatattttaatggcattagtgtcctataacaaattaccacacttttagagtgtgctcgagcaaattcatgttcttacggtgtctactagcaaagaccgcactttgtgaatgttctgtagtaaatttggccttttttttaaggcatgacctaaacaacatatatccaaatgtttgttacccgagggaatatatttactatagtgaaatgaattaacatcttgtaattaaaaacaattattaaaataggagagagatatatgtaaattatgatcaaaccttctctccatttgaacatgacagaaaagagaaaaacacttctatgttctcactttcttattagggctctatcaaatgcaagattttaacagggtttatgcaggaatttagattaaataatcctttaaaaatcctccgttacaaagaagaccttagggttctatgcatctcaaagtacatttaaggggaagttgtagaatcatgctttcaaagtgcaaacaattaccactaaaatatcttactaaaaagggtcatccctcgtctcctcccccttctcatgttgcggtcgcctccctgatgaaaagaaaaaaaaaccaactaagctcatagactatttttaattgtatggacttagtaatacatttggcccatccctaattgcacagccgattcaacgtccatgtttgttgtaattagttattatagaaaactatatgaagcacggtatattaggatgacatatgtggtttaaaataattgatcaagattattttttggactgtctaattttttttagaaaaaggccagtggcccggcttatattgaaagcccagtgcgggagtgtgctaggcaaagcccagcccggcttatgttgatgcaaaaaacacatcaaatttggtcgttaacagagtaccattacctacctgccactttgacccaagtttcatccactttcttgcacgaagcaccccaacccagaattgagaagctctatcaggggagcattggaacatcccaccattgtgtaggtatttcttcctcaatagctcaacacacaaactcttatcaggggattcaatcttaaacaactatttagctagtaaagcagtgttcagtattctagtttcagtaagccccagtcccccaaactctttagggaaagctagatcagaccacttcaccatgtggtatttcatgccttgtttatttcctagccaatagtatctaccactaattaagtcaaagttatgatgtaatcattcataaagttgatagaaacccatagcatatgagggatagaggataaccatgcattgatgtgtacaactctacctgcatgtgaaagagtattatcagatcaaacacctaatttcttctccattttttgagctaagaaggacggtatgcaaattaaaacaatcgaaaatcatgcacaccttttttgctttcgtcatcatgtatctaaaatctctattagagcaagtttaatagtatagccaactacttgcttcaaatcatatatagtcgatttaatagctaattcatacaatagttacatataacatatagtacacaattaatacctagattcacttatcataaacacatgtatcttggagcccatgctgtagctggctataaatctgtagtctactgctcttctctcttctcttttattttcttaaaatatgtttatagctggcttatagtctactattgctcctgctcttatattcttagagctgatcagcttgagcaggagagcaacatgaagggtacagtgcataaatatgaatccacgaaaagtataggaagaaaacttcagtgccatgagggaccccatatggggccatgctatacagctgaaatgtgcatgcctttaaacattcacagtaatcaacctcttagaatatattccaccaaaaactattatctcctcgacggttgccatgattgtacggacatgcatgtatatatagtgaaacagttcaccctgtcttttcttcagatataatattagtactcatcagtcgtcaattaaatttgaccaatcaaccaatcgtactaattaaattatattaattgcttgatcgccatgtttaaagcagcgtgcctgtacgtgcatgatcgacctacatataatatttcctatgttttaatttagtgctttagtttaattacactcttttggggatcttaattaatttcgagaaaaacaaagcacactttggcagaaattaaaaatatatatacctggactggatgaaattaagaggactcgaatgtgaaaataaaacaagtttgcgtggcctgtccttagaacagaatacatgatcagaaaacatgcacaaccacgcgggaaggaacaggaggcccagatggatgcgtacaggaaaaagtacatactagtaagtgtgcatctttcttttgcctgaaagcgacaattaaattgtttcaccaaaaaaaaccaattaaaattatcagtaaaaatactaaaatagctaagaatatatgtatgctcatggaccatttctgtggaaaaagcatgctggcttgcacgaatcaaatttaattaaatatggtacacatcaaaactaaataatagcatcgaccaaaatagtcgattactaacagagattctcgtagccacacatgcctaaacagtaggcacaaacgaacacttgcctgaaaagatcacgcaaaaaatatagcataaaat

SEQ ID NO: 56342 - DNA, 7820 bp, Oryza sativa
attgccagatcgatcgaggcgaaactatagaattttgccttggggtttaattagccttaatttgtacccaaaaattgaaacaaatccgtcccacgcattgcattgggatgtgtaatccgggtttccatatgcatggttatgggaatgtgccatgtgtctgctattgctatatatagttattagtctagctacatttccaaatcacatgttaaatttgttgttctcataatggattcctctgttggagatgactgttcctacaatattatattcgaacttttatgatctcttactgtatgcttgcttcttctgcctacatttaacttactgtacttgtttagctagggttacagtaaaactccctcttcttaatttccttctaattacaaactcgattcttcaaacatatatattcagttcagactcatccaaaccgcctctctctataattcacacattgcatgccagttacttcctctgcttagttaattacaaaggagcacgtatgcacatatcccaagattcagtacgttagttttgactagcaaatagactcacatttagtgatatatgcatgcacaaagtagtggtaccaccactactgtaaatgtacttccaaatatatactcactatatcctataacaacggtatataaaaaatgagtaccactaaggaggaatttggttatcagataatagaaggaattttgagtgtgttgagattcagaccttgtagctgaaaccacataccctttaccacgacagcatctcaattaacggcagtatattgcaagtaggaatttatggttagagttcaatacaactaaaatatatatcgccttaagatcgagaagttatatatgatatggacagtagtgcagtgggtgtgcactttcagaatcgaaatgaagcctatgcgtgtttaaatatataaagagatattacttttcaggtattgagaactgatcagctctattgcttgcatgctagctagttctttatctcccaaatttaattaaccagtttgctcctacaggtaaaataaccatacattatatttctttccgagttagtttgtttttcggcttaattattttgcttagcccatcgaaccaaacacatcctatgggggtgtttagatccagtagtgtaaagttttggactgtcacattgaatattatatagaatgttgcatggggtgtttgggcactaataaaaaaactaattacagaatccgtaaccgtgagacgaatttattgagcataattaatccatcattaacaaatatatattgtagtaccatattgtcaaatcatgtaacaattaggcacaaaagattcgtctcgcaaattagtcgcaatttgtgcaattagttttttaagcctatatttaatactttatgcatgtgttcaaatgttcgatgtgacagggtgaaaaattttggggtgggatctaaacagggcctaagtatagtttgcacaatttaatttgttatatatagttgtatttggtatatagatggaatatattcctgagccggcaatggaggacgaggtactcacgtgtggtacggtcgccggatgcatcagaggcttgggagagaaaatgtttagaattttctggatttttcaaagaaaaaactataccaatgcagcatgcttcctgctattaatttccatgaatttaattggaagcatagatcaatcatacaaaggttgcaggagtatctacaaattatcacaagttttttgagtgaaaagtttttagatataactaatagtataactgtgaatgaaccgagctcgagcgagcccgtttgcccaggctcgagctcgacataagcttgagccgggcctattgcaccttcgagcttttagacaagttcggttcgagctcggccataagtaagataatatatattttaatgataatctcttgataagtataattattttctagttaatcacactaataaaagagtagaaaatgattaaaataaatatattgtgctaacacatgctaatttattgtgtaaattgatattaatatatatatttatctattggtttataaatcaataaggtgaacaaacaatataaactatatataattaagctcggctcggtaaagctcgcgagcttttgctcaggctcgagttcggctcgtttggagcttaggccgagcttgaacagagcctaggacaagctaagctcgagctgctcgcgagcctcgatcttttttgatagccctaactataactgtgttgtaaccacactgtaactattatataacttatataaaacttgtattcaactatagttaatttggttgcttagtacctgtattttacgcgtgatatgtgtgaaaatttctttctagcaatttttttcttgtatatataaatctcgagatgatccgatggccacaaatctaaaaattttgaggataaaaaacttgcagaaattttctagcaatttcgtattgttaattagacgtggatccaacatgcatgcaaggtccatgatatatgagtagctagtctcacttatcatcttcatctacagtatataaactccataacacaaagccagccagcaaggaactgtctatgtgcagtgatcataaagtgaagctaattaaggtagtgaactaccttaatatcataccatacgttttgtgtactcctcaacgtacacaatccaaggattacctcatccttggtacgtacaattttatgagatctattattgtctcagctgtgactatgcaactatgctgtgagggccacaaattctttcccacacattttgatctaatggaaggttgccattttaattatttgggagttaattaacttgactaaataaagttattgtacatcttattcaaaatgtggagccgcagtttggacgcgtccatatttgatcatattacaaattaatttgttatatatatgcatgtcacaagcaatactatgccacaaatacatatatgtatacgcgtgtgtttgtttcgattggaaccacaattaagtgagttattctgagcatgcactactttgtacgcatcaccttcagaatgctgcaacaatttaattacttttatagctacattatatatatatacttaatctactgtacgtcccagttaattgctctgcgctgatatatctttgtacatctgatagtctcgtaatatactcaatctgtcttctagcattcatcatccggaggaggcaggtgtttagactgctttctccttagctcaatggactttgaggcccatataataatctaagtatctaatgtatttaggcctggcccaacctaatccaattcagcgtaaaaaaaaaaactaatccaattacagtgcattgtaattttgctgactgcatatgcagccggtcttgcctgtatgcttgcaattgatgcacactagcagaaatgcagaatgcaggggaaggacaagaaagtttcatgatgtaaatggtgtgtatcaaatgctaatcatgatcggtaattagcagacaggtgagctgcacatcacttcaattatgggcaccaattttgggacgaaggtgtagtactaatctgaactatatgaagccatgcatttaattttgttgtggacttgtacgtggtacagtcgatctagtgatgatacagtgtttaagggattttaactcttcatgagatgtcactgtgcagatgtcatgctttatttttttagtgaaatttgctataagacacttaaaatttgtgtaatttgcttgtaaatatcgtaaaaatatgtcacgactgaaagacacttaaaaaacaataattttgttacgggacactttcagttcaatttgatagagaaattcttcaaaaagacgagaatgcccctcgggtcaaaagcttttaagccgagtttgaagtgaagatggcatatgatatttgctagtgatttacttctggtgatgacaaatttagagttgcataatttctaaatgtttactctaacaccatgtttaaagcatgtgttcatagggacattcttgtctttcttaagaatttgtttctccgattgagctgaaagtatcctccagcaaattaccacctttttaggatgtctttcagctatgacacgtgtttttgatgtctattagcaaatttcacaagttttggatgtcctgtagcaaaattacctattttttaaacttggagaaattatatatgttcatgcctcatgttgaactcaaacgataacttcatccctagttttcttactttatgtttcctcttatttttaaatctaaatcttgtgtttgcccatattccatctgaaggagtacttaacaatgttaaaaacatcgatgtatggtcttgcaaatttaccacaatttttatgaggactttgtaatttaatttcccccttttgacatcaagccttttgacatgcattttcacaaatctagttaaaaaaagagcaagcacaaacttttcatgaattttaccaatgtatttaacatgagttttcacaccgtcaagtcctcctaattgaatgggaacaatcacaagcatcacttcaaaaaagataccaaaataaaaacaaatcaaaactagaaatgaacagaggggtaagaatggaattgccccttaattttccttgttgcatattcatggctacagtacatttagccagagatgcatgattatttcttttggattttaatcatggtcacttatgttgcatgagttgcgaggtaaatacatctattgaggcactactaggaaaacgattttcgcagacgaggtgcgtctatcttcctaggcagataacattgttgccatcatccgtccgcctgcaaaatagggaggcgggggatcaagatggccgtccgcttgcaaagatcaatcttcccatgcctttgcctacaggggggcgaccgtccgcctgggaagacaaattttggtctcctgcaaaaatggttttcctagctagtagtgaggtgagaagggcaaccactatatttaccatcttgctaactagtgccccacatgttgttacgatatataattaaattcaaaatagtataaaaataataatgaaatttgtatatactggttaaaaatggtgtaggcattggacatcagctctcctagctgatcgagttgtaaccagtgtatatgtaagtcgtgggtgttttcttttcttcttctttgtggggaagggggggggggtttatcaactacaggtagtgaagtttatctgatggttcatatatacacgtaagacatgttcaagtgtgcattggtttaacaaagagactaaataataggggtatctgtgaaagctcacacctgtatgaactgctcaattggagaaacgaggtaggatagtgtcactactactaaagagaatataatgtggaatgagagaattgctccttgagtgtgtgttttgagagtgaataattggtctccttttatagctgcttatgacggtggttaaggtcggtaactcccacaaccgtcattgggaagcaaccaggagctgccacttggtttggccgacccctgggccccacctctctccaccgcctttcaccagagattgacatgtgggtcgctaaggcagtgcacgacggtttggccccactctaagttggtttgagctgacttgtgggcccatcaattcatttgctctcatgtgattcgccagaggtgtgtttctttgaatgccggctcatttctccttcaccttagtgtataattcatgcacccatagtaattctccaagacaagtggaactaaatttacttgtaactaatatacgtgtaagaaatgatagttctctctttatttattgaggtaattgacgtgtcaaaattggtacttaacgaccgtcaacagtcatgcaactcagtcacccaaaaaaaccgaccacccctccaactctcgttactctcatgtaatcctgttggccacgtcctcctttcttggccataattgaagaggcgatacaaaacgacaaggcaaagatgtccccactgtcgttcctctctatgcctccctcaaagatgtccccacctccacccgtccccaccctcgtctgaggagatggtcacccttcccaccactattcccctccccatccctgtccttgtgtgctagcacctatcgccgagggaggccaccgcgtctgcctcgagcagtcgccattggccagagatggaggccgcatcaacctccattcatccccataggggtggacaaaaataccccgaaggctgcaaactgaacaaaactgagctaaattgaaccgaagtgtcgattctttggggcataggtttacccttcgattaatgtattgtgtttgatcaatctatggtcttttctacggtttttaattctcatgaaccggacaactcgaggaaactggaaagtccgaaccacaggtccaccaaacgttgtatagcgacaaacctggcaatgtgcaagctttaaggctcaacacccaaagcccacatatctaacaataatacatctcctagagtactccagtactgttcatcgttgtttcgtaatcgtgcgaagccgtggccggatttctaccctaccgccgcaaccgtttcacgggtccgtgccgctcgccgcccccagctcctttggacgactaccctgtgcaactgcgcatacaattaccacatagctcggtcatggtctactagttgcccaaacctctccaagttccaagactcctgctatgtgaggtcagaaaaactccttgtctcttgatctgccattgtatgtgtcatcaagtgatttctttgagtatcttgtgctttggaattcttgccaacgtgttcccacgatttgttcggtaaaaccgaacaacagaaccaaagttactcagtttactcggttcggctttctattttttctataaacacttcggttgtcatagctagaaaaccgaacttttattaaaccgatgaaacggaacactcagccctaagtcccctagagcttctttcacactacgaggagcttgcctccaccttctctaatcctcagcaagtctagaccagcgcccttcatcttcgacaagtcgtcatccacagatgctatctcccgtctttgcctcccatcctccactagaccatgctccgggccctttctcaacaacatgcggttacttcggttatgaccgaagaccggaccgaaattttgggtgcctgaattgtcgatcgcaaaatctacagtgccaagttcaggcatcatttttagaagaccgaagtttttttttacccgaattacgtagaccaaaatctcggtcagcaacaaatgcccacccctgagtatgccgatcgggatacgtggcacccgttggacctctttcttaggtcagcaggtgtcaccaatagtcccgattgagcggccgaagtcactccttggattaggcttggccagccaacccactcatagggcggttggtccaccacctcacttgggcttgtcttggtgaaattgggttaatggccaaggcattggacgtggtcggccggcctagtttaacttggtggctgacccttccaaggggtccaaaggccctccggctaggcttgtcttggtgaaattaggttaatggccaaggcattggacgtggtcggctggcctagtttaacttggtggctgacccttccaaggggtccaaaggccctccggctaaggtggtgaccagcctgattgctggcccttgttctaggtcggtcgaccaccctcggctctataggatgacggctctataggatgacttgtttttctggtcgtcgt

SEQ ID NO: 56343 - DNA, 17298 bp, Oryza sativa
acacacacacctcccatgcacatcaatatagaaatctcaacttcatgtgcaccatgattaatttggcatattattcatgaactgtcttaaccctcataaacctcaacattttggcatattttacatcacaactttcccccaacttttaatcatttacttctattttttgaaacatatatgatttcaagtagtaataatctcaagttatatgtaagagcatatttccaaagtttaatctattttttgaaacatatatgatttcaagtagtgataatctcaagttgtatgtaagagcatatttccaaagtttaaccgttcaaggctcttatcctattcaccctaggagggctaggacataggggtgtatatccagtataggatcgggtctttcccacccaaaaagtagctaatgaaatgagagactcccctacttatatattacatcatttgtccttccataatctatgtgagactatttaacgtatcctaacagataagtataaggtctttggcagcgtcgtgagacaaatacatgtggtgccgacatagggaaattaagctggctagatagctagctagggatgcaggtgacacgtcgacggcgacggctagctgatgcatacattggtacggttgatcagctgattaagtgtcccttaataatttaatgtttcccgatatgatcaatctctctaaatatatcgctaattatacttgtttttttcttcttcttctggcaggaattcaggctcgttcttaatttgattggttcatgaacccctgcaccaacatagcatgtctcaattaacgtacgtgtgtaccaggctaccggtagcttaattagccagtgatggaatttgattattaatttggctttaaattagttccggacaattccctgatccatctatctatcttgtgtgactatctacttccaattaaggcccccggtcggcagatggcaagagtaattagcaaagttccacagtacagatgctccctaggcctatatatagtttaattttgcgctcgtactagctagatagatatcgaagatatatacctttcagctcactactgtttaacgttgttcggcaaagaggagtactcaccaaagtaggcccaaaccgaccaggacttaaccaacagctttatattcaattgagaatttattaatttcatcagcatgcagctgctactggtccaaatagagcagctagcatgaatattgtgtactacagcccggacctctctcgatcgatcgaatatgcaagctagatgccaagatctatcgatcctagctacaccttagctgtttccatggagatgcaacgcttgaatggcaaatggatttttgaaagagggtgactagctataacttgtctctgatcgatctctctctctcgctaatttgaagaaatggtaacagagagttactgttgatatgattcactgaaaggaggatgcttacaagaaaacatcgagtaactaacaaggtggtgtaacctccgcatgttagaaggtttcaacatggcgaaaaattatggtgtgtttcacttctttcatatatatttttctaggtggtttaacgacggacaatttttacgatgtggttttactaaaactagaatacctacatgtataattgacgagaaggggtaccgtgttttcttcttaatctttaactagataggagctaaaggtttagatgatattatttgattgttacgatttatacttttaacttttttagggggggtgtatatataaacatgtaaggaaatgtaatggcaaccatacataaagacaatcgaaagaaagataaagtgattaactagagggaaatatttatttcaagtagatctacatatgaaaaatcagagagttaaaaaattatgtcagcattaggtttcatgagagaggtatcgtaaacccttctttgctttttttttttcgggtgactggtggggagatgagggtccttagaagaggtcattgttagataggttcccacggagttcgtctatttctacacttattttaatactcatgctatatatattgttagatacttgacaaatatggaaggtacacctgataactagggatgttaggatacgtaaaaatgctgtaatactagataaaatttgaattcaaactcaactagcttttaattaattttgaggttttttgacatatatagtatgtattccaatcttgtctcacctataaaacactaataatacaaataaaagtttacacacaagctatatatttttcttctttgtttaattttttatggcttatccggcgaatctacgtagtgtttatcgggatcacatgatcccaagtaaataacttaatgctaactaatttatatcatattaattagtactatattagtagttaataattagagacttcctccattccaaattgatctacatatagtttttttttaggttatttctaaatgatctacatatttgtgtttatttattaaatctatttgttatttgtgcattggagtaaatggacattgaggcatgcatccatgcgcacaagtatttataacccacatgcaatatcttgatttgctattggctaggaaatagtggggatggtgcatgcttcgagtttgttgctagagtaaatatagtatgagagaattattagtttttttttgtcttggtgtacctatgaaatatgcagatcaatttggaatggagagagtaattgatatctatagaatcctcgtaattttttctaggttcgtcactgggcttaggctgtgtttggaggagggggttgggaacccctcctccctggcacgcaaaacgaagttcgttttattacattattaattaaggattaactaattttttttttaaaaaaatagattaatatggttttttaaacaactttcatattagaaagtttttttttataaatcataccgtttagcagtttaaaaagcgtgcgcgcgaaaaacgagagatgtgggttggaaaattaggggggaagaacacaaccttatattagcagtaattcgatcaaataatatgatctatttcctgctagcccggaaactcaggaaatgggcacgtatagtaaagcaagtcgtcgtttggatcggccagtccgatgaggctataaatcatactgaggcggtcaattattaatcagggttctggaatgtaactgatgagatactatgtgccaacggcagactggcagagacagtttatgaccgtaattaagcagccgtgaccacatgtacatatatgcatgttagtatgtgggttatagtagtacttgcagttggtgaacttcatctataatatatggagtgtagtatactagtatatatattatcctatattaggatgcacaacgcgtgtagagaatcttaaactaagtcaatttataggcatttcgatttggatcattagtacacaaaaaaagataaaagattcaacatatatccaaaagcgaagataacttttttcacgctgaaaagaaaaaaaaaatcaataaacaaagaatattgtagttttttttttgccaatagcaattatttgaaaggtaacagtaattattttttaggggttgaggggatcgaatgaatggttgtgaggcacgctacttacactactagctagggctgcattcgttcggagaacatggggaggttggttgtttcgttttccacgcgcacgcttcccaaactactaaacggtgtgttttttacaaaaaatttctatattaaagttgctttaaaaaatcatattaatacattttgaagtttaacatagttaatactcaattaatcatgcgctaatggctcacctcattttgcgtattttcccaatcttttcaatcccctctccctcaaacacagcctagatatatttttacgggggtgagaaggggagcgagtagacggctatgagttggttaaaaaactcatggccgtcatcttagtctcccctcctcaccccagtaaaaatattagaaaatgctttcatgcagttatttgtattaaatttataaagtatatatagagtagtgtcggagagtgaacttctctagcagggaaccatgaggccctcctttgtgagttcggccgggggcagcgggtgagattcgagagcttggtgagcgatgctgtgtgatcttgagggggttcaatcccccaaagacgatgggacaaaaggggtttatacaggtttgggccgctaggaagtgtaataccctactcctgtgcttggttgattgagtgtagaacaccagtgcttgaggttgcaagacccaagcgcgagttcactcggaagttcccccctccaccactaggcatggacctccttttatacctcaaggggttaccacatgggtccaacaacctaacctaactccggtggagaagtattataatctttgcattaaatgcatgtctggtctcttgacttgggaagccaagcgcacgtcgtcttaatgatggggcctgtcaaatcttgccgcctgacacggggggtgcccttgtcagtcaccatttaatgggtaaagacttctgggctcctattacaccgggaaacgggagcattgctttgaccagagcgggaggaccgactccgactggaataagaggatgagaacctctcaccatcattatttgatgggacatgtcgggctgcacgtcgcctgacacacgcgatggtgcgcctgacatcctgggtcccatcagtcattcaaccggtcacagaccggttgagtgcactgcacaccgcattaaatgcggcgtggcgcgaccgctcgggtcgccacaaatgcgggtaggtgggcaccttgaggcagacacctaacccaccatacgtggtgacctagagagggggtcggggctgcccgacccctagtgacgggagggggcggccgccgcccgacctcgggcccgatcccccctcgggggagggccacatggcgcctggggcagcctcctccatccattctatgggaaggagtggccgccgccctaccttgggctcgactcccctcgggggagggccacgtggcatcggggggcagcctcctccgtttaaccttttgggaaggagtggccgccaccccacctcaggcctgactcccctcgggggagggccacgtggcatcgggggacagcctcctccgactagtctttgggaagaattggccgccaccctacctcgggtctgactcccctcgggggagggccacgtggcatcggggggcagcctactccctctaaacctgataccccggacccatatcaccgacagtagtaattagaaaaggcgatgatataatatgcgtaataagaactggatcaatgtcgtgctaaacgacaagaaagtaaattaaaggaatcagtaattctttcagatcgacaagctgctagcagggatcgatcatcgagcaagctgtcagtcagggtggcaatcaatcttcaaccatcaacccggccatcatcaactgactttcagtacattcccgggctgcaactttttgtgggtcgatccctttgatgaatatccagcaggagtaattaattagctcctcaacaaagaataatattaacctcacttaattagtgtgtctccgtttcatctgtccatcacatcatatcggcacagctcgatcacacattttattagaaatgaacatatcaactcgaatgggtccagcctgcctgccttttctgaatgatctctcatccctattcacaatgaacaggctagcatgcatatatgcagcttgcagcaatgcaagtagcaagagtgcgccagcagaaaacttagatgcgatgcaatgcatccatccatccatccatatgtatgcactgcatctggcaacaatggcgatactgcccgggaatgaatcagtgtgtgtgggggggggggggggggcagagagagttgctgctgcatgcagcaagttggccaatggcgtgcgatgcaaatgcatggctcagaatgatcgatagccatacagtatatatcttctctactgttgcctactgttgcagctggcctggctacccctgcctgcctcttgctaattactgatggacagattgatcatagtacattatatatgctaccgcctccatcccaaaataaatacagccatagatatatattcagcatttttgagcgtccgtcttatttaaaaattttatgaaaaaaattaaaaatattagtcacacataaagtactattcatgcattatcatctaataataataataatactaatcataattatttttcaaataagacgaacgatgaaacattgagcatgaaccgtgttaaaactgtatttattttgggacgaaaggagtactcctaaatgataccatcaatattggcagctgaattgcacctggtattgggggtcagtacaccagtactctccagctgctccaattttgactgttttcagggacctaagcagaaaagaacctggtataatatcccacttgcagacgtaggtaggtccaagcccatatggccatattgatctttgtccagacattttccaaactttgcagtgatttctctctctctctctctctctctctctctctcttttctttccaaacagttgcatcagatcagtgcctttgtttcactgtaccttttactgcgttgtgtacgaggcaccttgctgctgtcctctggtactgtgcatgttccttgtctgcttgctgtggacctgatcttcatttgggaggagaccgacttcttcctcttcctttgtttgcatgagagacgctctgaatcctcagacctgcatgctgcacctgctttatgtaggagtgttattactggagtatttctctatgcccacaagtaggcacacaaaatgttaattctccatgaaaacctggtaaaatggaccagtacctcttgaccaattgggtaattaactaaccccacgagctagctatccctacaaactaaaagcctgcactttgacagttgacacattgatctttgtatgtacaaagttgaaaatttaaagacccttaattacatggaaatgctgacacatttaggtgggaaattacaccaatgtctaatcttactccaagattcatgcttcatcttcgacgagctttagcaaactttcacgaaccctaaactttgacagaatacctattggttagaatcttgggttaagaatacaatcgagaagagtgggggtcaaggacgaggaaatgggaggtgtgggtcggtcggaaaatggtatcattattaggtgggaaatgaaagagggatgaaaacggtcggaaatggtcgaaaacggtatcattattttattgtttttttgaaaacgaatggaaacggtcggaaaattttcatatttatgaattcatctatttagtgtcaactttaatgccacgctgacagaaatttaaaaaaaactaaattttgaaaacggtaaccatcggtaaaaagatattattattatattagttttgcggaaacggtatcggtacggtcggaaaatttccataccgttttcactatgtgaaggctaccagctgccatggtagagtagtgaggcggtgatggtattgttcgagccacaagagagaaagatgctgatgggttagtgttggaggcaagacttgtaatacggagtggtgtggagatgggtctctcttcagtcaggggcggaggtaggcttagggcagttaggacttgagccctaaacttatctccaaaatcttgtttaatttttgttaaatcgccatgcaaatttaaaaaaaaaaaccaacactcgattagttgagctctttctttcctcagcctttcataatttctagccccaccactgtttaggaaaggagtcggagccgaggaagaaggtggggtgcgcggcacctcacatctacaatcaaagagaggagagcgatatgatgttactgtatcatgatgtttgctgatgcacacatatatgttcatatgtaccctgcccaatcaatccacccgaaaatggaaagtgacacatctactgcatgccaaaaacgatatgatgcgatatatatatatagtgtagccgccgttaattggctccatgcatgcatggtagaaagttctagaatataattataatctactactcatgctaagctatattgtgttcaagactttgacttgaacacacgcgcgcgcacatgggaattttgacaggagaaaattagaccaaaagcatctcccttctaggtgttgatccaatcatcaagtcgagaaaaaggcaacacaagcaagatattgctaataattcattagtactgatcatatgcatgcatctgcagaaagttggtgtcatcatcttaattaattctccttgctaaatgtattctatttcaaatccattttgtttgctttacattaatatagccctagctatcacggtcaaactaaacaataatatgcatacgatacgagtacatgtttacatgatggtacaaaaccagtgtgtagatatattcttaaagtttatccatggatgcgacaaaagcagaatggacccgggatacagaaaacatgatgcgttctagccggttccaatgggcaaattaaaggtactatagtactagtactatgcatgcatttgtatttttgttctgaatgctcatggtggcttggaccacggcctcactagctagctaggttaaatactttttgatagtattccgcaacagaattgccaagcattaaacacgatgtgaaattttgataatactatattctctatgttatactatatatttatatcagaacggtgacaaggaattcataaaacatatgcattgaacatgtaccatggtagagcgagctcctagatagattggcccctttacaatattgtagtcgagtcattgatcaaacaaaatgttttattcttcttccttttcctactataccatcatgcgacaaaagttccttttataaaagttgtaagtcgatgttaagcttaacatcgatgtttgcccttcgtcttctctctactgtatcaacaaataatttgtcttatcggcaagcctgagggagctcatactgatgactagaataatatttggtttaaaaaaatgtgatcgtcaataattttaaaatttgtagtctaaattgtaaaggaataatatacagagagctggcatgaaaaacaccatttatcttaaacttatttggttgtgctgaacatgttgtatcacaaaatactctatctgttgaaaaaataaaaataaaactggatatgacatatcttaatataactaatctggacatgtttattttttttattcttgaaacgaaggaagtagttatcgaaagttttaaaagttggaccgaatcttatactaaacacgagcatttatgaattatgataggagacagtattccacaaggttcatcgtgaaagcaaaatcttccttgtaagccgaaaagaacaaggaagaaaaatcaaggtgtccgactacgtacaatacggtcgaggaacatgttgaggtagctagctagcttagctcgggagtggagtggatttaatttatttctcgcgacgttttctcatcactcctcgcggcatagcacatgtaggtccgtctagatctcctggtaaaattttaaaccctgtcacatcaaatatttggacgtatacatagagtattaaatatagacgaaaaaataactaactacacatattacgtgtaaattacgagacgaatcttttaagcctaattgcgttataatttgataatatggtgctacagtaaacatttgctaatgacagattaattaggcttaataaattcatctcgcgatttacagaaggattctgtaatttgttttattattaaactatgtttaatactttaaatgtgtatctatatatccgatgtgacacaccaaaactttacgcattgaatctgaacccagcctaaatacagccgtagtacatgaggatgagagagagagacgacgatcgatcgacttggtgcacatgcacgaaaacgagaacgagagagaaaactgatcgactcgaaaacctgcagtccgtgtttaaatttccccggcccctgctgtgttgcgcaggcaatagggcaagttgtgcgacgatcgacgacgatagatggcgaaatggaaaaaccattcatttccactttaatcctttgtttctgcatcagtggcagagagggggtgggggatgcagctagtagtactgtagtatgctcccatcggatggcctattcacctttaaaaaaaaggcaaaatttgaattttcaaacttaattttgatattttcaacgtagtttcttttttagcattggcttctaagtcaccgagaacacatatataaaaattttaactacaaattcatttttattctctaataagccgttttggcttattacgaaaaaaaccaaccgataaggcccgtactcgccctgtctcaatatataacaatctgatttatgacatatcctagaaatacgaatatggataaatacatatccaaatctatagatatcaaacccgatcataggtttttatatatcggaacgaggaagtaaagtagagcagaagacgacaaggtcatccagcagcagtggcagcaataccagtggcagcatcaattcataggccacagtagcgatccttttctggatccctccctgcagccactggacggctggaccagctagcttagctagcggcagctgatgctctcgtacgctgatggatgcagcagcatgcactgcacacacacaaaccacccgggccgcggtttctagcttcccccccggtgtgtggagatgagatgatctctctctctctctctcggccacagccacacgggccgtacgttgcgcgccgtggtttttggatgcccaagttgctcatccgggatggagaaggacgcatgaaccgtaaggttgtctcgctatgatgttacaggacggacgaaaatttttcggtccagtactcgaggagggttttattgaggggaaacagctcgatttccggggttcaccggagggaccgggtaaaaggatgctacccatattttaattggggtccttgtcgtatgcttatatatatatatatatatgtatatatatatatatatatatatatgtatatatatatatatatattaatgatttgtgcagcgttctggggtaggctttttcttattgcttggctacttgtgtacgggtgttaaggaaaatcacatactaatagtagctatcggctttaatttagacctgactactctcttattatctggaagaactattattaccttctcccttattatgtatttgggctctatttactcgctactgaagcctatggacctccatgtcggtcgtcttttttatttcagccccactcgtcccactagcgcgctcctactagccgctcgttgcattcttatctcctttaacccctgaaattctcgtacgtttctgatggttttcgcttaattagatattatcaccatgatgtcgattatatctacatgttgcaccctggtaagtctaaaatccaccctctcgatcaccatatatactttgttcgacgcatccacatgttgaatttctcacacttcaatgtcttaaaatgaacccctaggcatcgtgtcttcctggtcttcggtggtttcagacgccagttaattaactgctcggcaccatcagtcctgttgccaaccgcaggttcacaaccatccatacgtaatcccattctaatccctatttgttcatcttaaatatatgctacttttttcactcccatcctaatccctattcctgaactatttctataccattatgattaattgctgagtttaagagcctactaatttcctttcattccatatcataccatattttagtttgtcctaaggtaaaactggattttgaagaaactaatttgatgattttttaaaaaaataattgaatttatttcggccatgacttctgataagctacatctaattattatagaatttgcaggagtaatcattgcgaattacaaaattacaacttcactagaagcaagaaaactactaagaaaaaccacccaaaagacagatatatccatatatgattggtcaaagtatgcataaccattgtttgcaacaaacggcttacaagttgtatgtggtccttatcttccttgaactagaaatacaacatctccgaaaccagcagtcgatcgaattccgcctccatcaccgttagcgaatgatgtttaaccaaaggggaagaaaatgttggggactagctgagcggtaaatcagtcattagttcatatcttagcaccaccaaaggaacatgatcagacggggataccgcagcaaggatattgcgctctaatttagggcctgtttggatgcattacatcggttgttgggacactaattgtaagtattaaccgtagactaatgataaaacccattttataaccctggactaattcacgagatgaatctattaagcctaattaattcatgattagcctatgtgatgctacagtaagcatgtgctaattatggattaactaggcttaaaaaaattatctcacgaattagctctcatttatacaattagttttgtgggtagtctatgtttagtactccaaattagtgtccaaatatccgatgtgacatggacgtactacattttattctctagatccaaacaccaccttagacatgaatttgtcctttcacttggaagacccgctaccttcttccttattatgtatctgggatctatttattataaaagttagtcgatatagtagaatgacgtctaaccttctcgatcacttcagtcattgattacccaagacacgctagatgacaatatagcagcacacgatatttgttaacgagattcaggccaaacctacatcctcgaggttctgatgatgagcgctcctcctcaatggatatagcacctaggctctacaagtacatggcctcgtcgttatcatctccctacgtgtctacgctaaattgtagtcgttacgtttacattgtggtgtctccctccctatttaaagaattgtcgggttacagagtccgattctaattccaccccttaccacctattacaactctaaatccaattgtaatcaaataggactaatatattcgacacctattcactattcgctctctagtgaagcctacaaacgtccatagatgtagtcttcctcatttcagccccgctccggcccctctgttcaccccactagttcatcccatcggcctctcattgaatccttatctcccttaggtccccgagaaatctccgtgccttttcatttttttaccttatggtttccgtaattttttaattgatcataaatcttactagggaaactaatttattaatttgatcattttcagataaaattcagtccatggttaactaattaattagtaaatccggaaaacaaattaatccagccggtgcgtgtacgtctgtccaaaggtatactatatggaaccaaccgggcatgcatggtggatcggcacgcacatacagtatgtctcaagtactgtacatgacctgtgacgactctgtgagtatttttgtttgtaattaaataaagttgctggatgagccggaacaaggggatggaggccggattggggcatgcatgtacatggtcggcagcagaaaataccaggtgcagcatcatacgtacatatcgatggacagcatcatcatgcggcgggcaaagcatcgcatagccagctgcactagcactacgttccagcatcatccatctgctccccagccccaacacgacaaataaaagccggagagagagagagcaggtataatagataaacagttataaatatattttaaagagataaaagaaaagagagaaaagtaacgggctataaatttgtagccagctacagcatggccttcaagatataatgtatgtatgatagataggaccatatattaatagtatagtaagcaactattatataaattgactattacatcgactataaatgattttagagttagtaggggcctgcactgttaaacttgctcagagagagagagagagagagagagagagagagagagagagcgcgcggcgcctttggttttggttttggtttgctgcagaggggggctgcatttggcctcttctcgctttgcatttttgtggcccagccaagccgcctgtcacctctcccgcccacttgcccatgttgcataccggccgcttccacatttcttacatgcccacgcacctattcatgcatacagccggcccccaccacctgcccaattggacattaatttgcttttcattttgtagatcgatatcctcaaaaagaaaaagaaaaaaagggatggagagggccggagatatatttcttgtaatgattattgtttgccaggtttaatcctctgccatatctagcttgaattttttttccaaatgggctctgaattagcggtcgtgcgagttggaacttggaaccaacgaccacgcgacacggtactggttaggagacaatcgcttgactatagtggttcgatttttcttaagttaatgttttgtgtttttagtcatcgagttaattgtttgaaattaaaagagattgttaatttttcttagagaaaaacacccataaacacaaaaagattgttgttttcccccctatatgttgttattttattaccattaattaattttatatttcttttatgtgctgccactatcagactacagagcttgagggtgagaaaacattagaaacatattatggagtattcagttttccaacaaaaacataattactgccgatcgataacccatagttgtagccttgtaggcgtacacacctagcaaccaccgcctctggctgcaggctgcaactcaatgcatgggaaattaatttttagttccccaaaaaagagatttcttaattttgaattttatgaagttttatttctgagaaatttcgatgttccaaatgagttctaaattagcggtcctgtgagtagaaatcaacctaagtagaaacactggagcggtactaagttagcgacagtttgcatgttcactgtaataatagtgttcccatgttttacgtctttttagtagcaagttgatcatttgaaaaagaaacggctgtttttctccatctctaattttatcctggtcttaataatttttctagtgcactataaaaactactggtagtaattattaagatcgtttaccacttagtttaagataatgcttctgattctctgcgatggctcctatggagatagaccatggaaacagtcttacagctgcatctatcttatcaagacatgagtatacacgtgttgtggacgtttgtgtttgtattgtgtttgttctctgattagaaaaaaaattatactatactatactatagaccttgataaaaggaattagtacaatcaataaattgtggttaagtattttattagtggttatgtaaattaaaaacaacaattaatctcttgatatgttggagaacacatgcatatcaatttatagtagtcttctcctgagaagtttcctattggacgctagcttatccatcagaatataattatgcctacttgcagcctaaatgcttgacacacccatgattcatttctctttctaggaagaaagtttctctttctaagaaccttcttccccctcacacctaattatagacgaatgcccttcgctttcttcacttgtcacaattctgggcacgctttttttagcttttcttattgctagaaactaattttatctgttcctttcttcctccattttgaacatacatatatcacaaaaattccgcccaaaaaataaatacatgttgaacataaatatatacgtctcctaaatttcacgttgtttagagctatgtttaattaattagatgcatccagttagtattatttttcttctagctttttaaattttttttttgtttgctgtcgcggccgccataggattttgcaccttggtccaacagtttttgatttttaataataaattaatgggtgaccagatactctgatcaaaaagattaaatagggatgacgcacacgccaatccgctcaagtgacgacacagtccttgacttccttgaagcacgtgcacgtcaaaccggttagtattatagactaattctttctgtttatgtcactgctaattttattttatctttaattagcacagcttaagaaatcaaattaattataccataacttagggcgtcgatgttttttataattggactgtgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtgtcatcataccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaaacatatagtcaaggaataaataatccaaccaaccgagtggttttgataatcgtaatcaaccaagtgacttgatatcaatatatagcatatgcggtgtgaatcctccaaataacatgatccgagtgtgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgtttgcc

SEQ ID NO: 56344 - DNA, 15898 bp, Oryza sativa
agaccggcgacccgggcgcatttgaatgagcccccaggcccccgccaatcttaacttctatcttgttctttcttctaaggccttcatgcctcttttttgtacaatttaacttaatctgcaatgagaaatgatgaaaaaatttttgtattagttttattttgctatatatgagatgaggatgatctgtgccgtggtctttttgtgtcttagcttgaaataagggcccgtgcccaagtcccagtcctcgaaaagcgcgggtcggggctagtgcctggggagatccgcatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcccgagccaaaacctgatacccgacccccccccctttcaggggtagagtagaagcgacgaaggtgttcgatgttccacgggtttggcagctccgtgccgtcgcccatggccagccgtaccgagcccggccgggggacaccgatcactcgatacggaccctcccacattggtgagagcttgctcaatccagcacgcgtttggacgcggcgtaggatgaggtcgtcgacgcagagtgatcgggcccggacgtggcgctgatggtagcgccgcaggctctgctggtagcgcgcagctcggagggccgcgcgccgccttcgttcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggctcgtttgaacggtcccaggatatcaagcccccagacagcaaatggccatgacagtggtatgatctgcagggcctgggccggctgatggatttgcttggcgtgaaactgacacgctctgcatcgccggaccagatcgactgcgtcattgagagctgtcggccaataaaatccttgacgaaaggccttgccaaccagggtacgcgaggcggaatgggctccgcactcgccctcatggatgtcagcaagaagctcaacgccttgttcctgaggaaggcacttcaggaggattccgtttgccgcgcgccgatagagggtcccttctaccaacacgtagcgtttggaaatgcgttgtacgcgttcactcccttcgcggtcctcaggtagagtcttatctgcgaggtatgtttggatctcagagatccaagcaatcaatctaaaggagcttggagcgctcccttcgggtcccgaggcctggactccgacgggcctcgggggccggtcaggcgcatccgtctcccctaaggggtcgggtcgcgccgacggctgagtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgcacgtaggcgtccatctgcggatcagagcaccggtactccttacagacttggttaacaaccagctgagagtcacctaacaccaggaggcggcggatccccagcccggccgccactctgagtccggcaaggagtccctcgtactctgccatattattggtcgctcgaaagtcgaggcggaccaagtatctgaggacgtctccgttcggagaggtcaacgtgacccctgcaccggcgccctggagagacaaagaaccgtcgaactgcatcacccagtgggcggtgtgaggcagctgagaggggttcgtgctggcctcgggtattgagacagtctctggagccggggtccactctgccacaaaatcggcgagggcctggctcttgatagcgtggcgtggttcaaagtgcagatcgaactcagaaagctcgattgcccactttaccactcgtcctgtaccctctcgattatgcaagatttgaccgagggggtaagacgtaaccacagtgatccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttcgctagggaccgtacccccggggcgttcttcgtccgagtggcccctcggggcgcactcgtcttctgtgccgatgacctcggggtcggaggacgacaggagcggccttcccacagtggcctcggggccgtcctgggggtcgggggctcctggcgtcatcggacaagcgggcaaagggccaactccggtcgtcaggggccttaggccaccgttcggcttgggggcctcttctccctgctctctcccgggtcgaatcggtacagggttagcctcggggtcagagggcgataggtgcggcctccccgcagtggcctcggggccttcctgagggtcgggggcgcccagcaccgtctgacgagcggggagagggccgactccggtcgtcaggggccttaggccaccgttcggctcgggggcctctcctccctgcttgctcccgggccaagtcagcacagggtgggggtgcgcggaatgaggattgtcttcatcgcgctccacagccaacgctgcactaactacttggggggtcgccgctaagtaaagtagcaggggctcatttggctccggggcgactagaaccgggggagagctgagatatgcctttaactgagtaagggcatgttcagcttcctccgtccaagtgaacggccccgagcgcttgaggagcttaaacaagggaagcgccttctctcccagccttgatatgaaacgacttagggcggccatgcaaccagtgacgcactgcacatccctaagtttgctgggggggcggatccgctctatagctcgtatcttctcggggttggcctcaatgcctcgggcagagaccaaaaacccgagaagcttgcccgcaggtacaccaaacacgcacttatcggggttcagttttatgcgggcggagcggaggttctcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaatccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtttagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatgcaagcaagcgcggctttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcagcctgccctccccgggcaatgcacggtgggtggtcggtctggtcgaaagtgagggcaacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccatttcctcgttcgctcggccaggtttttgaccgcacgacagtccgcgagatcgtggagggaggtgttgtggacagagcaccacctgccggcgaggcgctccctgctgggtgtaccagcctcgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctgccactccggaaccggaggagttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcgggccgctgccatgcgtaataccctactcgtgtgtcttgcgggcagacgatctttccagatacagagggagagcgagagcttgagatctcaccctaagcccccggccgaactggcaaaggggggcctgcgcggtctcccggtgaggagccacgagctccgtcatctggcgcgccaggtagggggctcagcgtgtgttttctgagctctcagactcttccgtgtgcgccaagtttttcttgttcagcctaatggccgagcaaggaaaagcgcacgacctctctccgagtgtgagcggcgacgacggggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccctgacccggagtctccagcccaacgatggctggaagacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgtcatccagggagagaaattggagtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgcccttgcgtccagctccttttcccgcgcctcgaggtcagcagcccgctgctccagtgcggctctctcggcgcggacgcattcgagattgcggcgcgcctgctcctcctgcgccgcctcgcgaagggacaggctgtccgccagccgtttggtcctggcctcagcctcctcgagagctcgctcccgctcagcgagtgcgtcctcgcggaggcggagcgcgcactcctcctcggcgcaggcggcctcatgcgccgccagcgtcgcctctcggagaccagcggcggccttgcggtccgtcaagcccctctccacggcgccggcgtgttcttccagcgccatggcacgggcctcaagggcctcctcgcgccgccgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgtggcttggccccccggaggatgcactgggctcggggatgtcccccgggcccgtttggtcctgggcgtcgcccggtgaggtaggcccaggcgatgcgcccgcggcctcgtcgcaagccgcctcggaggatgtcgcctgagggccgcccgagggagtaggcccaagtgacgcgccagcagcagctgtcgcctcagcctggcgagaccgggcggcctcctcccgagcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcggcgcggccccctccgggcgccgactgttggcacgcgccgccccgccccctcggggaggagatgggggaggtgttcctcccagcttcctcttcccctgggcgtcggcagggcggctgctccccgagcccccggcgcggggcccagaagcacgaccccctcctggggcagattgttcccctcggcggcgctcgcccgcgccgtcgtggcccttaggggctctctcctctgaggccccgacctccatcataatggttagaatggaggcgcggtcgggatcgctgcagagggggaggatctcctgaggaatgcgagatgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggccgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgaggaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacgaatctgctcatccagattcgcgcgctgctcaagtggtgtggcagtcttgaatagaccgcccattatggacaaccaaagttaccaataccaatgtgcatggattgagaccgttcggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgtttgccccggccccgagggccgaggcaccccgacccccttaaggaagtctgcgccacatatatgggataagtgagcacagctgtgctcacctaacagcatttattgcagtctggtcaagcgtgtcacactgcatgcagcgcagtacggcgcgttcctttatccggtctgtgaccagtcacagaccggtcagatcacgggttaggtggcgactggcggtctgacgcacgccttaccccatcccgtcaaggtgtgagtttctaagcactcgtccccagctggagctagcgtgttacatcccagagatggcacgttaactccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtcgtcgccgggagtggaggtaggtgtgggctgtcccatcggagtgtcattcggacagcaaccataccaatctccgtccataaagagaagaaaagtccagtttggaaaggggaggggtgcatgtggtatccccttgaagtataaaaggaggaccttgcccatagagagggggttgggtggattcttttccagatttagagcttagaacggggggggggagttggctcacactttgtagctcattcatacacaaatccacaaaaacacaggagtagggtattacgcatggcagcggcccgaacctgtatacatcgccgtgtctcgtgtgtcttgcgggcagacgatctttccagatacagagggagagcgagagcttgagatctcaccctaagcccccggccgaactggcaaaggggggcctgcgcggtctcccggtgaggagccacgagctccgtcagagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacacggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcaaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtaacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgtaacccttatggggaataataaatagtccagtctttaaacatagaaaatagacccatgatcatgaatccatattgcatgtatccagagcaagtccaaattgaaggtatgatacttgtgtttgaactagtaagcccctgagcacgtagtcacaattgttcattgatggtagctgacgcaattggcatagagacaagacgaccaatacagagataatattgcccagcagaggtggcaaaaatattggtggtagtgaagatagtgataccaatcaaaagtgatgaagttgcacagccgtggaggcgaagaaaccagtcggcagcagtcagatcagccaacaatgaatatgaaggcgctcagcaataaagttgtgtaactatggcagcgaaataatcagtcggtgacagacgaggcaaatcaaaggcgatgacgaaatccaccaatcatgaagatgaagaaaatacttgacgacgacaaacgcaaccgacatgatgaagatgacgatgtcggtgatccagccaacagcagtgtagcaaccaatgataatgacaaagacgctcatcagcattgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttataactgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatcctgaatattggagagccacttgttgtagtaaaataacatggcattgcatgccgagatgtcgaggttcacaaagacgtcgtggttggtgaagtagtaaaacttgcgaagtagcaacaatagagtttcccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagcaccagtcggcgacagcataaccagtcggcgacggaaaacgatgatgtttatcagtagtggtagctgtctaaaccagacgtagaggtgagggcactagtcagcagcagacgagacgaccggcgatgaagatggtaaggccaatcaacactggcagaatcatgcagccatggaagtgaagaaaccagtcggcagtcatggcaaacgtaggcagcttgtgttgaagatactgatgcctattagtagtgacagcgatgtagccggccgtgaagaagatagcatcagttggcgttataacaggccagccgtgcaggcggtgacaccagtcagcggcggatgcggcggccggtcggtgaagacgtagacgcccaacaacggcggcataaaggccagccgtgcaggtggaaacaccagtcggcggcggcgaaggcaagccggtcggtgaagacgtagacgcccaacaacggcggcataaaggccagccgtgcaggcgaggacatcggtcggcggcgacaaaggcaagccggtcggtgaagacgtaggcgcccaacaacggcggcataataggccagccgtgcaggcgaggacaccagtcggcggcgacgaaggcaagccggtcggtgaagacgtagacgcccaactacggcggcataaaggccagccgtgcaagcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggtgaaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcgcttcccaaacatgcatatgagtgacatgagtttgtcattaatggaacaaagtttcacggatcagagtttactactcgggtacttttgcaattgttaagagcagaaaataaatttatctcatctctatacttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaatttgtttaaaaaatatgatataacatcaatagcccccgactcactaatcaacggcgaaccagttgatgtagtgaggcagaggaagagcaaaatatcatataaagaatcaatgatgacttagctttgtcgtattccctcggtgacagcagaagtagccgatgtgggaacgaagcagtccatcaatggtgacaaaaacaccagtcggcgccagtggaaccaagccagtggtgtagataatgaagcccattaacggaggcgaagtccaccaaccgtataggcaaaaacaccagtcggcgccagtggaaccaagccagtggtgtagataatgaagcccattaacggcggcgaagtccaccaaccgtataggcaaaaacaccagtcggcggcggcgaaggccagccggtcggcgaagacgtggacgcccatgaacggtggtgtgaccaaccaaccgtataggcgaggacaccagtcggcggcgacggaggcgggccggcggtgaggtcgtagacgcccaacagcggcggcataataggccagccgtgtaggcggaggcaccactcggcggcgacggaggcgggccggcggtgacgtcgtagacgcccaacagcggcggcataataggccagccatgtaggcggaggcaccactcggcggcgacggaggcgggccggcggtgaagtcgtagacgcccaacagcggcggcataataggccagccatgtaggcggaggcaccactcggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccagtcggcggcgacggaggcaggccggcggtgaa

SEQ ID NO: 56345 - DNA, 3356 bp, Oryza sativa
tggatggatgcggagacaaaggatttagacaggttcaggccctctcaatgagaggtaataccctactcctgtttggggatttgaatccgccgggtgtagtatagatctgacgatcaggttgtgtcatcataccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacatagatataagttatcccctatgactagtcggataaccatgccgtatgggtatggggtacccataatatccacagactggtaatcaacgttgatgggaccgctttaccggccgatagccattgttgtcatgttgcaccacaagaaaacaaatgacaaattaaaccctttgttttagagtcgttgtgcttgtgcagttcaatctcactgtgcttatcctgacaatatagttttgttttttacgataaattctcttctactttattaaagtattccatttaattaacatcttaaactatttttcggtttatttttttgtcatttttagtttagttacttaaaaaggttcacttttttctataatagaatagtatttaatttggttttgtttccttgtatataagtactttttaactaagtgagaattttgatgcattgcaacttgtgcctcaacttttttttctctggatttcgtattcagtttctgcatactaaactttcatgaaagatatatcttggaactattgtatagcacaggttatattctcattaatggctctacaaaatgaccaaaaatattttagaatgctaagtgaagcaaggaatagttgaagggagtaaaaatatgtttccctattttttaatttagggtgtgtttgagaaaagagaaatgagaagattaaacaactttcttatagaaatgtaaaaaaaagacacacatgtttagtactcggatgtttagttcgtgaagcatccgagtgaaagatggatttcttctccctttatcctcctaacgaacgcatccacactactgtataatcatctgaattagtctttttttaattttctcctttcatctgaacagcatgataacaataattaatggagataccgtagttatatatatggaaatttaggaaataatttagcagtgatcgactgcatgaataaatactctgaaacgacatacttatatctgcaagttgcggaaaataattaaattaagctagctactctggataagtcctgcacgaaattcattcagcagaacagtcaataccgtttgtttcctcaattcttatactagtgtgaaaccatgccgctgaaagaccaggatggttgcataaggaagtcctggccatattgaaagaagagcaatgcattatgcatatatgtctgaaataatgaaaaagataggttgaaaacagtaagttgattgttagtgcatatttatatatatattcaggatttttaaactaattaatgaaaaaaaaatgaggagtaccaaagaagatattctcctatgcatatccatccccttgggttcctacctagtacggccggacaggcaacattgtaacatgcatcaagtacattgcatcacacccccaataaagcatccacatcaccatccagcaacttgcatgaaacaaaaaaaattaattaataaaaaaatctactagcacctcccaaccacctgtaatatggtgctttgatagggaccaaaataacaaacaaaaaaaagaattccaaaaagacatggtcgatcacttttcataaaaaaaagcacagatatactaccattaaattattgtaattaactaggctcaagatagatagacgtcgtctctactactcctactagaaaacatatctttgtccaagcaaattaacaaaatcaaatatagcaagaacacgtttaattttgtacacatgctgcgtttgggttggtccaaataaaatacaaagaccagtgtctatatatacagagcacacgcccacagcaactatcactcttcatcatcatcttctttggcttctccctcttcactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcata

SEQ ID NO: 56346 - DNA, 11406 bp, Oryza sativa
ctctcatgtccacttgtccactagatttaacttgacatgttcagaataaagttataaagtgtgaagaaccattgtagtatcttttcgacaaatttgctcataaatatgtgcatatagtttttttttatcagaactattgcgggtcagattttcgatctagagcgtcactcagtcagcaaactaaactttcagacatttaagttagcatgcagggtgatcatttatattctaaaacaatttctcagatagagattaaaaaaccactccttgatcgaacttgcaatatttacaataatccatcttaattctcaagctttcttgtgattgatcagttaactaaatatatttaaatatagcaacagtagtgataacgtattcctctgttacctaaaaaaccaacttctgaggatgaaactgaactagtccctaaaaattgtatgttttttttggggtacttaaaaataacagtgctccttaattgcattgtttgctggagatcgagctgcagctataggcctatagctacttgggcaacttggatgaagtacatcaggcaagttgcaccatgagcacgatggaaaggatagcaaggttcagtgcactgaacacaacatttgctgtttcactcactcatctgcctgcagcttgcaattttcatggatcacattaaccgatcgatcgatctttcacatctttattttttttttcgagttgctgtgctctgtacgatctacctgcaagttgcatcaaaacgacataactacgcttgtgcgattctgttagtctgagtactggttgtcgattgacataaatctctctctttcttgacctataaaccaagtagtagctctgtctagctatgtgcattcatgatgcagagactgaaaataataatactactagtagagcttgtcgttctcgacacacatataggatggcaaccttgtaaatcagggtaacattactgtaagttttctctgttagaaacagaggagaatcccacaggttctaacaaagagtactgtaaaattcctcttatgacaaatgttagaatatacttatattttatgacaaatgttgcatttacgaatattattaatttgttgtcgtaagtgattgattttgtgtagattcggttcttttccaacctcaaggggagaataaccccagcttgttgcaattaatgtatcagtttaatttaattaattacgtacaacgagcacgttggccatgtggttagcttacgtactcatcttaatcttataaacttttgcagtgatatcactaaatcgttgtggcattcgaccggcccggtcccgacgactccaaagactttgaaaagtcgtccgagatatagtttctagaagattcttggagaccatcgcagaacgttcgccatagctccacttttagcgatcgatcgagcacagcttaatgcctgattaatccatgtgctaatcgtattgcgtgattatacagtgttatgcattaattaattaacatcttttacagcctcatcacatcgttttgtcttttactactactagcttataattaagccgttatcatgatttaaattttgaaaagttcacttcgagtttttaatttatcgttgtttattttttggtttctaaatttctaatgacacgtatataaaagtttttttcgcgaaaatatattaaacgaaagcagagtttagcttacacaaattaaagcgctattgccgggtgggtgcgcggggggggggagccttggaaaaataaaagaatctaaaaggaaaactacttaaaagagaaaaagaactcctaagacaagggagacacatatatatcttagcttttatcatgattaagccgttaatcatgatttaaattttaaaagtttacttcgaactttttatcgttgtttatttttgggcattggtatgttctaaatttctaatgacacgtatatataactacttaaaagagaaaaaaactcctaagacaagggagacacatatatatcttactttctccgtttcagaatgtaagtcattttagcttttcccacattcatattgatgttaataaatctagacatatatatctatttatattcattaacattaatatgaatgtggaaaatgctagaatgacttacattgtgaaacggaggaagtaacttttattgttgataaaccatttcgctttatataaattacagcatatttcaaacgctgaggctgttagtagctgtatgcggaaccgctgtatgcagatactagctacttgtgtgtactgtaagatcagattaatttgatacagtagtggtattaggttttctttgagaaaaagaaggcagatgcagctagctagggcgacctagctagcgtatagtagtcctacgtacgtgttgttgcttcaagacttcaatgtacaaaggtgaccttggagtatagtaccacaaaatgattcgaatgtagagtttgcgatcgaatactttcaaactttcagttatcgaggtactacgtactactaatatgttataagtaatattaatttctggaaatacatacagtatctaattggtgtgtatcataagtgtgacactagctactagatttgttataaaaaatgcttaacttatcagtatccatattcaaagttatgttaactgctcttgtgctgtttaatcagctttgatcaaaactgaaaagtattttgtagatatgtatacctaatttcctaacgtacggatgctgactatatatatgttgtactttgcattgcgtgatgtagaatatcagaagtagcttaatcaaggcaacatatcgtttgccttttagatcatcagaagctacatatccacaaattttgaatgtcgaaacttaattttagagttgattttgagatatttttcctttttatttttagtttatttttaatattgacttttaaatcactaaggatagaaatatataaaacttttacttataattattttagtttcttcgttcattttttttcacgctttatatatataataaatatcagccgtaactcaaacgatgactctgaacgatgtgtctaacagattaatggagatttatttccctcttgtgtgtttcatccactcctctcttgctttcttctttctagctgttgatccagtgcgacaaagccatatgcatatgcttcaattcagtcagtcagtagctttctaagcaatggtcagtggtcaatacatgctcacgcgcgttgtatgagcaggaaaacgaatcaagtctttgcattgatcttgtagggatggcatgtgtacagacagcaacttgatgtgttgatttccctctagctggctatataatactgtactgtgatcaacaatatgaaagaaaacagactacatttgaataagtggagatttatcctgaaccattactacatttgaatctgcagctttttcagcttgctgcttgcatggtctctctaataagttcttgccagtgtgaaaaaaggtgctgcatcagaaaaaggaggatgaggccagaaaagggaaaatatgttagcagaaagtgttctagaaatagagagactagctactcaatcaagcatcaaattcaaccaacacaacaaggaacatgactacaagagatgattatttgacttgcaacataaattttaaatgcataaaaattaaatttggaagacactccaatccatatttaacttttatctgtgcgcgtgttgttttcgtttaattgtatagtacaattggcatatcatatatagtactcgagaattttgcttagtgtttactatgtactcaccttagaaaattttggctccattttcagtcttttttatcgatctcttctattttccttgttcacccaattttgcctaaaattgataaaattcaactcaagatcaccccttttttttgcgagacaattcaagaattgatttacttcgattctacattgttatagaacacgactcgcctagttgtgacaatgacttacatcaagctagcgcccaagtatgaccgggttcgatctcttctccatcactaggttcacgcggtatgaccacgagaacgcggaatgtgacttggaatggcctttaatatccatttgaatttaaattacattacatatgtggcaatggctaagagacctttagtttaaaggtaatatatatcattgcaaccctataattgaggagcaacttgttattctcctttttctctctctctccctccctcagtctcttgaaaaggctggcagaaaccatgttcattccattaaaaactttctgtcacaaatgaaatcatgcttccttgtcatgaaaacatatttgtcctgaaaattgatacaattttcttctctcttttttttgcgtgcagattgatatgattttcaaagtgcatatcattttattgcactgtaatttctgtcagaaaataatttacaaacctaacaaaattagaacactatagaatttttttcaagataaattcagacatcattcccatccaacataaattaaaaaatattctttattatgttcaaaaagtgttgatacgattttagacctgccggagggggaaaaaactcaaactagctagttcaaaatttaattaaatttaatcatcctcttgtttaatgtagctaggacgcatagaagtcgaagaccaccaaattactaacaaccaatcaatttttttcatggttttatcaaccgagcacgacacttcctagttgcgacaaagacgtgaaaaacacatcaaagtctaggtacgcagcaccccaagtatgaccgaccggccgaccggattttctcgtcgatggctcagcacatatatatctgcacgatcccaaagccctcctgtatatatacatataaataatatttatacgcacctgtataataaaaaccaccagaaattcagattactatacatttctgcaggctgcacagcatgcattcagatacatgaattcttcatatactactactatcaagaggtagtcattgcatgaatgaatgaatgaatccaagacaatgtggatgagcacaaaatgccttttagctcaccaggcaagaatgcagcaacagcagctagcagcagcaagttgcaaggggagtgtagctttccagtggaaaaaccacacagcttgtttggctactagagaggcagtttgagacgtacagcacacagtttcataccgtgtgcgtgccaagttggcaactggatcctagcagctgcagtgaccggctcaagtttccattgccatccaatccaaccaggccaacccaatccaatccttcttcctcctcctctcttgtgtgtgtgtgtgtaagaagaggctagtagagctagctagcctgaaattttttttttgcaagttgctgctactagctgtgctgctggcttgtcatcctctgcttcaactttaaagagagagagctaatagtagatgatggttcaaagaatggattggtgatccacttgggtttcagctgggtgatcatatgcaacatggactagctacttggcttagttcaaaggatctgcttcttggatgctgtccggccacgtcgccatgcatgtcaattctgtggatggcgtcaaaggctgcatgcaaggagctgattttaattaacatgttgccacccacctaattaagcatttgtgtgttaatttattattactttgctactatctctttgtactatagtactcctactatgtaagtgctatatccttgggttttttattccaagctactagcatgcaagcctttgtcagagagaaaccgatgcaatatgccttgttagtttcaagagtccatgcgtaatatgcatgctttgtggattcagtattggtcaagggcaatggatccatttggagtatactagtaagtaattaaacgttgctttgacaaggattagtcggttgttaattgatttccgtcttggaatcaaactaccttttcctggggttagctgatgctgtgatcttgtgtgcacatgtgtttagctgttcatgcattcatggactccaaattatttgtttagttgtacacttgttatgctagaagtgttttgattgatgatgaaaagtgcacacattttatatgagatgatccttacttcttcctggaaggaagctaggatcaagtatatatattatatatgtgtgtgcgtggtttgttcatgcatgttgccgacttgttaatcaattagcagatgcatttttgtagtaaatcaatttgtctatgcatgtgtcattggcggctgaaactttttggcacgttataattaaaatcagcacttgatcaatggggataattaattaaaaaatattcataagttgctagctagctgctggtcttgatattttccggggtagagagaagactaaagaattccacttgccaactagttttcttgagagtctgtacagagatgaaactttttggaaaggtgctccaggtgaccaagttcaattcaccaactgaaatcgttggatttaaatgaataatgcaagacagaaaaagaaatgatttctttcgattcttcattaatactcccggccatttgggaggagcaatatgtacaaatgcatgcatcacacttcagcatttttgtcttttttttcttggagttttaagagtgctcataattaggacatacaagttgatccattggtattttcgcaatatttgacgatttttccatttaaaaattgttgacgatattttgcttaatcttggtagaaaatctcgatcggttaatttatcccgaatttttatctcaagcgataaaatgaaccatgagttgaggtgctaattaaccacaagcaaatagtattcattttaatttgtgatatatatacgaacatgcaaagacgatgatatatgtgaaaatataatggtgctggtagatttgtctaaaacatttccataatactatgatcatggcattcgatcaggtcaaagctaaattttagggattgtgtcattatcaaaattatcaatgtatataattgccagaaggccgggattagcaagggtctactactgtcctgtcatttcattaattaatgagattaagtccccgattccttgcatccctaattggcctacgagaagcgacaaaaatcacaagatgggaagattgtggtaggttcttctacaactgtgcctctcaagcagccataacatattaaccagaagcataaataaacatactttaatctgccatgacagttttgataatatctcatgagacacatgcatataaatcacccataagcaagagtctcctaggtcagtcattgtccacgtactcctgactgcaaaagcttagctaatataatgctacaagcttaaatcgtcaggatatgatagaggctgctaggaattaattaactatgttgatgcacatatacttaattagtataatagcattactagtggtagttaattagtacaaaagcatcaatcaaatggagactaatagctaggagaccgggcaagcaaagcaaagcaagcattgatcttgatgaatactccagagagattggccatttcctcctgacctattatatgcatgcaagtgttcactgtacttctgcggtacaacgacgagcaagagccttcagaagagtgcgtacgtttgtagtactgagcgtactacgccaccaccccaaattcagctgcaccggccaatagattttagaagcaataattggttcatatatgcaaatttggagtacagtacatctctcaatttctggccatgttcagagaaaaagaaaggctctagtaatcgtcctattgctttggacacaagatgcagtatatgtccatttgtatctatatgtgttctgaattttctgacggctgcaaccatatatatgcatgcatggcatggcatggcatggctgtcatcgcttcactgatgatcagtctatgatccattgatcgatcagcactgaatcatttggaacaacagtttggcccatttgaaagaacagtttggcctctagtttgctcgattatgagcagtgccagtactacgttgtacgtcatcgactgatgtcccagcttgattggctgaatcatattgctgcctcacatgcttgacagtgcaggtagtacctaggagtgcacgcagatgataagatgggttttgcactgcagaatcacgggcctccactccagcaaaccggcctgtcaaaaagttcaggttcagtacatttcagcgagaaaccgaatgaattttaccaagcaagtttggacaaaaaatagtactatgggcagaccctgatgaggccaaaccaaccgtatcagacgtgttcagtacaaagcacgtcagatgaaatgataacgacagttgattccaaatgttgagatacaagttacaacagcttttattgatcagatgaaaagggccaaaacattcagaaccagcgtgttgcattcaacagagactgtctggtaaaattgaaggaatcattgctacaagcctctacaagtacttaccaaactcacatgaacaaaaggagatcgtttgagggttgaataccagacctgatcgattgggggccaaataaaacttgggcaaagaacaagcactgaatagaaccgaaaaatgacaggaatcggaaaccagaggagaacaaactatacaagctgcaccacaagggctccacgttaagtattattccttaattaatacacttgtggaaaatttcaagtataagtgacagtaaaaatgaaataagttgacgacagaggagcaatgatagcctaacgcaataaacaggttgtaattaatcatagttaggctatcaattgtacaaatctgtgaatccaacttccaaccagaacaatcgaagtcataaaatatacatttctgtggagcagctatgcataagtgagtgcgcataatcttgtcaaccctcctcgccaaattcttttgtaaacctttcgtgcacctccaagtctttcttgctcactgtcggtctctgcctggcgaggactttctcgaaatctgtccttgagattggtggtggaaggatctacataacaggaaataaatcttgctaatcatcagaagcctcttctaacatgcgcagtggaggaaatgtcaatcaatcttacctttgctgcaaggcccttggatgcgagctcctgcatggttgtttgtacggcaccagattgctttggtccacaaggcatccacatatcaccatcagccttaaagaagaacatggcatcctgtgttttgcggacaggttcaaataacacatcctttacctgttgaaagaaaaaagagcaacgagatttcagtatatgctaacagagcatggatacatgagaatgttgcagaaaacaacttacacaaacagcaatatccgaaccagaaaacccgtctgttcgacgagccaagttctcaaaatcactttcatttaagttgtgtggtgtatccccgagatggacctggataaattaaaggtttgccctcagccaaagattgtaacaacagaacatgacattttcttgaaactgaattggacaattctgcaccttaaacatatgttgccttgctttcaggtcgggtagtggaatgtaaatacgtttatcaaagcgccggcgcacagcctgagataatggatttaagtaagtactaaattgttcaatggaacaagagaattttgacagttctgaatggtgcaacacagttttatagatcttcttaaacctggtctagagcatatggcgtgtttgtagcagcaagaaccagtactttgtcatcattatggccaacaccctggacattcaccagcgaaacaaagcaaaaggtaagtaagttggtgtaacaaaaagggcatctaaatagtttaacaaaccatggaatgcttcagataacaaggaataacatgatacatgctctaagaaaagatggacagtatttgaagcccatcaaatgtggtattcgattattatggtcaagcggtcaagccatgcatcaatatccatgtatctagaaagcaactaatcagccaattcgcatctgatctacttggaaatttagcacgttttcacttttatgattccaaatctggatggaatagcttcagatctggcctggctaatatccctaactaagacacctgatactagtacaactctgtttggacttggtactagaaacctactggtattagaggaagtagccggtccagtacgccagtattagctaaaacggtgtggcaacaaatcttagaactaaaatgtgaaatgaaaatataccatgttcctttttgcccctcaaatatacaagttagaagcactgtttcaataacttgatccttaacgaactatataagtttcaaatataacagcattttgtgcgtctccaattgaagctctgaactttcaggatcattatcattctaagaataacacgtccaagtacacatttaaagtattcaggtagcaggcacctgattaagaaaagttaataatataagctaaaattcacctgcatttgcacaagaagttcagttttgattctcctagaagcttcactctcatttccttctcctcgttgaccacacaatgaatcaatttcatcaatgaagataatggaaggagcgttttctcgagccatttggaaaaggtttgcaacaagtttttcactctctcccatccattttgaaacaaggtctgatgaagatatactgcataaagcaaacacattaaatgaaacataataaaatatattgcacgaacaatacaaatgaatatggtatacattgatattgatcattggcaacatcatggagcaatcaggtagaagaaaaggaatactgcagtttctctttcacagatgtctgcacatcattgtaaacatgaattaagctgtggcatgagaaaccacataaataatcgttggactgtagccactcccagtattaatcacacaatgatcagatgtggtgttgctagataggtatcgcaagtaactgaatctttgaggaattgtgtggtcaacagtgaatacaaactgcttgtgtggttagctacagaactctagtggtaggattagaaaagacctaacttttttattactttggaactgctagcgaaattgaattatcaatgcatacatgatagaccgtcaactgttacaggactgtctcatgaactttcttttagtatgcattggaagtggctgtgtaaaatgttcattggtccggtaatactacattattactactaccatatagctatgcattggaagtggctgtgtaaaatgttcattggtccggtaatactacattattactactaccatataatgctctaaactcaaatccattttgatatcaacacaaagggttagaaaa

SEQ ID NO: 56347 - DNA, 767 bp, Oryza sativa
tctcgagtattatatttatatcagataccactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgaccgccgccgactggtgtttccgcctgaacggctggcctttatgccgccgttgttgggcgtctacgtcttcaccgaccggccgcctcgaccgccgccgactggtgtttccgcctgcacggctggcctattatgccgccgttgttgggcgtctacgtcttcaccgaccggccgcctcgaccgccgccgactggtgtttccgcctgaacggctggcctttatgccgccgttgttgggcgtctacgtcttcaccgaccggccgcctcgaccgccgccgactggtgtttccgcctgcacggctggcctattatgccgccgttgttgggcgtctacgtcttcaccgaccggcttgccttcgccgctgccgactggtgtttccgcctgcacggctggccttatgccgccgttgttgggcgtctacgtcttcaccgaccgg

SEQ ID NO: 56348 - DNA, 1089 bp, Oryza sativa
gacgacgacacgggcatcgtcgtcgacggttgccaggttgttcctctccatcttcttgcagtcgatgaggaggtgcttctccgtcccccacgccgccgccgaccgggagaaggccacggtgtcgcctggtcggaggcccttctccctcacgaatcggctccaccccttggtgagcacgtaactctggctgctgttccagtacgagtaccggaatcgccacaccttgccgtcgccgtcctcgaagttgaggagcacgcccttgccggcggcgtcggagctgtggcggcggagcgggaacgggaaatgcctctcggcctgctgcttgggcaccacgaggcggttgagcttgccgacgtcgctcggcgtcacggccttctcgaacagcggctcgcgcgcccaccgcggcgtcggctgcgcgcgcgagccgcggcggaggccctgctggagctcgtcgtcgtaggtgtgcttccgcagcatgtccacgacctccgccttggagtgcgcggccaggaacgcgagctcgccggcggacgcgccctccgccgccggggcgcggttggtgacggcgtcgcgcccccggaagcggagcgccgccacgtcgtaggcgcgcgccgccgcctcctcgtcggggaacgtcccgagccacacccgcgcgtgccgctcgtagatctgcgccccccaccgcccgttcggctgcggcaccacccccttgtaccgcgacgacggccgcgtcgccgtcgtcgacgacggcagccgcagctccgccgcctggacgacgtggatcaactcgtcttcctccattgcggccaactcctcctcctcctcctcctcttgctttgaatcggtcgtcgacgacgacccacgggagccggagttgcaggagaagacgaccatggcagctcttgctccatgatcgatctggatcaaagatactaaaaaatttctcgagctctctgacgattatgatgtcgacgtcgtggtagttcttgacgaatggaaagagagaacagcctagcttatagatactagtatatatgcgacttggagtggccttgtagctagattggtagtatatgttgtgggctgcag

SEQ ID NO: 56349 - DNA, 1035 bp, Oryza sativa
attcaatctttctgtgaatggaagaaagaggagagtacgtttttgtccgctgtacaactgcccagctacagcaagacagcctacgatgtgcagtgagccagcgacgagcgtaccttcaaagggacatctggtcgtagccgttggtactggatctggtgtacttggtattatattggatggtacgtactagcttgattttgaatacttacattaatttttaagtaaatttcataaaacctaatttttttatggtcaaaattaaagaaaaattacatgtattatgaaatgtgacacctaatctaggtattatggttttaaaatttcacaaaaccccacctttatgcattttgagcgcgaatttacttaaaattttaaaacatagagtgcaaatgaaaattttaattattaatttcttgattaagatcgatagtttaattttttactacttccaaaattttgtttaagatatgttgaaatttatcaagatttcaaaaattgcggagttttatgaaacattcagaccataaaacctgtgatgtgccacacatcataatacctgtggttttccacaactttgacgacaaaatatggggttttctgaaatttactcataattttttacatgctgctaaaatgctagtaccaatttatctcattcttgcacaactttctttgggctatgctgtttctatatatttctaagtaagacaactcaaattagtagttggaatcttggaatacatggattgcttggagaaaatgactatatatattttattttcaaacactttgttatatttaaacataggagttaaactaatttcgtgtggtttgccagtcgaattaaactattattaatatgatttgtatcacatgtaattaatcgaatgaaagattggacctataccgtccaaagttcaccactttagagtagtatcattcgaagtacatcatttcacaataacaccaggggaaagatactactccgcctaaattaacaggtagtcattatccatggcaaaattgcccttcttt

SEQ ID NO: 56350 - DNA, 1002 bp, Oryza sativa
  unsure (1)..(1002): unsure at all n locations
aatgtcacctcccttgtaacttcaacaatactagaggttttgttgaagacacggtaggcatgtgcatttgactcatagccaagtaagaatcctcgtccaccttaggtgagaacttagatgaacaaggcctcttactcaaaataaagcatctactcccaaagacacgaaaataggaaacatttggtttcttaccactcaagagctcatatgaagttttctttagaattttgtggaggtataggcgattgatggcatggcatgcggtgctcacggcctccgcccaaaagatatccgaagtcttgtactcatcaagcattgctcttgtggcttcaataagagttcggttcttcctctcaacaatgccattttgaggaggatcatagggggcgaagaactcgtgcttgattcccacttcatcaaggaatacctccacttgtgtgttcttgaattctcctccattgtcatacccccctcaattttccggggttaaacttcgtaccctcttgatggtgagatcatagaggttttgggcttgcttggcgaagcgcttgaagacatcttgagcctcactcttgtcatagagaaaatacacccaagtgaagcgggaaaaatcatcaacaatgacaaaaccatacttgttacctccaatacttatgtaagccacgggcccaaataaatccatatgtagaagctcaagagggcgtgttgtagtcatgatgttcttgataggatgtggattcccaacttgttttccggcttggcaagcactacacacacgatctttctcaaatgtgacattagtgagcccgaggatgtgttccccctttagaagagttgccaaattccgcattccaacttgggctaatctacgatgccatagccaacccatggaggatttagcaatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56351 - DNA, 9458 bp, Oryza sativa
cactccccgggacgcaaaacgaagcagcgtttagcaagtgattaattaagttttagttatttttttaaaaaatggattaatattatttttttaagcaacttttgtatagaaactttttgtaaaaaaacgcaccgtttagcagtttgaaaagcgtgcgcgcggaaaacgaagagggggttgggaacaactgggaacgaacacagccttagtatatcatttagatgtgtaattatccattggacttatacgttgagttgagagacttatatcctctgggttggtcctgtacctccaattaaccatggggaattcgcatgtttaatatcattctaggttgcttgtgacagttcatgatatagacacagaaggaatttcttaaaaattgcaagtaaaagaatttaaatacattaagtgcgtggagtatttctggctagtatgtatgcactggcagtttctcctacggtcttactagcattcacttttgtactaaacatgtatctattaataatatatccatgccaagaattgactatacttgatggacgacatgacaaccgcttcagttatttcatcggtggtatcgcaaccaatctataaagagacgcttgtattcttttatgatccaggcgtctcttattgttaactcttagtacttttaagtgttggtcgatgcaaagctcaacaagctaatgaataaactaatgtaaatccaccaagtataaattatgattagtagtaactaatcatagagttaaaatgacccttagccgacaactaattaatgaataaactaatgtaaatccacttgtactctcagccaaaaatttttttatcatagatatcaagaaaataaaggggctacgcttttgaagttccatttttagagtcacaactagtttcattgaacaaaatatagatacagttgcatccaacaagcataggatccaatcgttaagaaaagatgaaaaatcacatttaggaaatactatcatctagacaaagcgacacgagcgtgtggccaaaatataatattaagctaattagtcatctaattagcttttgtaaggcctaactgaattagaggtccagaccacaacccataatttttcgatcgatgaagatgtcatagatgatgagcgtcgtagttatataagggtcggacattttagttgtgtgtatagcattttccataaattaattgccaagttgtactcggcggcaacggcagcagcgccggccatagctcgcggggtgttgcaatcgctgctaaccaagcggtgtggaaggaggggatagagaaaagagatacgagagagctgacatatgggtttagggatatttctattatttcacatgatttctcttttcttttcaaccgaaaattattatttgaataggtgtaatgtccactatttataaatagtgttttataactaaaaccataaaatcacagtagataatattaagtggttccaagtgaaaaactcagctaaaacttagcccaaaagctacagcaagggtaaaaatacattgcccaaaataagatttactcgaagtattgcttttattagggtctaacttgaaaggaaattccccaaatttcgtcgtactcctctgacgactccgatgagccgccaccgctcgccgtcccggtccccgctggacgacgacgacctcctcggcgagatccttctccgcctcccgcccattccctcctcgctggcccgcgctgcctgcgtctgcagccgttggcgccgcctcgtctccgaccccgccctccgccgccgcctgcgcgcccaccaccgcgaccaccttcccctccacggcttcttctaccacagcgaccacagcgcccgcctctggcccatcctggagcggccggatcgcatcccggcgtggcgcgtcgcccccacggagaagctgctccctggatggcaagtcctcagctgctcccacggtctcgtcctccacaaggatcgcgagaagttcatggtgcttgaccccgtcgccggcgagcagcacgccgtgcccttcccctcctcggtggaggacacatccgggttcgtcttggggatggtggttccttcacgccgttcttcttcttaccgcgtggtggcgctcttcgccggtagatctaccagcacaagagtagccgcctatgtctactcttcagagtctgggagttggggtgattcggattcccccatcgcgacattggttctaccatcaaaggccaaacatcgagccaggcatggcaccattgtgggcagtgtgattcactggtttcttgatggacacaaggtccttacgtttgatttggagaggcagattctagccatcatcgagctgccgccggaggtggtgaaggatacggattcattctatgaatttcggtgtcagatcataccagcactagatgatggtgttggtgaggttcgtcttgccgttctagctgatcctaacatgcaattctgggagaggaagaagacagggggagatgggagtggtgccgcatacacatgggtgctgagttcaactgttcggctgaacttcccttccattgaatcaatcaggagtgatctgaaatatcaggtcctggggtttgatgatgaaagtaatgcgatctttatatgggtgcagaatgttcttttcatggtctacctcaggtcgatgcagagcagaaaggtgttggatcattggccccctgctgacatcttcccttactcaagcttataaattgcaaggtgtcatatcctctttagactgaccaaattatttttgtaataagttgtcagattattttatctttttacacatgattcaattttgaagtggtatgtggtcaatttgcaaagtatcttcttctatgccaaatagacctatgaaatgcccacttaatgatcatctctgtttctccataaataactaaatgatttagttcatccattctatgcgtgcaaatagatatagtaagtaacagaatgaaaggctggcatgttctgttctagaaaacatgattatgtgtcttggagtcctattagaaataatgaacctaaataacgaacaaagcagtgtctcctatgctggaaattttattcatgcaggatgctgccattttttatatagaccatcaccctctcttgttatgtggtgtttttattttaatataattaactgcattttcctttttacaaacaaaatcaataactagtgcatttgtaaccttattattgtaatatcattgattagcaccaatactctgctttttttccaagaaaaattgttacaactttgtgaattatgaggtatattttggagatgattttgaaaagaagacattgctactcctaagttttgttatcttccagataattattatgaccatgcgtactggttatattaatgataaagtgacaatgaagcaatgccatgtagttctctatcatttttgtgtagactattactaaattgcaatctatagtaaaggaacagaaattcatacttatcaaatatgaacttgacatgcccagcttctctatactgtgggacagcttattttctagtcaatgagttttgtgtatgcattcactcaattattttgtcctggagtagaatgagaactgtatatgccaacattgttttggttgctaagggtctctacatatttaatcagttgtgcaactttgcttatttaagtgacaagtcttagcctgcatagccttcattataagcttaattgtagtattattggacctaactgtacaatgtgactgatcaatttatgacaataaagggcatcgtttgttctagttttggacctttggcatattttattgagttgttttttccttgcttctagatggcagctcgttggtgtataacaagatgattgcacctatggtagaagattatattcgaccatgtagtctgtcagaatggtaatctagatggctgctatgcatttggtattagttgtaggagatagtgtatgccattcaatgagctaaattggaagcatgcagataccatgggaaaataaactgtcatattttgtgttggctgcttattgacaatatgatatgtagtgcacttttaatccccttgtgtttgggtgccgactatcaatttggtaaccatgtgaacctgtgacttgatgcttcaattcgttgtgtaaaactgaatagccaggtctgctgtcgcacttgatgaagcttgcatggcaatatgctgtccatgagtacaatggtttatatgactactgttccctaagaaatgttaatggagtgatgcaggtcttattgctgatatgctgatcatttaaagggcactgcatgtatgaactgtgaagtagttgtgtaactggttgattgcagatatgtgatgccacttgtcttctaccgacgtctaatgtgcccttgatgcttagattgactgcgtgtacggcactatgtgatgaagcctgcgtgctgatctactatgctgtccatgcctagctatatgagtatagctgttcataaaagtacatgttcatgtagatcttttccatatgtgaagtacagctcactggttgcatctctgtgaagcaacttgagattttctgttagtgtgcaaatgtcccgtacgtgatctcatcgttttgtgccattccaaatttgttggtggttcaagatatgcgattgcagagtgctcaataaaattagctccggtgcaaaggatcattcttttgtgatacagccacgtcagggggacaaagacaacatctagctaactggaagagcaagtttagaattgagcatctgcattgcagcactactggtctactgcacgcactttacgaaagcacctggggcatttcattatcctctagctcaaaagtcacgtctaatgccacgtgagacagcgactaggttaaaaccaccacgtaggcacaacaacagtgagcccgccctccaaaactgccaagggagcaaaattacaccggtttaatagttagggggtcagagataccgggtattgtgatacagggatacaaattaaattcgggaaaaagtacacctaaggtcccccaacttgtcatcgagttataaaatcgtcctcaaaccacaaaaccggctacaacgtatcgtccaacttacaaaactagtacaaaactagtccctcggcggttttgaccccggtattgtttcacgtggcggctgagtcagcgtggaacccacgtgggcaccacatggcagggtgtccccgtcagctcctgcgtctctttcctctcttttctttctttgtttttctcctcctttcctccctctcgctctctgctcgtgcataggcggcggcgcgcgcggccgacgacggcggctcccgggtggcggcgcgtgggctcagggcggcgcgagctcgccggcctccccgtccccctgtgtggttggcgatggcggcgcgcggctgcggccatcatcaccgagatcgattcgacgccgccgccatcagtcgctgccgtcggcgcgctgcagtgggccgtccgcaacttcatccgcgccggcgactgcatcacgctgctgcacgtctgcccgtcggcgaggtcgcggcggaggcggcgcagcctacgcctcggcggcttccagctcgccctcgccttcagggagctatgcaacggcatcgcggaggtaaaccaattaatcaatggtggtagttggctcaactcaaaacaaagaaagaagcaatcatcttgttaattgtgaaatggtatgcaggcgaaggtggagatagtggttaggaagggggaggtcggggagacggtgttggcgacggtgaaccagctcaccgccaccacgctcgtcatcggtctccacgacaagagcatgtggcgtgtcggaattttatttgccgtggccgcagcggcgggctgtatcgcggggtggtcggcgcttgagctgctggagcatggcgacgacgactggattccgaccttccccagctcaaggctcagcctcgtggtcgccatctccgccttgtcctcctgctcgccctcgccgccgcctcctgccgacatagcacaaacgaaaatcaagcccaaggcgttcgatgtgcatgtgatagacggcggtaggcaaggtcgtcgcgcggatttactactactcacctgcgtagcatgcggaggcggcgaggcctcgtgttgtccggttgtggcgccggccatgtccgcgagagccatggcggcgtcgagctgagcggattgaacgccatggcagcgtcgagtcttggagcatcctgggcgcggtgagtggattgagggtgatggtggcggcgtattggggaggcacatcggagcggggaagggatgacccagtcgcggggggagaggagcggggaatcgacggcggcgtcgagggcgtggacctggccgaccccctcgtagcctgcaacgacggcggggaggggagggcgaacggggtagacgccctcgacgcggttgaggtcggaggggttgatgggggcggccagcatccgcacgcacacatcgcggttgccgatctccgccggcggcagctcagccaccctgaggactttgtcgggcgggccgtggtggtcgtagaggacggctatggcgggcggggacatcgaggcgcctcgcccttgccgtcgtcgttagtcgcttcgtcgttgacgccacggcggtggcattgcctctgcccgtcccggcgcaggtggaggcgacttccgaccgacacttccgaccgcctacgccgctccccatcgccgttcccacgcgcaagagatgagggagagagagaaaggccgggtagagagataagggggagagagagctacacactgacatgtgggtccctccatgctgagtcagcttgtcaatcgggtcaacacgccacgtcggatgaaatcgtcagcaaaactaccgagggaggtgatttgctctggttttcagagaaggaggaggcattatacccggttttccggttgagggcacacaaacgcaagagatgagggaggcaaaatggacttattccttcacaccaccgtacttggtgtaaggctgggccttaattgggttgagatgggctggccacacgctccccttgtgaactccgccgatatccggtcgatccccttccacggaataggacggtggtcgcaaggttcgatcaagcttcctcctctttgcactttgcttgctggttttgatttttggattccttccgtttgcgtctggattcattgatggcggcggcgacggggtacggtgacgccccgaccgccgacgatctggccgcgtacgaccaactgctcggcctccgccacactcgccacatggcggaggtcttcgccgtgcgcctgccgcacgccgccggactccgcaggccgccgccctgcggcaccatcagcttctgcggcggcaaccactgcaacgacgtcatctacagccgcagccgtacggacgactccacctacccaccgccctgcgacacccatgtaaaacttccaccttgtaggcagctaggtaatctcattcagaaaccggctttcatgcataaaccatcacacttaatttgtttcttgctttcaaattctgaaatataatatatctataatagtcaaaactgtaaaacagagtctaatcctgcataatgtgtaacatgacccaaggaaatgaatccacaagactaatattccgatcgaatgaccagtgattccgaatgagcaattcaggatttgtgtagctcctcaatatgttccggacctgtaattgttggtgctgcatattttcttatttagtgcaaatgaaaacctcaaaatttatgaaatcgtatttacaactagcattcatattaatcaagaaagaaatagagattaattttagtttttaaccaaagtttcgttttggtttagcatattttcactctggacacccttttcaaacatattcactttagtcccattttcctgaataccctttcgctttgggtatataaaggacaccaatgcaacggcattatcgagatgagcatgaccaaggtgcagtttgtaggatcaaatcacaataactaagccaaccagagaggggtgaatggttggtatacccaaaaaccgaaaacttttagcggaaataaaagttaccctcgaaattgacggaagtcggtctgaccgagattgatctgtcggtctgaccgagtggtgccgtcggtctgaccgagattagatctctagtctgaccaccgagatcagctaccgctcgctgtcgccgccgccggtctgaccgcctcgccaccgccggtctgaccgccgcttgccgctggtctgactgccggtatatcgccggttagaccgccgaaacccggtaaaacacaaatcgaagaactcttaaagtagatgacgactttattgattctctctgtgtttacaaagtgcaccaacagcactccctacaaaaatttcgactaaactcgaaaccctaactcaaaactcaactcaattgctctcaaaagcgatatcgggaagcatcacgctccccctctatttatacccgaggtaggcagcctaaagccatgaaccaaacttatactaggagtgctaaacaccttaggaaactctctagtataagaaacaaactttacataaccactcataccaaatttggactccttccgaattcgactccgcatcccatatgcacacaataactccatcgtatgccatatggaatctccatcaaccatgtgcatcaactctagcctaagtatcccgcatgatctctgaccaccaggacgtcgtcttatccccaagctgactcccggtccatcaccgcaaatactctcccgaggcatcgagtcacctacacatgaaataaacaaagaaaccatattccgagaccaagctatcacaacttgagtcattagcagcaaacaatcgtatagtatccatctagaagccataatcatgaaataatcacggatatccaaacaagcaacccaaatccgaaaccgacacagcgtcggccggtcagaccgcgggctaggccggtctgaccgcgcgatacacgccggtctgaccggctactagagcccggtctgaccagtcacatgaaataacagaacctgcgattcacctataaatccaatcatctccaaaaccacttcgtgaataaattctaaatatcaaaaccaataatctccgatgccaattgttcatcacagaataataatcaaaaacacctttgattttacaatctcccccttgatgaacacattggcaaacccatcaaaaatgttttggtgtttggaaaaaaaaataaaaataaaagtggtaaaaagcacacttcgtacaaacgtacatatcgtgctcaaaaattcaaaaatccaaaagaaaacttcttcccctttctaaaagaaagaaattcccaattgaaccaaaaacatgctcttcttaaaaaaaaactcttcgct

SEQ ID NO: 56352 - DNA, 25301 bp, Oryza sativa
ataaacactaaacacatatacctattgcatttatcactctttctcaaataacctttagcacaaaacaacaaagagaatttttgaactttttcttttcttgagcctttttgcttatatttttctcttttattccgggtacgtccctgtcatcaagactgtttccagggattcggcacctattattttgctcacatcgaatacgtccttgtcatcaagactgtttccgaggattcggtattcattttttttatattttttattctctttttcacaatgagcaattaaagctatttgaggaataacaattcaataaagcatatatatagagcatttataaatcaaaccatatgctagcatcaacattgcatatttacttaattcaagtatagaatttaagtgccatgcatcatcgcccttaaaagcaaaatctaaatctcatgaaaagactagaatacatacaagctatgctagagacaaataaaccttcaaaatattgttagcatgcacaagaaaataccatatgcataaacaaagctctattttctcaatttttctcattgtcatattattgcttgataaaaccatgaggtacaaactccccctcaaaccatgccaaaaggatgaattattcccaattcaccacgaagaaaagcaaaacgattagaatcgaaaagtttagtgaaaatatcagcaagttacaactttgtgtccaaaaactgcaattcaacatctcctttctcaacatgatccctcaaaaagtgaaaacgaatatcaatgtgctttgtgtgtgaatgttgaacaggattcttagcaaagttaatagcacttgtattatcacaaaagagaggtactttctcaaaagtaagaccataatctttcaaagtagataaaagccaaagaatctgtgaacaacaactagcagcaacaacatattcagattcagcagttgattgagcaacactagattgtttcctagaagaccatgcaatcaatgatgtaccaagaaatgacatgttccactagtatttttcctatcaattctacaacccccaaaatcagcatcagaatatccacttaagcatatagaagaagaagtagaataccaaattccaaattgaagtgtatgattcaaatacctcattattcgcttgaccgcttgacgatgtgaagcacgaggagaagcttgaaagcgtgcacacaaacacacaacaaattgtatgtctggcctagaagcagttagatacaacaaagatccaatcatacttctatattccttttgatcaacagcttcaccatcttcatcaggatccaatacagctgtagaaccaattggtgttgaaattggcttgcaattctccatcttgaaccgcctcaaaagatccttcgtatacttcgtttgatgcacaaatgtaccttgagatgtttgcttaatttgcaatcccaaaaagtacgataactcactcatcatgctcatctcaaattccctgcgcatagtctcagcaaactctacaaccaaagcgtgagttgaacaaccaaagataatatcatccacataaatctgaacaaaaagttgattatcaccatgcttaagaacaaaaagcgttttgtcaacctttcccattgtaaaacctttcacaagcaaaaagttcttaagtctatcataccatgctctaggagcttgtttcaagccatacaaagctttagacaatttgaaaacatggttggaaaaatcaggattttcaaaacctggtggttgtttgacataaacttcctcctgtataaaaccatttagaaaagcacttttcacatccatttgatacaatttaaaaccttttgaagcagcaaaagccaacaaaagtctaattgcctcaattctagcaacaggaacaaaagtttcatcaaaatccaaaccctccacctgagtaaaaccttgagcaacaaatctagatttatttctcacaattaaaccatcctcattttgtttatctttgaaaacacacttggttccaataatattatgtctagaaggtggttcaactaaagtccaaactttgtttctctcaaaattttcacgttcttcatgcatggcgttaatccacgattcatcagttaatgcatgtgacacatctttgggttcaaaaaaagcaacaaatgcagaatttgcacaaacatcatgagttgttaccttagaccttgtagtccgctcacctatattaccaataatttgttccggcggatgttgtcgttgaatgtgcaaaggagcagcgacttctgaagttgatccacgttctgtatcagtactggtcgaagtagtaatctctggaggaccatctcgatcagcatcaacagtacctgaacccgacgtccctggccggtctgaccgctcctcctgaggcggtctgaccggagttttgccggcggtctgactggcctgacgcccggtctgaccggccgagccgacctcgtcgtcgtcgttgtcgtcgctctcgtcttcaaaaatacgaccatcctccccctgaacctgtgactgtgtacctgcaatatcgggtctagttcctggactagcctcatcaaaaaaaacttcgcaaatctcaatgattttgttagtctccaaaataagtacatgatagccacgaatatgtgcggggtaaccaagaaacaatccatcggtagaacgtgcctcaaacttatccaaatttccagatttcaagaaaaagtacttgcaaccaaaaacacgcaaatgtgaaactttgggttgatgtccaaatcgaagttcataagaattttttccaagtttagatctcaagaaaacccggtttgaaatataacaagcaacgttaatagcctcagcccaaaattttttaggagttttatattcatccaacatcgttctagccatctcaaccaaaacacggtttttcctttcaacaacaccgttttgttgaggaacacgtggagaagaaaattcgtgttcaagacctttttcggtgcgaaattgttcaaaagaaacatttttaaactcaccaccattatcacttcgaattcttttcaaagaaccaggaaattcaagattcaatcgaagaaacaaaccacgaaagtattgaaaagcttcgtccttagttgccataaagaaaacccaagagtatctagaaaaatcgtcaacaataaccaacacataccactttcctccaacagattgcactctagctggaccaacagtgtccatatgtaatagttgtcctggtgcatccattatcacagaaacagtaggagcatgtgaagaagcaaacatcttacatgacgaccggtgtacaaaccaaatcaagatctttcttaagtttaggcaaaccacgaacaagatccaaaccacttaacctagtgagatgatcaaaacaaacatgtccaagtctacgatgccaaaacatcacatctttatcaaacttagcaaccaaacatgttatcacaggtgaaacaggattttcaaaatcagttttaaatactcttccatagcgagaaatattcaacacagaatcaccacaagaatcgaaaactttacttccagttttcttaaagtgaacctcaaaattttcatcaacaatttgtgaaaccgaaagcaaattgtactttaagttctcaaccaaagctacattcttcaattcaaatttttcatttaccttaaccaaacctgtagcgagaatggcacttgtagaggcatcaccaaagatgatcaattcagtctttgatgccttctgaagtgaggagaaccaatttttatcaccggtcatgtgccgcgaacaaccggaatccacgatccacacgttttccttccttgccaccaaagcctacacacaagcagaagtcgaagcctcagtactggggttagaagataataaaaatttaggaatccagtactgagacacatgaccagtagatccaataggcatatatccatgtgcaaaatcaatttgagaattttcagaaaaattcctccgaggccggtttgaccgaggtatagtggccggtctgaccgggggccggtctgaccgcttctgtaccaccggtctgaccggtgcccggtctgaccaacgctcagtaccggtctgaccggtcgccggtctgaccgcgggacacactgcgatctgacctgtttcctcgagggaaaacccgatttttgccactttaattttgcaaaagcaatctctctctcctttttctgtttgtgagctaatctgaaacaaaaaccaacaatatgtccatcttttccacaaaaagaacaagtatatttttcacgatgattagacacattggtagcattagaagatttagcaataccagcaacaacaggagattttgcatgcacaacattggattttgaagaagatgcattcaaggtaaacatgataccagcagatttaaacacagttttgttagtatcaggtttaaccaaaatctcaccacttctagcaccaacacctaacacaacaggaggatgtctagaattatgagcataaggattaaaacctaaaccatggttatgtgtgctaatctttgattcatccaaaatcatgttgaggttctttttaccatcagaaaatcttagcaaataatttttcaaacaagaaaactctttttccaaattagcacaattttcacaatctaccatgacacctttgcttttacgacatttagggcaagaaagcacttcattgtttttcacaacatcttccatgaactcgacacgacctaaagcatctttcaatttcaacttattcaaattacatgttgagcaatccaaaacatcatgaggttgttttaacttcttagcaaaaatcatgttaaacatcaaactagcatgaaaagcaatttgatatttttgcaacaactttttagttaaaaacaactcatccaaagtgcgtgtatgcaaggcaaaactacaagcaagagaagatctatttttcaaatcatgtgcagcattaacatctttaatttttgaaatctcattcattaaaaccacacaatttgagcaatcatcatcattaggaataagagattttaacctatcaatttcagatttaagagattcaatgataaattcctgttttctatacatcttctcacacttcttattttttgcactcaaaatattaatagcttcctcaaaagcacttacctcattatcttcatactctgtatccgattcaccacgcgccatgaaacaaacaccggagatgttctttcccttgtcatcatctccactctcaccatctacatcacttagtggctcgaaggcggcgcaaacttgttaaaaagccttcctgagattctccagcttcctcccttgggatgaaccctttggcttgatgttgttggtcttctccaaagtcaaagtagacatgttaacagattcctgaatagatgtaactttcatctcccaaatagacatatcaagaccattcaaaaagtgacgagaaatctcagattgtggataattagcatcataagaagaatcaacagatctaagatcactcaaaattttattaaacctagaaagatagtcatccaaagcttctccaggtttcatctcaaatttaatgtactcctttttgaaaatatcacgacgaagttctttaatgttttttgttccttgatgaaagttattcaaagcattccaaatttcatgagcagttcgaaaatgcgcaacacgatcataatccgaacgagaaataccactcaaaagaatgttgcgagctttgcaattttgttcaaaaacaaatttttcagcagcagtattaatagcttcaggaatcacataaggatgagaaacttttcttcaaatatcataaacttcagccataatgtaagattgcatcctactataccaatgagaaaaatccgttccattgaaaacatgaggcttagttgaaaacctaacaggagtagccatggcaaaaactctagatcgataaaaatctaaagaagaaacaaggctctgataccacttgtaggatcgaatcacaataactaagccaaccagagggggggtgaatggttggtatacccaaaaaccgaaaacttttagcggaaataaaagttaccctcaaaatcgacggaagttggtctgaccgagattgatctgtcggtctgaccaagtggtgccgtcagtctaaccgagattagatctccagtctgaccaccaagatcagctgccgctcgctgtcgccgccgccggtctgaccgcctcgccaccgccgttctgactgctgcttgccgccggtctgaccgccggtatatcgccggttagaccgccgaaacccggtgaaacacaaatcgaagaactcttaaagtagttgacgactttattgattctctctgtgtttacaaagtgcaccaacagcattccctacagaaattttgactaaactcgaaactctaactcaaaactcaactcaattgctctcaaaaacgataccgggaagcatcatgctccccctctatttatacccgaggtaggcagcctaaaaccacgaaccaaactcatactaggagtcctaaacaccttaggaaaccctctagtacaagaaacaaactttacataaccactcataccaaatttggactccttccaaattcgactccgcatcccatacgcacacaataactccatcgtatgccatatggaatctccatcaaccacgtgcatcaactctagcctaaatatcccgcatgatctctgaccaccacggacgtcatcttatccccaagccaacttccggtccgtcaccgcaaatactctcccgaggcatcgagtcacctacacatgaaataaacaaagaaaccatattccgagaccaagctatcacaacttgactcattagtagcaaacaatcgtatagtatccatctagaagccataatcatgaaataatcacggatatccaaacaaacaacccgaaactgaaaccaacacagcgtcggccagtcagaccgcgggctgggccggtctgactgcacgatctgaccggtcacatgaaataacagaacctgcgattcacctataaatccaatcatctccaaaaccacttcgtgaataaattccaaatatcaaaaccaataatctccaatgccaattgttcatcacagaataataatcaaaaacacctttgattttacacagtttacggtggtacacggagagtaatcttgaggatgtggaaaaaaaaggagtccaaactgaaacaaaaaatgtataaaaaaaggcaaaaataaaaatatgggctaaatggtggtgtaacattgaacttcgtaaggagtccagtttgaaattttcactcttaaaattatttttgtgggattcaatatatttttatgaaaatcttgcaaaattcatgcttccaaataatgtctatgctagtttcaattggattttttttctcccaaaacagggcaacatcatgctaactggtccatcgtttgccacctcagcatatgcccccatcatctttaccctttgtctccatgacggtagccaagaagaggataacaatgagaatgaggtggaggtaatatacaatacctgcaacggtctcttcaacaactacaacagtaccataatcgagacagtcaacactgggtatggtcccgctgaggtgagctacgctgtgctgaccaacgccgttgaaggacaggtcacagtcaagctggtccgtcgagatgaacacaacgaccccactgcaatcaccggtgttcttgggaggatcatcacgcgcagcaagctcctcaatgttggttgtgtcctgttctacagcgactttggcagcatcccacacataggatcagacgggttgatcccattggcgaggcgtgcgcttgcagtgccagctatgatgccgttggacttgcgttcttcttccggtgatgagattgtcagagctgcagtcgagtttgaccctacgactagtgatcaacatgtggaacgtgttattggaatgggtggtcatgagatccaagtgacaatctcatggttggacttcccttggtagtgccctcatgaccatttactagtatagctactcatctgagagcactccaaagtagagcaatttgttaatcactattagtggtgctcttatcatttcttaccatttgaaaaggagactttactgaataaccgtcactcatcttctaggttcgattgaaccatatgggacgaagcgggagagggaggcagcgggcatgccggtcaccgtgggttacaccaatcagtccctgtgaggtagcaaggtgatattgtatgggagttgatgtgggcacgacatgccgcacccttcctattatttcggttgacgtgggcatgtaggaggctgcatgcagggccacgtccttgtggtatatgcagatgagttgttctccaactgtttcatcttgcaacataaatcatgatattggttggattcaaaagtctgagcccacttggataggcggaggaacccaaggcgagcccggagcaggatgcatgctagggccccgagacccctatgctataccccggggcagccacatgcctatggcacaatgtgtgtccggggcacgaatttggcccagggtagttggatttatagcttttctcgttacttcggataagcttctcaaagatgtcattgatgaacaagttctcaatgtacaccgcctgtggagggtgcaccaagtcaccagctgtctcctcagcaccttgatatagagcttgtaggtctcaattctcttcctggcaccttggtgatctaaatcttgtgggtctctagaaggtgtagatcttgtacatctcttcaaaaagttcaaaacctctattgccccaaagaccccggagggctgaggaccctagtccccgttcctccaacacatgtgataaaaccttaggtcgcaaggaagaagcatatttgtgacgggtgcttatttcacccgtcaaagataactgacaccatagacggttggggacttgatatagagatcagagcagctcggcatagagggtgctctagtgtggaggagatagctagggtaggtgctcgcagtagaggagatggtgacccacacttagagtggaggagacgatggctagtgctccgaattggaggacggggtggtagcgcttggatgcatgcaactttcgggagaaaggcagatagacgagagaggaaaacagagagttcgagatgggaagatgaggtcgatctagagagaaagaagagagacctgaaggccatgttaggtgcatgtgatggtatgagaaattggcttgtcagagataatattttatctttaataggtcattcagatatgaccttaaatctgtagcatgtcgtcctcgtcgtatctcaaacatgtccaacccatcaaagatgaggtcatgtgacatggatcacattgatccgtcatagatgcatgtttctgtagtagtgggtaggagagggcactagggcagttggagcacatgtagcaagtgaggtggtcgtgatgttgtcggaagtaacaaaaatggttaattagatccatgccactataactttgacgattttgaaatatgccattactatttatcaatttagaggcatgccattataattctatagttatttgaaatatgccactacttaccttttcaatgtaatttctagaatttttggaccaaattacccttcttcctcctttctcccctctctcctgttcatcttctctaccaactagatccctcagctactaagctgaacatcaaagcagcaggtagcatgcctactatgtggaagcggagcagctactgtggacccaattatctaggcatacgcagcaacgatgggtcaaaccaacaactactccaatcaccaggacaaggacccaatatgaattagctgtcatgttgctacagtgttgcatgtatcaatatccaccaaagcacttgatttcccatagaagaattaagatgcagcggaatcaaattggtggcctaagttactagccggtcgttggttggtcctcggacggcttggctttgcgacgggcacggcaacgggagggattcgagcaccagctgcagcacctcgtacccgacctccgcctcctcgctgacgaggatatctcccacagctctagtctgtcacccatcgcgtcgacggcccaacgtgtgaaaatgccccgcaggaaggggctcgcgcagagagcagcatcagtgcaccggctggtcggcatcactgggtgaagaaaggggatgcatatgttggagaagaagaagaggagacggaggaagaagacaagggtaaattggtctaaaagttttagaaaatacattgaaggggtaagtagtggtatatttcaaataacagtaaaattgaaatggcattactctaagtagatgaatagtaatggtatatttcaaaaccataaaagttgcaatggcatggatctgattaaccctaacaaaaaaggggggatggtcgtagctggttccaagaccatgggaatacaccaaggctgttttcgagaggagggattggccaacacacaaaacaaagttcgtattagcataagattacttaagtattaactaaaataaacttgaaaatggattaatataatttttaaagcaacttttctatagaaacttttataaaaaaaagtaacccttagtagtttggagagtatatgcacgtggaaaataagggaggtgagttgaaaaaagagaccgggttgtgaaacacaggaagtacgaagtagtagtatttattttggggttgagtacaagttatggtcatgacacttcaccctggaacctagtagaccgttggctcctatcttcaagtggtgaaggggcggaagctatcttcctgcgcaagctctcctcagcttttttttttgcagtaagctttttactttgtggtttcacaaatatgccatccgagtcccgtgccgtaattaattatagtttttcattaaaaataacaactttgacatgcaactcacatatataattaaaacaggcaactattcgagggattgaataattatgtttgagtgtacaaccacacgtacaaccatctataggttagatctccctcgaaaaaaaaaagaatcatacaacgtaggagcacatatggtagatagtacagatcatagtagcacacaaatatcctttttcaccgagatcgttgtatggaaataattgagtaaactaattaacgcttagttgggtatcaacgtgtagagatgttctggatcgatgcaattggatctccttgaagccacaattgtggttgtcgctacagagaatcctcgatcgtctctatacaattcagcgctccctgtaaaagtgaaagacgaatgctatagccatatgtccaaaaacgacgtaagtaacgcatacaacattactagctatcgctcaaaagttaattaggcctactcaaaccgtgttcattcctgggagaaatactatggaaggggtggttattttacatgagactttacatgaattacatcgcaaagataaaagtggtgtaatttttaagattgattttgagaaagcttatgataaagttaaatggccttttgtacaacaaactttgagaatgaaaggcttttcttctagatggtgtgagtggatagcttttttttgttcaaggtggtcatgttggtataaaagttaacgatcaaattggtaatggttttcaaacttacaaaggtcttaggcaaggggatcatttatctcctattctttttaatatagtagctgacatgcttactctattgattaagagggctaaagaggcgggactcttgaatggggttattcctcatcttgttgatgatggtttgtctatcttgcaatacgcagatgatactatcatctttttggagcatgacttgcaacaggcaaagaatttgaaactgattttatcggtatttgaaaagttatctggcctaaaaataaattttcacaagagtgaattattttgctttggtcaggcaaaggaatgttatgaacaatattctgatatttttggttgtaagttaggtacctttccttttaaatatcttggaattccgatgcattttaggaagctttctaataaagattggaaacttattgaagagagaattgagaaaaaacttagtagttggaaaggcaagcatttatctgttggtggtaggctggtgttgattaattctgttctttcaagtttagccatgtttatgatatctttttttaggtgccgaaaggggttcttcgtaaaattgattattatagatcgcggtttttttggcaaggggatgaccataagaaaaaatacaggctcactaggtgggatgttgtttgtcaacccaaggaccaggggggtcttgggattcataatttggagatacaaaataaatattttttaagtaaatggttgtttaagttaattaatgaggaaggggtttggcatgatttattgaaaaggaaatatctctataataaatctataacccaagttgacaagaaacaaggtgattcccatttttggtctggtcttatgaatgtcaaaagtactttcttaaatatgggttcttaaattgtcaatcatggggaacaaattagattttgggaagatagatggattggtaacttagcttttaaggataaatatccatctttgtacgtaattgttcggaggaaaacatcttctattgccactgttatgggatctgttccgcttaatgtttctttcaggaaagctttagatggtcagaatcttgtttgttggcatgagttgtgtgcctctatagtacatattcagttgaatgattcgtctgatagttttagatggaatttccatcagaatggcttattctcggtgaggtctatgtacctagctttaattaatagtggctatatcgagagaaacaagtgtatttggaagcttaagttgccacttaagattaaaattttcatgtggtacctgcttaaaggggttgtgttaactaaggataatttggcaaggcgtaactggaatggcagcttgaggtgttctttttgtttgaagaatgagtctattcaacatctctttatggattgtcattttgcgaagtttctatagagagtagttcagttctcttttggttttaatcttccagttagcatatctcatatttttaatgggtggcttttggagttgataagaaaatgagtaaactgatacttgttggagcttttgccatttgttgggcaatatggctgagtaggaacgatatggtttttgacaaatcaccatcattttcctatatgcaggtcattttcagggcaactcattggctccggttttgggcacaactacaaaggtgtgatgaagatgaagagtttctgaatgttgcatgctgaaagttggagaccacggttatgcaactttttgccaattatggttggagatttacaaatagacttcaataattgtgatctccttatgttaggctgatttctttatttttctcttcggtgtgttctattcatttagatttacactatgttcataaaaactactatgtaataattggctgtagctcttttgagtaaaggccgggatattatattccattatctaaaaaaaacaatattactagctatatactcccttcatattttaatgtatgacgccgttgatttttcgatcaacgtttgactattctttttttcaaaatttttttgcaaatataaaaatatttatgtcatgcttaaagaatatttgatgacgaattaagtcacaataaaataaatgataattacattaaattttttgaataagacgaatggtcaaacataggacaaaaaatcaacggcgtcatatattaaaatatggagggagtacagaagacgaagtaatataactaaatgcatgcaacatttcaagtagggcgctagctgcgagttcaatttaccttgggaagtccggtgaccaggtgatttcaagcacagtgttgccggcgccggcggcgcggggtgttaaagcatgcaatatttgttttgtctgctgcttaccacatacaccggcggcgaactccagcttaccttcactggtggagaaaccatctttcgtcggtcggccgatttccacaatagtcccggatgcaataaaaaccggggctaaagatgatctttagtcccggttcaaaagagaaacgggcatatttgatctttagtcccggtttgtgttaccaaccgggactaaagatcatctttagtcccggttcgaatgctgtcaggacctgtcaggcccccccgagatctttagacccggttggtaacaccaaccgggactaaagatcttaactttagtcccggttggtattaccaaccaggactaaagatcccggtgatctttagccccggttggtgctaccaaccgggactaaagatcttaactttagtcccggttggtaataccagccgggactaaagatcccggtgatctttagccccggttggtgctaccaaccgggactaaagtcccacccctatatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggctttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgttgatggtaacgacgttgcggatgatcttggtcagatgttggaggacgccagggaggactgcgaaagtgaaaaggaggcccataaattggacaagatgttggaggaccacagaacttcgttgtacccaggttgcgagcaggggcacaaaaagttggataccactctagagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagaccccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaaatacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaagaaggttgtatacatgggtcatcgtcgattccttgcagcaaaccacccggtatggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccatgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaataaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagatgtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggaaacaaagaaaatgccgccaagaagaagtaccattaccacttggggtcaggaggctatagcgtcgcgatgccgaagtgggagcagatggaggctagcttgattgagaggggtatctaaccggcaacagccaattggccggaacgatcgaagttctggtactatacttacggtggaacgctcaacccagctgatggctcactggtcttcggcgatcagatacgagaggctgcgcgacgactaacagatgcagtggaagcctcctctcagggcacgttccaaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggagttggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatttctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctcggctccgccatctcctcctcaggatcctgcaccgtctcctcctcatgctccgccagcaccgactcctcctcaggatcctgcaccgactcctcctcgggctcctacacctactcctccgcaagctcctcttccggcaccttcaaagtcaagggcccccccagctccaccgcctgtccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaatcaggagatcgagccgttggtgaccggtaaagaaatgacgatagaacaatttattactgacactggtctaactacggatcaattgctaggagtcgcaccaatcgaaaaggcggaagtgaaatacatgtacgaactcggtaaaccgcttatcaagcctgagctgctgcagtccctacccacacaaatgtacaagttccatcagctgtacatggagatgagcgccaccggtagagaaatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatatgtataaatacatatatattatgcatgtatatacatataatataatataatatatatacatatatatatgtatgcatatatatgtattgaaacatatatatgcatggtttatatatatatatatatataaaccatgcagcaacagggccatgcaaaaaaaaaaaggtcagctcgatctttagtcccggttatttcacccgggactaaagatagcgatctttagtcccggattgtccaaaccgggactaaaagggggttacgaaccgggactacaaagggtttctccaccagtgaatcttacgatttgttaactcagggtacgtacatatgcttgagatagtaagttcgatatatatatatatatatatatatatatatatatatatattgctttttttagttgatctggatatagtgtgatcttgcatgcatgataaactgccacctgatcgagatgtgatccaaactgacgtacgcataaccggaaaagaaatacagatcgatcaatgcgaacccaaaagctatcgtaaaatttttaagaaatagacatctaagacttattaattaatgttactttaagtaaaaacttttactcctgattagtatatttgcgtgcacttgtgctgctgtcgttatttgatgccgtttgcatgtgttaggcttccttcaggcgacgacaccagcaacaagagatcatcagtgcagatggcgacgacgctggcgaaggttgggcctttcggtgcgggtggcacccctgtcgacattgaccacaccttgccgccagatcacctcaagagtatcaaaatctggtacgacgaagatggaatcaacggcttaaagttcagctacctccacgccgccaacaaaagaaagctcaccaccactcgcgtttggggcgacgatagcggtagtagcgatgaggtatgtatatatgtgttctgcatgcgtctgcttgctttctgatttgttattctccatttttaaaatgtactatgccgttaatttttttttctaacgtttaaactttcaccttatttaaaatatttatataaaaataatttattttgttaggattttttttatcatcaaataaaataaaatcttaacttataattttacatacttgcactaaatttttgaataaaataaatagtccaacgttgtgtgaaacgttaacggcgacattaattctgaaatggtgggagtggtcaaacgttaacttagctagtcccctgtttcaaaaatgaaatatgtttctgtttaaattttgtatagaatcaaaatttttaagcacgactaatataattaagtttatagaaataataataatatttgtaacattacattagttttattaaatatcattaatattttttacaagtatgaagtgatatcggtctctaaacttgtctaggtatgtcatctaggttttgaactctaaaaatgtattttcggatcttcaaacttgttctgattgtcatatagatccaaatgagctccaatacgatccgtgcgctaacatggcttgttacggtggcacttatatatcagttggacaaccaacacattagtcacatgggaaaaaactaaaattaaaaaacatcttttcataatcacatggaagcaggtagaaaagaagtttttaaattttatatctttctatgtgactgacatatatatgggtatgtaggcagtaccatatattgctgcgttaacacgtaaagcggggttgctacctgtttgaacctatacatcacagggcaagttcaagtttgaggacgacctgaaaatgcattttaagaatttaggaaactagatgacatatacctacataactttagggagcgttcttgcacttaactctatttcttataacacatttgtttggtcattctattacattttttctatgaataaatttattcaaattaagaaaaaaaaatttggcttagcaccaaactaattaacaaacaccttaattacgttttggagcggagagagaattaatagttagcacgcatcgataaataaaaacactaatatttttttcctcttgcagattaatattgaagatgatgatgattacgtgaataagctggagggcaggactgacggccgtacaaaaatcaagtctctcagaatcacgacgaaaaacaataataatcccgattggctcggggacaaaaccaaggagggcgattatttcagcgtgccggtggaggatggccagatcgtggcgttcttcggccgcaccgaccagtacatcaacgctctgggcgtctacatccttggtaccccttaccagcaatccaccccctagatcgatcgatccatccatccacacacatatattaatataagtaaatgtctacttacatgtgtgcattaattacgacaataatcgtaaatgcacgcatgcagctaaggacgttccgccgtcagtatagtcatgcatgtgtgcacgcatgcatggctcctgtattttattggtgtggctttcgtttccttttcatgtatgtgtgtacgtacaccaggcgctttgtatctgcttatcagctgtacacatcgtccgtcctggttgtttggctcgtataatgcaactatatatgtgtggtaatgaataaaatatcagaaatcagcaagcatatggtatgctaatttgttttctgaggtatcaatcaacccgtctcaacgctcctttaatttgattacaattaatatactacttcctccgtttcatattaaattgtatatattaatatgaaacgaaggaagtaaattatatcctccgccttttatatattcttttggaacccacctcaactcctgccccgccgcctatatgccgtcgaaaaccatatgctcacgaattggcatgagtacatatatataaagggcaatggtccgttgcaccgagccggtatgggttttctgttacatggacgtggacgtgtggatgttgttcttttttttttccatgatgttttttaattatccactaatatgaaactattgaattctgttgaattagtgatcgatatgcaccttctcttggaatcagtgaaatgaaataacattttcttaatatctagcattttattttattttattttcttgtgaaaaaaatcatccccggaaccagctccagcatgacgcatcatcgcttattctttcttttgtgcttgaggcactatatggaaccacaagcacgttgtcagaattaatcccgctgcaccgaataattaagctatcttctgggcagagcgaataagctggccttttatggtttttaattacttgatgattcccctagctagttgtaaatgcctggaaggctggaagcagcatctatccgccccaactctgttactcctccatgccaaaatacttatctgtatagtaatcaaaagtttttccaaaataattgtcaccttagagtactacctatcacataaaccactttcaattcaaatttctccccattctacccctaaccaccatcctacatccaaatgtacattatttaataaggggtattatagtctttttatcataaccttaatgcatgctaaacaacctagaatgacaagttttataggacggaagaagtatttcagtacgctacttagaaaaataaagtacttgtagtcggtcgaaatcggtcttctcaaacagacgcctggtctacctgtaggccaaggcctgcaaaaatcaccgattttcattggtggacggccggtctgcttgagaagattgaagagaacccagggccccgccctaggaagaagggtagaggtcagggccaccagcggtaatagtcaaggccgccacaaaattttaaatctcccgccaaattttgtaataatattgtaattaattagttaattaatacattaatactattaggcactaacaaacatttaatattgacataattacgtacaatgtacaagtgaaaagtatcgtcaatacgttacaatatttttacaattgtcattccgaatgcattatctaattaatgcattatggcatcacattgttccactctcgaaagaacttgtacccatccatctttatgacaacaatcgcgatggatgaaatggcagagatgccgctacatatttttaatgtcttcatcgttaaagctagttcgacgtacgattctaggtaactgcatgcacgaaagaatgagaatatattaggctttgttcgggagt

SEQ ID NO: 56353 - DNA, 4779 bp, Oryza sativa
  unsure (1)..(4779): unsure at all n locations
ccaaccgggactaaagatagatctttactcccggttatttcacccgggactaaagatagcgatctttagtcccggattggtactcccggtttggaaaccgggactaaagggggttacgaaccgggactacaaagggtttctccaccagtgtgatgggcatatgccgaggtggcaaacgatggaccggttagcatgatgttgccctgttttaggagaaaaaaataatccaattgaaactagtatagacattatttgaaagcgagaattttacaagattttcataaaaatatatcgaatcccacaaaaataattttaagagtgaaaatttcagagtggactccttattgaagttccatgttacacccccttcagcccatttttttttgcttttttaatacatttttcactttggactcctttttccctcatccttaagattacttatttttttcacgaacactcatcctcaagattactctccgtgtaccaccgtaaactgcaccctggtcaagctcatctcgattatgccgttgcattgatgtcctttgtatacccaaagtggcagggtattcaggataatgggactaaagtgaatcaagaagatgtttaaaaagggtgtccaaagtgaaaatatgttaaaccaaaacgaaacttgggttaaaaactaaaagtaatctattgctttcttgattaatatgcatgcatgaatgctagttgcaaatacgatttcataaattttgagtttttcatttgcactataataagaaaacaaacaatttatatgcagcaccaataatgagtggtctgaaacatatcatggagctacacaaatcctgaattgctcattcgccttcactagtcatccgatttgtggattaattgtcttgggtttagactctgttttactccatttatgtacagttttggctattatagatatatatttcagaattgaaagtatagaacaaattaaggttgtgtttagttcgtgtgacaatttttttaagtatacgtacacacatttgaagtattaaacatagactaataacaaaacaaattacagatctgtaaactgctagacgaatttgttaagcctaattaatccgtcattagcaaatattcactgtagcatcacattatcaaatcatggcgtaattaggctcaaaagatttatcttacaatttacatgtaaactgtgcaatcggtttttttcatccacacttaatgtttcatgcatgtgttcaaatatttaatgtgatggaaaagttagaattttgacgaaaaaaaattaaatctaaacacggccctaagtgtgatggtttatgcatgaaagctggtttctgaatcagattacctagctggtttctgggtgtagtggcaggtcggtggtaggtggagtcgtcagtacggctgcggctatagatgacgtcgttgtagaagctgatggtgccgcagggcggcggcgtccggcaggcgcacggcgaagatctccgccatgtggcgagtggagcagttggtcgtacgcggccagatcgtcggcggtcggggcgtcaccgtaccccgtcgccgccgccatcaatgaatccagacgcaaacggaaggaatccaaaaatcaaaaccagcaagcaaagtgcaaagaggaggaagcttgatggaatcttgtggagtacctaccaccttcctattccgaagaaggggaactagagtgactactcgaccgtggatgtctggatgtcgggcgagttcacaaggggtgtggccagcccatctcaacccaattaaggcccagccttcttacacaaagtacggtggtgtgaatcgaaaaggaataagttcactttgactcccttaaattaggggccgaatgtaatttgtatccctgcattacaataccagatatcttgacccccataactattaaaacatgtgtaattttacttccttgatggttttgaaaggcggtctcgttggcgttgcgcctacgtgacagtgttgacctgatcatctcacgtggcatttgacatgacgcttgagctaatatggcatactctctccttcccttcttccttctccctcccccccctctctctctcccttatctctctttctctttctctcccctttctattcaccttcatccttcccaagggagcgggcgttggagcggcggtggcggtgatgggcgggaggacgttggagtggcaacagtggatcgcctccagctcaaatgtcatgtcagatgccacatgtgacgaggactaggtcaacaccgccatgtagacgccacaccagcgaaaaccgccctccaaaaccaccgagagagtaaaattgcattggttttaatagtttcagggtcaagttatccggtattgtgagtcagggatatgaatcaaattcggctactaattaagggagtcaaagtaaaactattccaatagaaaatacgtccactgtccttttcttttgtttgattagaagaagtgcccatgcgttatacaccggataaaccaaaattacaacaaacattaggtagttagagtttaatattcgtcatgttcatctgtcaggcaacttctttagaataggatatttcttatctgctagttacaacttcagctgaggttttgcaaaaaggaaaaaaaatcccgcgtactaaaataggtccagtgacatatataatattcatttgctacacattttcattcacttcccgttccaatatcatagaattgtacaccataatcttggcatgtggaatgcaatcaggaaggaaagagaagatgaaaaagtcttgaagagagagcatgttctttttttttttgaaaactcataaatttatttatttttaagagtattaccgacagagctgaagagaaatatcatctccaatacatcaccaaaaaagataaaatatacacaacgaaaccatccattcagaagataaagccaattgaactaagaaaaacttcctccaaaataatccaaacagcagtaatgaatgagatcgacaaggactgcggcattgccacgacgactacgtgagcatgttcatcaaaaggttaagcaagatgcgcggtagtgtgaaaaaagagagagcaattgttcaatgatagagggagacgatgagacatgctaaaatcctaggtaagttgagaggagaggacgagggaaacaaaatcagaatcaaaccccaacacatacatactacgaatgttattccattatccaaaaataaagtaccccatgtaactgtatagctaccaaagcaagattaagcctggtatagatcacaccatggacttacgtacgtacgtagtacgtagaattgattagcacctacagaaattagtacgatcaaacacggaccaaacagacggcacggaaacaaggatacgtgatgagaatataagtcgctcatgacccagaagcccaaagtttacaaactcatcgtcgtcttttaccccttttcttatcggtttatcttatttctgctgtaagcctaagttagtatctaaattgacggtctgataatctacaacacaatactaatctggtatgtccatcttatttgcttgggcctcacaaacatattctttgttacgctagtccctttgtttttttctgtgcaatgtctaagaataagaccatataattaacgcttgtatattgacgaacaggagtttttccattgtaaatgagtacggagcaatcaacgaattccggcgaaatagaagatctacgtgaccaaattttcctgctcatcagactttctctgttcttctttgcaaaatatgttatcataaactttactttgcaatttttttaatatatatatatgcatatgggccgagcaatacaaggtaaatccatccatatatgtgggaccaaacttacagctcttactaaacactggagaagtgtttcatcgtacaactatcgtacaaaacatatcgtacgtatagcagccctcgtttatcatcatggaccataagaacaagtttaatagttacccatatgttagctattgacgcatcatctataacaaatctaatagtttaacacattcaatagtttcatttaacatcattagtacttggttcatttatcacgcacaattttttggagctagtgctacaacatctagattcgtgggtcctatctagaatcgtagtactagtttacattccatccagtactagtttacggttagctaccaagaaatctgaatatccctgactctctagacttggcggtcggtcaacggaataatttaccttgacggctatcaggctatacttcgaccgcgaaggacatgctgttttgttttcttgcagtgaatttaaggttttggaggaggaaaggtttactattacacatgttaatagtaatgatgcatgtgtttgaaccgagaaaatgtgcgagggtcgacatgtgaagtttctctttggaatatggtaagaaatgataaagcaatggtgtggttgtacactgttacaaagaaatactgtcctgaaataagaatctaaagtacgtatccactatcaaagcgacgattttataccgtcctcaaataaaagctaattttaacgtgtcttgtacagttgtacgtagcaaattctctcaagggttgtttagnttgatgacatattttgtcacagttgtgattgtaaattgcatggtttgaaaatatatcattactatttacttatttataaccatatcatcccactatatctaaaattgatccccactactatgacccaccacctatcaattact

SEQ ID NO: 56354 - DNA, 4582 bp, Oryza sativa
acttggctctagttcgcgccaggaacatcggtaagtgggatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgccaccgacgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcataatttaatttactatctttcatatgctacttatatatgactattcgaatttttaaaaggttaaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagccaaaaataatttttcgaagtaattgtcattaatctttgtactttaaataatgttaatgcattaacttctattttataaacacatatgtaagcgaaaatcatatgcagtgctgtaatctttagtcccggttcttaaccctaaccgggtttaaaaagaattttgaaatagcgggaaaagatatttactcccggttgttgagaacaaccggaagtaaagatccgggggtatatatattcccgcggcgccctcgtcttcttcaccaacacttatacgttttcgggcgatcgatctctctcggcctctctccttcgccgccactgcctagggcaaatccccgcgtcgacgccgccgtatctcgccgtcgtctcgagctcgtcgtcctcgccgccgcctccgcctcctccgctgccgccgcatctctagggtgagagccgccgccgccagatctccctttatctcgatctctccgtctcgatctctctccgtcgcgccgcccgccacgagacgacacgccacgacgacgacgcgccacgccgacgccgcgccaagccgccgtcgccacgccacgccgtcgccgccacgccaagccgccgccgccacgccacgccgccgccgccacggccccgcaacgccacgctgccgccgccgtcgccacgccgccgcgccaaccgccgccccgatgccgccacaccgccgttaacgaacgagaacgagaacgatcgaacgaacgagagcgagaacggacacgtcaacgtacgttgccgcgagaacgtgaacggagaacgagaacgatcgaacgaacgagagcgagaacgagaacgatcgaacgaagacaagtgagaacgagggaacgaacgtgaatgagaacaagcgaacgaacgtgaacgagaacgagcgaacgaacgaggacgaacgttaacgtgaaatgcaatatatatatatatatatgtatatatatatatgtatacatgtatatatatatatatatatatgtatatatgtatacatgtatatatatatatacatatatatatatatatacatatatatatatatgtatgtatgtatatgttacttcgcatttatcctaatacatctttttgtatcttgcagaaaagacgtgttgtcggagtcgtccgtcaagcctgagtggaagagctagccctagaaggaattggagcaggcaagtgacgtagtaatataaatgattgttatatttgtaatgcaattaattaagattattagacctgtaattagacttatcatataagattgtgtagtgttctaatattatttgtgttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtaacaattgactattgtagtcttaattagacttagcatatacgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagtgattgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccaacaagaagaagtatcatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtcttcggcgttcagatacgagaggctgcgcgacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccaaggcgaagattgcagacctagagttccgggtatcgagctacgaactcaacatgcaagaggaagtggcaaggaaggttgatgaac

SEQ ID NO: 56355 - DNA, 4564 bp, Oryza sativa
ctgcacccctgttcgcatgagggataacctgaccacacacaaggaatttatcgcggcggttcaagaacaactcatgggattcatcaacgaagaaatccttgatcccaagggtaaattctactacgacggaaacacaattcaccggtccttagcttctgagctagcagcgagtactctacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatataatatatatacatatatatatgtatgcatatatatgtattgaaacatatatatgcatggtttatatatatatatatatatatatatatatatatatataaaccatgcagcaacaggggcatgcaaaaaaaaaaaaggtcagctcgatctttagtcccggttggtgtcaccaaccgggactaaagatcgatctttactcccggttatttcacccgggactaaagatagcgatctttagtcccggattggtactcccggtttggaaaccgggactaaaggggggttacgagccgggactacaaagagtttctccaccagtgggcggcgctccgccgcgccgtgaacgtgcacggtagtgctagtgttgagcaccagtagcactacacggcgagcctgctcatcgtcgttgataccggtctcgctactaagcctgcggggccatggtgttgtctcgtcctggagtagcgcccgtgacataagccaccagttacgcaagtaatctacttgccgctcgttgaggctgatttggccatcgttcacggcgtcgtagtgcagagccatcctcgcgccctcgcagaagacgacggtcaggtgcaccagatccagtttggtgtcatcgtctgcagcgccatatggatcaggtggttgttcgtagcccgacagcttatggacggcatccagcaggacgacctgtcgcaggtcaatatcattaaccaacatattcttaacgtcgtcttcatcgcgaccaccaagtaagcttgggtagctgccgtcgcatcccagaaatgtggatggctcagggagaatcggcttgctcatccccgagaagcccatgtggaaccattgtcctttcaggttcctgaagccgatgaggttgacattgtcatcccggacggctaaggttgctctgtcgtcgccgttgcccaccaggttgatgtacatccacctcgccggctgttttgggcatcgttgcatcgcgagtacgggacagccggcgtagacgtcgtcgaggtcaggatgctccgcgagcctgtcgcgaaggttgttcatgaattcagggtagttgcctgtcctcacgttgaactctacgttctcaactctcaccgccatcctctgatttctgatctacacaatgattaatttgcagttatcaaaaaccgtaaattgtactctctcctgttttatagtacttaacagtttagacaggggttgaggttaaacttttgtaacttcatttgactatcaataactttaaaattattttgtttaaaggaactagaacaacatatatagatttatctttgaaagtacatcaataaaagtaaatatacatttatttattgtatatatattataataaaaaacaaggtaaaagatatattttgaaaattgtatcattatttaaaacatcaagaattattaaaccagagggatcgagtttctttgtacgagctatagccagtaatatcgatctatgagtatgcttatatactagtatatatgttctcttgtttcagaaaaaaaaaaaaccaattcctgagctagattttctaggacggagagggtgtatatgtcaagctggatgttaacgttttaaggtacaggtacaccacattaaaaatgagccttggattttcttttctcaaaaaaagaaaagagccgtatgattttttttctcaacaataaaacaagaaatgagcctttgtattcttttgatgtttttatctatgttctagatgacaatcaaatttgtttagctctctagctaaggtgtgtttggttgtagaaaaatatgttgttttgattcttagtaatcagaagaaaatttaagtttttggtatgatcaaccagctgaatggtagtttggaatataggattgtgatatgatatgtctagtaagtaaaacacacataactggtgatatatattaagattccgtttgaaatacgaatatatatcatctgtttccctcccgatgaaatcgtatcaacctttctttcatgcgcatgagctatacgatgttgcattccccgcagtctaatacttccaagttgcccacaactaaactgaaaatttgaatacaaaaaacctcccatacagaaaaggaaagtttctttgaatcgttttccatttaaatttacttttaaatagaacccttttggtttacactactcgaggttgcatggtactacctccatccataaatatatatgggattcaggtattcagtacgtattatctaggtatatatgccgaaacttaatacctccatccataaataaaagggattcagctatacgtgtaacacaataacttaatatcttcatccacgaaggatccaggttatgcatatacctgaacagagccactattttatgaattggcaataataatttgtcacaccaacacgtgtagcatggctaaatccttgccatacgtgtttttaaccggccatgacaacattgtattaccacgcagatatatggattgtgtggttaaaaggattcatataagaaaatggtaagtttatgcagagtttatttttaatatcaatgaattatatatatactattttggtagcctgaaacaagccatcacatttgatgtaaaggcctataaattcctacgttaattaataagagaaaagagaaagatttgaacggttagattatgcatgataggtccaaattataacagtgtagattggtcaacaaacttgtttacgaaatacaattgtatttataaaaacataattaagtaagagttgtatatcacataattaaacaaaaaaaatatgtgttttctaaaattcacccacaacaaactcgcacgataatctactagttattgtatcatcaacagaggtaaaaacgagcaaacatattcactagatctggaggccacaaaatttccgtataaatccaagaaaaagaagatttgcaccattagttcatactaggttcgaatattataacaacgtaattaacattacttttaaaaaaactaataagtgattttttccagaacctatacacatgtcggattcaaaacacccgacacagttgagtggagcttattggtgctagatttacaaccgacaccaatgtggaacgatgaaaaaaaaatcaatttttagcatccctatatattaagaattttcggcagcggaggaggagaggaggaggcgctacgttggcagtgatagcggctgtagcgaggagggttagggagagagcgagaggttgggacttgggagcgagagagaggagcaacctgatcgagatcgagagagagtgtgtgcgcgtgctagaaaaggatataaaaaaactagatgggcttgctagtggttggattgactccatccctaaagttgcgtattattattttttaaaagaaaggcacttgtatcccactttgtatcccacacgtacaagtatcggtttattaaaaaaacacagatattagggttggttttattaataaactgatatatatgagggtgtcctctgaaaatcatcactagtgctggcttttaattttaggcctgcctgatgaattgggaggatggaaatagtctgatagatgaaccgacgtatacgagggaatcctctattagggtctttgtaaattgatcggcatatatacttgtatacgaaatagaattctacttaccaaaacagcatgaaaagttgtactagtattatcaacgtaaaatgggagttgtactacatcaaatctagctaattgaacttcacactggtggagaaatgctttctagtcccggttcataaccccctgtagtcccggttttccaaccaggactacgaatccaggactaaagatcgctatctttagtcccggttcaaataaccgggactaaaaatcaatctttagtcccggttggtgttaccaaccgggactaaagatggaagcatctttagtcccggttgataacaccaatcgggacgaaagatatttttttcttttttttctgcttttaatattgaatattgatttcacacaatcccatcccatatccaaatcatcacatattacagaacatctccaaatcctcaaacaaatcatctccaaatatatcacaaactcttaaaaaaattacatcacaagattctaaaaaattcatcacagattcacatctcacacaaaaatacatcacagat

SEQ ID NO: 56356 - DNA, 734 bp, Oryza sativa
ctctctttagtcccggtgtgtgtttccacccggtactaaagatagatctctcctttttttttttgcatggccctgttgctgcttgatttatatatatatatatatatatatatatatatatatatatatatatatatatatatatatatatatatatatatatatatatatatatatatatataaaccatgcatatatatgtttcaatacatatatatgcatacatatatatatgtatatatatatatattattatattatatgtatatacatgcataatatatatgtatttatacatatatatgttatgcaaatgcatatgtatatagatatatatatttccaaaatatatttacattatagaaaatgtgtacacatgcatacagaaacatatgtagtcatgtattaattacaatctattatatgtcctagctagctacgatttcgacgtagtagtactcgctgctagctcagaagctaaggaccggtgaattgtgtttccgtcgtagtagaattcactcttgggatcaaggatttcttcgttgatgaatcccatgagttgttcttgaaccgccgcgataaattccttgtgtgtggtcaggttatccctcatgcgaattaactatatgaatgtatgaaattgattagtaattaaacaagaaatcgctacgtaatgaaattttgaatttatttgtacgtacatcgagctctctttgtggtgatgatttggtctg

SEQ ID NO: 56357 - DNA, 1906 bp, Oryza sativa
catcactttctaagaacccacaaaatataaatatctccaactccagcaatatagagacttgctatttatttctcctgtatttctacttatactatgtctacgtatagtttaacaccttaagaattcaaatatgaatatttctaatgttagatttcaaccatattcaaattcaaacgtcataatagttaaagttcgaatccttaaaggctcaaacatgggaaaatgggaatgagaaatcctgcgtactaccaagtatccaagaactatagtcaatagataaagttaactctctatacacttttccaatacaatctatctgagaaatttttttttaaaaaaaaagctccttcaaattaatcctggaaaataccctgaagttataaatcacaatttgagacaaaattaagaacaagactgaagaatcattccaattaattccccctctacctcataaacttcagcgcatgcagtgtcaattttagaaggtcaaaagccaatacatggccccgtttagataacacccaaccatcttcaaataatgaagcgtacgtatgtcttgctgcaggaattgaacaaattaacatcgatgattcgaaagctctgaacggagctaaaacaacatctctcatcaagtttaaatgttctgataggacttaactgagcagtccagtttctcgaaccacttcctcctcctaaaatgttacggagtagcatattttaggtggacacacgtattaagaacgtagatgaaaataattggttgaagattgtgattggttaagatgagaaagtcgataaagaaaattaaatgaaaaataattgtgattgattgggagaagatgataggcaaagaaatacctttattttgggacagacattcacttacaaaacaccttatatgtaccggatcataggtaccggtttattcaaaaccgacacctattaccatttcccacctctttaggatgaaaattttagataaaaactggcacctataggtgctagtttgttaaaaaaaactagacctatgcttatattataggatttggttatagctagataaaaaccaacacttatagtagtactacttttttttaaaaaaaaatcagcacctataataaactacaggtgcagccgaaccggcgctccaccacgagccgcccctcttctccaaaccctatccactccccttgcccacccccatcgccccatctctctctctctctctcactcactttgggccttgaataataatcggcatcatgatgtacttttgcttcatgcacaaccaagggggaaggttgtaaacacatagggtcacaggccaagcagtggcggatccagaaaatcgattcattggtgtaataacgtgtctattggtgtcatagtatgctaattatgcttagatcatagcgttataatatatggatgaacagttttgctataggttttgctgaaagtcgccggtgtagcctgacactggcccttatactgtagatctgccgctgaggctaagtgctacgaccgctactcatctctccaaatggattcatgcgattcgtactaaaaccaaaccttatattccttgcatcattaccgaagtcctcaaatattttgtcgatctttcgccactatgacccgtcgacagggtgtctcaacatcccgtcttgtttacgttcttctacgtgccagcgcatcattcaagcatgcgctttagtcttgtacaaatgtctcagacgtggtattatagggaaataccacatcaccttagcaggaactctcttctttgaaggttgtcggttaacttcatcggggtcatctcgtctaatcttgtatcgtgatgcattacaaaccgggcatgcttcgaggttctcgaactactcaccgcgatagaggatataatcgt

SEQ ID NO: 56358 - DNA, 25343 bp, Oryza sativa
  unsure (1)..(25343): unsure at all n locations
cctccttttcactttcgcagtctttctttacgtcgcacaatatctgacctagatcatccgcaccgttgttttcttcaacagctccacccccatcgcctgttgtatctgcaaatccaccgtattgagcccagtctggaacgttgtcattttcttcatcatcttcttccattgcaatcccaaagtctctatgcaaggtccaacaattatagctaggtatgaattctgattgcaataagtgggtatgaagagtccttgatgcaaaatactctttctagttttgtactttttgcatggacaatatataaaaccttaggcctgtgggcattggccacataaaaaataatgtacaccatcaacaaactccttcgatcgtctatccgcggtatgccggtatacatccattgccaattcatctacatcaaataaacaaatgttaaggaaatccacgaaagtgaaaataattaaataatcatataatatttaaaacatcataattaaactcacaactgaagtcacaaatctctctgactatttctttaagaaaattgtaaatatgcttttccatgtattatccttttaaaaaaacattttacaagtttttaaaaaaatgaaaacatatttttaatgattttttcttatttctaactattttaatgtgttaaaaatggacttagttttctattttttttcttcattttctacaattttcctttgttttatttttttaaaacatttttatcaaatgtgtcttattttctccaaatatttttctctccctctttttccatatacttttttgagagataatgacatataaaaacatagctagaaatgtaatatgctaatcatacatcaatacagaataaaattgctaacctttcatatcccttcgatttgtgtaatatcaccaaattattttcacgaaaaattttggcaacacctcctttccttctccaacctcttggcagcaatgacacgggccgaaggaggaagaaggcatataatttttagtactggttggtgttaccaaccgataataaagatcatatagtatcagttggtaacaaaagagcccagggtgcttaacatggtagtactgacaaagttcaaccgggactaaaaacaatctttagtatcggttggtgttactaaccagtactaaagattgtattgtgtcgtgagggttattaaatagtactaaagacggcatctttagtctcgattggtaatagaatcgagagatttgtatttttgggaaccacaataaaagatcagttctccggtagggaatgcgggacacaggcactatgcaaacgccaccacgtggcaaagcatatgacatgatatatagaaacattaattaccctctattgatacatgtactctctccatttcatattataagattttctagcattgcccacattcatatatatgtcaatgctagaacactactacatgaaagattttcttggacactagacccttttgtttccaggcggaccataagtgcaaccgcacatgaaaatgagggaagggcgtcgggccatcgcccacacaggaaaatcatttttcgtgtgcggatcacttaacagacccgcacaggaagataagcctattttcgcgtgcggttgttaagtcaaccacacaggaaatagcccaccccaagtgctgcccatcatcccatcttcctcttatcctcctctccatcctcccatcacgcgcgcgcctcactcatttatggtcctccccatcctacctatcctcactgtccctctcctcctccccatcctcccatctccctctccctgtccctctcctccccggcaacggcggtgccctcggttagggcggcgaaggtggtggcatcggcgggcgtggaggcggcggcatcggctacggtgttggcggcggagcggatctgtctccggccgccgcgtaaaggccagatccgttgccagccgccgcgggaaggcaagatccgtggcccgccgccgctgggaggccggatccgtggcctgccaccacggggatgtcggatccgtcgcctgccaccacgaggaggctggatccgttgccggcgaccgcggggacgacggcggcaggcctcaggcaaggtggcgatgacgatgacaggcctcgggcaaggcaacgatgatggtggtggccgtggtattgacggcggctaggttagggcttgcgggtggattttgattttttttgtttcagttttttatttttcccatgcgggcggccaaagcgcccacacgcgaaaatcgatttccgtgtgcgggggcgtcacccgcacaaaaaccaggatttttgcaaacgttgccttccagacgggtggaagctccacatgtgaaaatcaattccacccgcacggaaaaatctttcatgtagtagtggaaagtcttataatatgaaacggaggaagtacctatcatgtgtttacatgattcacgtccattaattaccctctattgatatatgtacctgtcatgcgttacatgattcacgtgtgtatgaacacgggagaccaaattaagttggcagtttgtcctttttacatcatctgctgctcccagttaaatgcaaaatagttcgtttgaaaaccgcttgagattgaaatatctgtaatggcatacatttatatcttttagataatgacatacatcctctcttactataaagttacaattaatccactaaatcctaaagcttaccatataaaaatgtcacattattatccactaacaatatgccaaatcaccatccactaataattactctctcggttccatgatataaggcacaactattttttttggatgttccataatataaggcatatatgcatgtataaaattaatcaggacctcttctccattaaattattactttttaaatcctccaccctcaagatctctaattctattggatgcatgcattatatttattagggtgattcaaactaggatatgataataattattttttggtctttgcgttaaaggtggtcgtgccttatattttggaacggagggtgtattatatttaaacatcatacaagcatgctatattatctatagttttatattttattaaattttagagcttttaaaatgcaaacatgctaaatcgttattccacataattcacataatattttaatatatatatttattattttttataatatcatatatacctgtatagttcattctcacttagttaatgttgtttctctcttctcttattaagcaatattacattaattgtttttagtccttagatgattaattaatctatgatccaaattatatatcttcttttttctctcattaagccatatcacctcaattgtttatagctgttagatgattaatctatatggtccaaactatctccttcgttttgttctcataaagccacatcactttacttttatatttatatttgaatcattattctatatactatttaaatttaaattatcataaaccacatcaacttacataagcttatattatcttgctatcttatatattatttttacttattgttattatactaaaattttataacaacacgcggagtttcacctaatttatatagattcggaatatgtgttcacatagataaacggcatgcatgccattgatcatcttttattaatatttatgcgggtgacactgggtagaaagcagtgcccaacataattattcagagatttatataccatcaaggtattctatcttacctaggatattttaaccactacttcatataccacacactactacaaaacatcacaacagtgccgccaatcactgcaggttagttaaaaaccgacgctctctataaatcaatgactgttaattagactgtaaaaaaaacacagggatcaaatgagagagacatagacttaaaggaaaattttcaagagataaaatgcacgagaacacatgcatgtttcctagtttttaagaaaattgacgcaaagttacttttgcgaaagctgaatgcttcaaaaaaaaccaaacggccaggttaatatagttaatttaggaaaaatgatgccatattaatgacttaaaatgaccagtaaaccttttattgtaacagcagttgcttcctaacaaaccaatcatacagcacagccacgccagtagacccagccaacattgaagagcttgccgatgatcctcccaagaacaccagtggtggcagtgggaccagcgtgttatcccgacgagctaccttgacagtgacctatggctgtgtttagttgagggggaagtttggattttggttaaaattgaagatgatgtgactgaaaagttgtatgtgtatgatgggttgatgtgacggaaaaggactgaagtttaaagtttagatccaaattttgaatctaaacacagcctatatatcattggaaggcgttggtcagcacaacataggtcacctcagctgggccataccatgtgatgaccgtctcgactatggcactgttgtagtcggtgaagtcacaggtgcaggtattgcagaatatctccccaacgttatcttcctcatcgtcatcttcttcttcttggctaccgtcatggagattgatcaggtcaatgccgacatacaccgagatggcaaaagatgggccagttagcacgaggttcccctgttttgagagaaaacataacccaattaaaagtggtttaagcattcttcgaaagcataaaatttacataattttcacaaaaattatattgaatcccatgaaaatattttcgagagttaatttcagtttggacccttcttatcgaggtttaacattggaccttatttactccataatttcaccttggacacctttattttacccttagtttttcctctgtactcccttttattcatactcaagatttgtctcagtgtgctacaattatctgcaccttggtcatacttcacactcatcttgtctcgttacgtccggaaaaatacaaccatttttttaaacgcttattgtattaatccctgtcccatgaacacgccaaattcctcgctgttctactgctgcctttctttgtttcctctgtttcttctcatcttcttactctccaagtcttccaaatcgccgtcgttgcggcagagctcctcggtgcactagctctaattttgattgcctccggttagttttatggtgatgattcactcggcttcttctttatggactgctcgttgctgctgattgatctacagtgctgcttgatcaccatcgatactgtaagtatcatgtattcaacatgttcttctactaatctccaggcatgagttgcatcgatctagttaattagtgattattgcattttctataatttagtatatgtgcaaaagctatgcagggtactgttcatgtagattatatataatatcattgcaggagcctaattatcgactcacttccaattatgtccgatgttctatgcattgcatgcaacgcaattgtttaccaactagtgggaagctctgcagtattttcattcatggattcttctattgactacttttgttattgcagcagtagattacgttcttaattttgttaaggtcattcgcgatgatattaattcatgagctccgtttgatgcgtgtatggcatgtttgattcgatcatttcaataagctgcttaaaaattgattttttttagacacaccccctttattttttttcaaacgggccgaaaaaagacccatacgtacaaagattttcgaggtggccagcaaatacctgtatgtgaaaattaattttcgtgtgcgaaccttgtgatatgttcgcatgcacaaataggtaaattgctttatttgtgtagacaggcctgttaagaggcgtgcctagtaaaaaatcaaccgctcaatcctctccccctcttcttttctctcctctctttaaaaaaaaaaatctaattccccacttctctcctctcatctcctcctttttcaccagccccctcctccaccggctggccacgggagcagcaacaacggtcgtgatgaaggcagcgacaagagcggccacgacgcccggagggacaacgatgtgagccgcggaacaggcttgagctggcataaatggacccacgatggccggatccaacggcggtggccttgccacagttggatccagcggagatggcctaggatgacaacctcaacaatgacgatgaccccgactgtttgcgcgtaatggtagcgggagcagccaccgagcgccttggcagctcctcctccactaccactggcaggcttgcaaaggccggatccggcgctggcgggctcgcgacagccggatcctgagaaggtggccccgggtcgatgattccgattgctagcagcggtggtggctagggtttcttgaccggagggcatggatcgatggcggcatcccctagatctagtgagaggggaaggaagcagtggagagggcttcggatccaacggtggggtcgtcgtgttcaccccgatgaaccctgtttgacagtgacccatccttcgacgacgttggtcagcactgcgtaggtcacctaagcggggccatatagcctcgattatggccatgttgtagtcagtgaagagaccgttgcatgtattgcagattatctccacctcgttctcatcattatcttcattttgttcgctaccgtcatggagacaatgggtacagataacaggggcatatgccaaggtggcaaacaatggactggttagcatgatgctgccctgttttgagagagaaaaaataatccaattgaacctagaatatgcattatttgaaagcatcaattttacaagatttttaaaaaatatatcaaatcccacaaaaataattttaagagtgaaaattcagtctggactccttactgaagttccatgttacaccccctttagcccatactagaaaattggctgccggttggctcgccttgtagctagcccgtccatatggctttaaaaaaatcatttaatcaatatagcctcttatattgctacatcgatttctattttgttgtaacctatagcaggtagtatttttccttgtcatatgctaatcaccatctattacatatatgcaggtaattttcagggcaacgcactggctccggttttaggcaagctacaaagatgtgagtatgatggggagttcctaaaggttgcatgccgcaggttggagtcaatgcttatgtaactatttgctaattatgggtgaaggttaacaaatagacttcaataaatgtgttcttcttaaatgtgttcttcttattttggctaggttacctttgtttactcgtttctggggtgctactttgtaataattggatgtaactctttttaagcaaatgctgggatgatatattctattatcttaaaaaaatgcatattggctctgcgctagcttgttgcaacccgcagggaatggggttagaccggctgtgctgtgctcgggtggagcatgctaaggtatagctttgtaaaaaaagaaaaaaaaaagtacgaattacccaattacagtactagactattttaaccctaaattttttaaactggataaattacctcctataactcagctcgaagcggttttaatcttagtctcgaagcggttttaatcccacaggcacacaagtggcagtctaatcgataaaaataataaaaaatagtgggccccgcttatcagcatcttctctcttttgctttcttccacctccttcccctcccatccatctctctctccagtcaccaaggagcactgagtaatggcagcaacggcatcaccaacgcgggaggagaggagcagcaggtagcgtgcgtcttgcagcctcaacggcacgcgctaggggtggcggaggacggcgcgacagtctaggcgagggcggcggcagcattcccggcggcaggcggcaatggtgtgcgagacgagggcggcgaaacgggatgcggcctcggcttccatcaacacgcgggagctagggcgagctccggcgctgaacctctccggtaaccggctcaccggcgagttactggaggggttcttctcgctggcgctgctcgagaaggtggatctctccgggatgccggcgagcgccttcctcggcacgacgctctgcggcgccctgctcgccccgtgcgccaaccccgcgctgctgccgtcatcgctcgggaacagcaagggcggagggaagctcacccgtggcgcggtcatcggcatcatcctcgacgtcgtggctgtgctcatcgtcatgcttgttgggaatagtcccacgttgaaagtttagggggagtgacaccaacttaaaaaggggaggggtccctcacctcatgagctagcttttggggtgtagaaaggctttctcccggttgggccaacatctcccggttttgggccaacaagtggtatcagagctgggcccacaatctctctaagtgccgtgcacactcgtgtggtgtaagcccgaagcccagtggaccgcgggtgtgaggcccgtatgtgcctatgtgttgggccagtcagtggaccgcgggtgtgaggcctgtatgtgctcgtgtgtggagcctggtcagggctaaggggcaccaatgtgtgacgggagagattgttgggaatagtcccacattgaaagtttagggggagtggcaccaacttaaaaacgggaggggtccctcacctcatgagctagcttttggggtgtagaaaggctttctcccggttttgagccaacaatgctcgccgtggggtacttggcatgcttccggcgctgagcagagcaacggctggtcggagcaccaccaccgcagcggccacccccgacatgacggagcccatcacggtgaccgtggcgaggacggacagcgagacaaggacgtcgccgtcaagcagtcagcagtcgcactcgctggcgatgatgacaggcgaaggcaacaagctggtgttcctcgacagcgtgccggagcggccgtacgacctggacacgctgctgcgcgcgtcggtcgaggtgatgcttgcgcgggtggtcgattacgaggagtgcggcggcggcggcggcagcagcgaggtggtggtttgctctggtggtggagagaggtaggaggggagtgacctgatagtgggccccaccgacttttttaaatgaattgatgactggactgccacgcatataccacgtaggaccgaaaccactccggattgagttaagagggttatttgtccggttttaatagttgagggtctaaaaggtctggttttcgagttcgagggggtaattcagtcgtctacgatagttcaagaggtaattcgtactttttcctaaaaatacaacgctatgtttgtacattgacttagcataatatcgttgcacgcatcatggtattgataggatcatcacttcaaatgagttcacgcgcgatttgaaattattaccttcccatatatatgattgatgtagcattattatttaactttactttttctccattttcttttttactatagcccttttgtgccttcagtatttttgagttagtttataattttctttggagatagcagtgctgttattttattggtgtttcaaagtttggtagggtaataaacctttgttacatagttgtacaatgtatgtatttgattttttttttagaaagtggctaagtccataccagtttgtttattagattatatatgctcagatttttgtaataaaaaatagtcgtgacatccttttaaatataaaattttataattttacacttagctttctttacaacatgtaggagtgaaatagagcaagaaaagaataataaggaagatagagggaaaaaaaaagaaaggggggggggggcaaggcaggcccaagacaaacaggcccagcacccgtctcctacctgttgggccaggcgagctgaagcccacgccccagcagcagccagtttggctctagtgcgggcgtagcgcgagcgtttgatgaagcggtagcacgcgttgcgcaactattggtgccacgtggcgcataattttgcaagagaacccgtcaattttagaatattagatttttatttttgttttttatacattttttttgtttcactttgaactcctttttacctaatcctcaatgttactctccgtgtgacaacgtaaactgcactctggtgctcatctcgaccatgccgttgcattgatgtcctttgcatacccaaagacggcagggttcaggaaaatgggactaaagtgaatcaagaagatgtttaaaaagggtgtccaaagtgaaaatatgctaaaccaaatcgaaacttgggttaaatactaaagttaatctatttctttcttgattaatatgaatgctagttgcaaatatacgagttcaaaatttttgagtttttcatttgcactataataagaaaaaaagcaatgtacttgtatgtagcaccaataattattggtccggaacaaattaaggagctacacaaatcctgaattgctcattcgccattactagtcacgggaatattaggccctgttcatattatagccaaaataaaacttaccaaattttagcaatgccaaaattttgacaagatggtaatattgttaaaattttggcaggatttcttatgtatttaacaaatttagcgacaacctaaacatagatatttttttgacagcttaaaaaaaaagggtatggttgaaaatggcattaaagtgaacaggcccttagtcttgagactcttgtgtaggtttagactctgttgtacagttttagctaaggcccagtttagtttccacaaaaaaaacttttcaccatgttaaatcgaatgtttgcaactcttgtgtaggtttatcttgtgtaggtttagactctgttgtacagttttggctaaaacccaatttagttcccacgcaaaaattttcaccatgtcaaatcgaatgtttggacacatgcatagagtattaaatatagacaataaaaaataattacaaagatttgcgtgtaaaattgcgagacgaatcttttaagcctaattgctccatgatttgataatgtggtgctagagtaaacatttgctaatgacagattaattaggcttaataaattcgtctcgcagtttacaggcggaatctgtaatttgttttgttattagtctatgtttaatacttcaaatgtgtatccgtatattcgatgtgacacgccaaaacttttcgtctcacgatctaaacacagcctaaattcagagtatgaaacaaagtctgatggtttacgcaggaaagctgatttatgagtcagattctagaattgtggaatacgatgggagtcttacacaggggcggaacccaatggaccaagggggtgcccaggaacccggcccaaaatctaaaataccttgttaccctcgtacctagggaaaagtacacccaaggccccttaacttgtcatcgagatacaaaatcgtcccccaatcataaaaccagataccgggcgtctctcaactaacaaaaccattcgctttaggtttctcggtggttttgacccggttttatcccacgtggcggctgagtcagcgtgggacccacgtgggtcccacatgtcaggctatccatgtcagcctcctctctctctctttcccatccttccccttcctcatctctctctctcatttttctcctcttgtccgacggagcaagcgagccatcgctcggcggcgacgatgcgggagaaggggagtgcgttaccgatgcagtgggcacggcaggcccggcgggggaggagcgcggcggtggctcctggaaaacacggcctcgagctcactcccacgcgcttcaaccgcgcgtgccggtcccaggaggctgtcgtctccgatgatggcgacaacggcgacgatggagacgcgctaccaccgccgacaacgacggagccgctccgacgatctaccaccgacagcaacgacggagccgcgcccgcgcgctcctgattcctaaaggcggtgcctgcttccgcgcttcgtcgcccgtcannnnnnnnnnnnnnnnnnnnnnnnggcgacggcagccgtgcagcagctggccgcggacggtgaaggtgacggcgtaggcgcccacgccacgggcccgcgcgtagccgtcggcggcgtaaccggcgttgagctcgttgcagcagccaacgatgtggaggccgggctcggcgatgaggtggttgagaatcgtgaggttcaagtccccgggcacggcgaagacgtcgctgacgcccacctgcacgaggcggtgtgccaagtggcggccgagtgtggtgtcgccggaggcagcggacggcaccaccgcctccttaggagatcctcctccgccggtggtctccattgtccttgttatcgatcgatcttaattactccgcatgcgggcgtatatatatgcatgatgaagagatgatgtgcgtggtggctgttgtaaatatgtggttgtcgatcgatcttaattactttgcatgcgggatttttcgccgccgctgtcctcatccgctcccgctgctcctttgatggtgcccgcgatgacggtaccggccctaggaggttgtcgccgacggcggtggcggcaacgacgacgaagacgcaccaacgcgctacatccgctgtcgccgctgacgaagccgctcctgggcagacgtgctaccgccgccgccgccgacgcgcggacgcgctactgccgctgctgccgatgcgctacagtcgtcgccgccgacggaaccgctcctgggcagacgcgcttccgccaccgccgtcgacagagccgacgactcatctgggtgtgtgtaggagagaggaagagaggaggaagggagaggaggctaacatggatagtttgacatgtagggcccacgtgggtcctacgctgactcagccgccacgtcagacaaaaccaggatcaaaaccaccgagagacctaaagtgaacggttttatcagttgagggacgcccggtatcagattttgcgtttggaggatgattttatatctcgatgacaagttgagggaccttggatgcactttttcctcatacctacagcatagaggcaccacaccctcctctcgtccggcccaaatttgaaaggcccaaccagaagaaagccccaaaaccaaaacgattttgctatatctcactcggaagattttttcttatctctcactcgattttctcacttaaatttacagtgcattttcttgtaagttacagtgtaatttatgaaacttacactgtaacttttgtaagttacactgtaatttttgaatcttcacatgtaaattttaaattttgtattggatttggtctttttctcgaggatatggtaatttaatgttcattatggtgtttcttaattgctttttgctttttattatatctatcggattttaatacaaatattaaaaatctgtgtgatacgattataaaaatcttttgaaagatgtataggtactcccaaaccaaaaattaagcagtgggagaaactgaaacgtccaacgacgcttcccctcgaagcctcgcgtgataccgaagcggtagtttcgattttctcgcctgagtcgcctcaacgcccaatctctctcctcgcattcgtctgacctgtcacctctccccgggaggtcgcccttttctcgccgcctcaccggggacccagcccggcagccccaatcgaagaaatttctcatgtgtaaagcactaaagcctttccctggtaggtttgcctcccttttccaaaattttgcactgattaggctagcttagggcttgcaactatagaggcatatagagatagatgacgggggcaggaggaggatgactggaggaggacggcggcaagctgcaagctagcaacggccaatagctggagcttgccggctggccgctcaccctagcttatcgatctactctgagccccacaaaaattgcagccagcagcactagctgagagcaactgaataagtgaactctttctctcaatttttcttatccttagtttgtagttttgtgccaaaataaacttgaaaatttttatttggtcttaatagattgctatatagcactggatagtacgaacaatatgaagaaatttgttttaatttgtaccaaatcatttcataacttattctcggttgaaaattaaactatattttcaaggtcattatcctatggaggaatgaagacggtgacattcgcatgatatattcatattattagttgatttcttcattatggtacgtattttttatttttttatgtatttcttgtggtatattcccttcaaatgaagaaataatgcttatatttatttattggtatgcaactatttagtataatatcgctctataattatagatgttagtattacataaataaaggtaggaatccctcgtcttttctctagctccgcccctagtcttacatgggtgtcgcagggcggtgggtaggtggagtcgtcagtacggctgcggctgtagatgacgtcgttgcagaagctgatggtgccgcagggcggcggcgcccgcgaagatctccgcagttggtcgtacgcggccagatcgtcgccggtcggggcgtcgctgtaccccgtcgccgccgccatgaatgagagatcgaatactctcgtcgatcgatcggcacccgcccaccgattaccgaatgtatcggggacagtctgcactgagcgaatagtatcaaatcagtgggtagagaaagacgcaaacggaaatcaaaaccagaaggagaagaatcaaggaggaggaagctggagtggaggaggagatcgatcgtcgaaccttgcggcgccggagcaccgatcaccgctgtcgggcgtggagtagcactctaggagagaactagacaaaaaggaaggagagaagatcgaacgactactcgacgaggattgccgggatgcggcgggccggggagcagcgtggaggctggatccgggcatgacgacgacctctctctaggccgcaccgccgtgtgcgtgtgcccctcctccccgagccgccccggccccgccgcgtgcctccgccacgatggaaaatttttaatgtgttttttctacttttgtatttttcaaaagaatttctcaaggaaatagtccaaatatcaccttagactttggacgaaattccatctagaatcatgagttttaaaacccgatatctaaccccctaaattttatattaccctctaagatgattttggatggtggtttttcatattttgaaagcttacatgaacaactttgaataactaatataatatatttgcataccatcaattgtaagtcaccaatttatactcatacagtgatactatattattattatacactggttcttatttataaatgtgagctaacgagtgataaaaagaaagatttaattaagtggagattttaatatatatatgtccaatttgtatatcacatgatcaaattcatccaagttatatacaaattagataaaaatcactaaacaaaatcaccttaggggataatatgaacgattttgcaaagtttagggagttgaatttctagttttaaagttcaggatgatggatggatttctatctaaggtttatggggggtatttggattttcttcatttttccaataatgcattctaaaagggccctgacagaacaaaatgattctctgataaaatttcattttaattttcctagatggaaatcacacgaaccactgttttcaaaggttcgataatacaagttgcaaatgcccacggtaataccattgtcttcttccaattaattaatgtcgatcagtatatagtcaactgcattatatatatgcctcacgtctgcaaaagggacgtgtgtattaccttctcccacagcgcgcacagtaagcagcaaccaacaagcacgctggcacacagtagatagctagatgagattattacttcaatttattcgttgcgcatataattaagaagaaaccaagatcattctgtactgctgccaatttatagctagtcagtccggtgtccatagacgcaagctctactgctgttgctcgatcgaccggtgtttgcaattatcatgagcctggtcaagaagtaagtttttaatttgttcactttattgcctatttcattatctacagattagtgaaatactccttccgtccaaaataaaaacacactaatctccttccgtccaaaataaaaacatatagtatagattaatggacaaagagtttttcagatttgttgtattagtaggggtcatatttcgattattttttattttcggatggagggagtacacatttatggcatagtttagatctaaagtttggatacaaacttcagtcctttaccatcacatcaacctgtcatatacatacaacttttcagtcacatcatctccaattttaaccaaaatccaaactttgcgctgaactaaacacagcctatagagagcgagatagcccgcaaaattgatcgactctatgccgctgaattgacaatctcattccaagtttcccacacgatttctgaggaattgtccgtggtacggcgttttttgaaccagaaaaggtccgcaaaacgaagttaattaagacaaacatatagtacgatctatattttgctccagatctccgatgttttagagaaaatatagttttatatatactcaatatcgtaatcatattctcttgagctatcccaacgcaattgtaaaagcgtgcgttgctaattgctctaggactgcaggatttctcacataatttcactgatatatcactactacgaaaccggtttttgcaaacgggcgaaaaacatttttgtatgtggttggaccagccgcatgcatgaaaagatcagcgaaagtcacgatttttgcatccggctagggcaaccacatgcgaaaatcgctattttcgcatgcggttgcttacataggccgcatgcaagaataaaaatccaaaaaaaataaaatcgcaaaaaaaaaatcacgtcggccgcgcaccggcgtcgtgccctccgctcccaccgtcgtgggagccaccactgcccgctcccaccgccgtccactccagccatcggatctgtgcaggacaaggcccgccgccgccggatctgggtgggaggaggcccaccgctgctgctcccaccggcgtcgtggaagccgctcccaccggcgtcgccgctagccgctcccgctgccagacctgggcgggaggaggccgtgcgcccgccgtcgaccgctattgccacctcctcctcctcctcgtcgacggttgcagcatcgggggggaatggagccggtcgccttctcgtcgttgtcggcggcggcggtgagttggggatggcggttgcgccgccgcccactcactggatccgccgcctccgttgcgcgcctgccgtagccatagccggagctggccctcctgagggtggcgccgccggatgcgctgtccgtcgacgccatcgccgcccagcctgctcctggccgccagcgcccactctcggagagggagagggagaggatagaagaaagagagagagaggagaggagagaaagagagaggggagagtaaaataatagaggggtagagagaggaaatgagttagaaaaaaattgaagtggtgagagggaaaagagagtggagggatatgaaaaaaataggggtggcatttttgcataccgggtattctaagtggtccgcaattttacatgcggacaacttaagcgttcgcatgcaaaaatcatgcggctttctaaacttcgaatcgaattttataatactaaatgaactcatgtgaaaaaattgtcaaaaataaagctgcaaaactcattgagatctgccaatttgcttttggtcatttctccatccgaatttgattgcactatataaaatttgaattttaaaatataagaaattcaaataatttttcagctagtaaatgatttcaaacggaaaaattgtcaacaataaagttgtataaagcatcaagatctacaacttttgttttggtcatttttctatatgactttgtttcaataatttgaatttgaattttaaattatgacaacttcaaataatatttcaaatactaaataatttcaactgaaaaagtcatcaacaacaaaaacaacaaagttgtataagtcatcaagacctataacttttattttagtcatttcttcatccgacaaagttataataatattgttcaccaatttaacatatatctcatatggttttataaattataagagagatatgtaaattttttgaacaatgttactatcactttgtcggatgaagaaatggctaaaattaaaattttatatcttgatgagttctacaacttttatgttcatgactttttcagctgaaattatctactacttcaaaatattatttgaagttgtcatctttttaaattcaaaattttaattgataaaacaaagtcacaagaaaaaatggccaaaataatagcattaagaacacaataacatgatagagcatgattttaaaaatatttaggaaaaaaccatccaatttggagttcatatgagtaagataaactagtttcaaaatttcaaattttattttcgcatattttcaaattttattttcgtatatggccccttcaggaaaatcgatttttccatatgggcgtcttaaggagccatatgcgaaaatgccgctcgatttttccagacacggtaagttatggtccgtttgcaaatatcgtgagatctcgtacacaaaaatcgtttgtggactagtgtatagagctgttttaaagcgtcagaacacacgaatttgtactccgtaactcattaagtcataggttaaaaaacactcatttgtagtgttacaaagtactccctttgccctataaaaatccaatcatgtatatgtctatatttaaacgcaggattgggtttttacggaacaagggagtacgttgtaactatattctttacaaatgaaaaaaaataatgcaaaaccatatatgtagcgcaaacttaaatattactgtagattccagaaaagcatgtctgagacttatcaacgtcattatgagtacaacaagtagggatacaatttataaataacataatatcggaataaaaaatattaatttttcagaaaaacacaatccatctagaaacacaatgatgacaaatgacaataaaaaagggagaagcaagagggccgcgaaggagcagggcgacagtggttgatgtgacatctaaaaatataaataaacatcaaatagaatcccaatgatgattaagaggagggacgacagccaggacattaggcatctgttaagccgatggttggcggaacttctataaagtaaaaaataaaccacaatgataatcaccatgatttttaaaatctcaatgacaataaaaaggaagggcaacaagtgtaaaaactataaacaaaactccaaataaaatactagtgatgattaataggagagatgacgggcaactcgttaagcatcacaatcacggtggttggcgagacttttagaaagtaaaaataaaccacaatataatcacatttgattttaaaatattcaatgataattaaaaaaaagtatcgtgcagggtgtagaggacttctagatgacggtttggcaggacttctataaagttaaaagtgaacaccgatactaattatgttcgagtttcaaaatctcaatgacgataaagaaaggaaacggacggacagtagaggagtagagtggcggcatttgacgggacttctaaaaattataaaaatgaaagccaacaagatatttaactctaaaatttataaggtgcaattttaaatttccaaggaggacgaatagaagccgtaatagatcgagcatgcaaataaatgggtgacaaaggagtaagaggtagtgataggtgtgacttttaaaaactacaaaattagaaatatggagatgataaggttcagtcttttaaagtccgaaaataatgagataaccatttaacaaattttaagtgaactcatatgtaaataattttgtatggatacttgtcgtgcgattgcgtgggccacctagctagttcttattttatcttatagtaattatcaggtttatactacatattttcccacaaagaattcatttaacacttgatatgtgtgtatacacctatagtaaaacaaccagtgaataatacagaactgtaggcaaataatacaaataatttgtaaaattatgattgttttgtccctatcataatttgttactaaaaccagacatagtggttaagtgactagacacaggaccactaccaaaaaaaaaaaaacctcatcggtactgcccaagaagacccatcagtgctggttccctgcctggcacaaccatttgggcaccaatgcacgccgttcggggtattttgctatgttaagatgccattcggactgataaccgcagggaatattttccagcgcacggtccagggcgcacttagcgaccagctcggcaacaatgtcgaggcatacgtcgacgacatcgttgtcaagaccaagacaagcgactaattgattgacgatctgcgggaaacgttcgacaacctccgacgatatcgcctcatgctcaatccagagaagtgcacgttcggagtaccgtcgggcaagctgctcggtttccttgtctctagcagaggaatagaagcaaatcccgagaagatcaaggcaatcgagaacatgaagtcgcccacaagactcaaggaagtacaaaaactaaccggatgcatggcagcactaagcaggtttgttgccaggatgggagaacgaggacaacccttcttcactctgctgaagaagcaagacaaatttgtatggacacaggaagccgaagaggcattcgttgcactcaagcgctacctatcaaacccccctgtacttgttgctccccaacctaatgaagaattattcctctatattgccgccacgtcatattccgttagcaccgtcattgttgtcgagagagagaaagtacaacgaccagtctattacgtcagcgaagctctccacgacgcaaagacaagatatccacagatccaaaagctgctttacgctgtaatcatgacatcaaggaagctacaccactactttcaagcccacatagtcacagttgtctcctccttccctctcagtgaagttgtgagaaacaaagacgttgtcggccgcattgcgaaatgggtagtcgagctgaaacaacttctgacgtgtcattcagcctcaatcggccaactcatagattcccctccacctcagcacatttggttgcttcaccaagcacggaaagccaaaatatgatacctgttcctcatcaaaactattactctaggctcacacaatttcgtgtcccgtgccctccgggaagagagaaaggaccaaaggaggagaggcatccacaccaccgagctcgtcgaaaagagagagaaagaggaccgggctagcgctggcgacacagccaccgcggacaagaaccggaaggggtgaagaagggaggagggggaaaggggagctcgacgtcgatccacgccgccgcttaagcctcaccgccgccgccattgttgggggtggaggagagggcgccgacgaagacaggaggggggagagggagaggagctctcggtcaacccgtggtgccggtggaagaggaggaggggaggcgcggcagccggatgaggaggggaggcacagcggaggtggtgctccacccccgacggcgccggctaacctcgtcgtccaacgctactgtgccgccgagctccggtgaggaggaggggggtggtgtgccggcgagcactaggccccaccgcctggctctctatggtagggaaaactgggaaaggaagaggggagagagggggaggggaaaagtgaaaagtaaagtagtagtggtgggacccactataaacatcttgcattgtagaacatgtggctaacattgtttttggtctaggtggcatgcgaagtccaccaaagcttcgtgacacactatgaaagcccttagtaccggtttagaaattggcattgatgcgcatgtacgagcaaaaaagaatatgaagcggcggctccaagaatcggctctagccgattcttcgagcccgcccccatgatccacgttttcaaattcatatcccttaatcaatccccttcgacaacaagaacactcaatcccagattgatcaaccggaagattaactataaatcaatcacaagcaagaacatgaagagggtctggacattcctcaaacaagagtgaaaaattataaatattaatttataaaggtgaggctgaggatctgtacaccggagaaaaagagggcaacaactgctagtctgctaccacctctccctagggtttatcttatcgtttgggccggggttaccgtcactccgtggtagctcgataactgtgataatcacgcggtgaccgcctataatcgcacaaaaatcacttccaaaaaattgaattcaaaactctatggtttcgcggtttcaccgcggttaccgcacggtttaccgcgatatgtgggatgtgggatttgaactcaagatctctcacctcaggcctcacgcgtgttgccatcatacctactacacacatctagcttggataagatactttgttttttaattaaccctgaagacatctttagtactagttagtaacaccaatcggtactaaaatatcttaagttcagattgatgttacagtgctggttggtaacaccaacccgaactaaagatcctctagctttagtctcggttggtgtgttaacaaccggtgctaaaaatgtttctagggacttatacttttagaactggtagtaaagcatctttagcactgttttttaatctaatcaagatatttgtgttttgggggtgtaggatataaaagatcatttctctagtacttgtgtatgtatgttttttttttgacatattttctattcaaatttgtagtattagaatgtatatttgtttagatttatgatattaggatgtgacttattttatactaggttggtttattttgagattgagagaattaatatattagtatatgatatgcattgttttagtacttgttacactaattaaaattcctcgaccgaacgaaatcggcgtggcaaaataatcttggctagctaagtaataaatcggaggatggagagaacagtcgtcgttgagaatgtggactacaatatcatgacaagcaactacagtgatttcatcatcgacctccaaagcaggctcgctgagcatccagaacaggctaacttccacggccgtcccgtgctagcaaggcaatgccatcctaaacagccggcgagatggttgtacattaaccttgtgggcgagaacaacgatagggcaaccctagccgtccgggatgacaatgtctaccttattggcttcaggaacctgaacggaaaatggttccatttggggttctcgctgaggagcgttccgattcttccggaaccatccacgtttttggagtgcgacgtcacttatcgaagcttacttggtggaaatgtgaaagatgttctggtgagggtggacgtgcggaagatttctgtgatacatgccgtccatagactatcgggctacgcgcagcgtcgatgtggagtcgatggagccaccaaacgggatctagcacgcctgattgtcgtgatctgcgagtctgctaggatggctgcacactacaacacggtaaacgatggttggctcattcgcaacaggcaaattagactcgacctttggcacgtggattacctgtggaactgggggcttatgtcgtgggtggtgcagcagcagggagggaagatgtggcccatcaggcttataaactccggaatcaacagcataagtgaggcgctcgcagtactccaactgctgcttaacacggcgagaaggcctttgccagatctaccacgagcttcaccgccgccgccagtgctctatctgccacgtcaggcggcaccggcagtaccctgcccaccggcgcctccgttatggttgccatcgccatcggtgccgtcgtcattggcgttacatgtgcccctctttcatgcgtcctccttagaaagatggagtcctacagcattagctatggcgccgccgtcattgccgttacgtgtgccgttctttcatgcgtcctccgtagaagaaaagactcctgcagcatcaactgatggcgacgaaggatctaccgtcgactactgtgttggacgcttattagtggaggtgttggccgtgtggtccagctttgacagctgtaccatcgcagtatttgacgggaaacgcggccagatcatctacgagaaccaccgaggagatcacgatggcatccacgattctcaggtaaggaggacggagtatatatatatggactctctccgtcccataatataaaagattttgggtggatataacattcgtacattgaattttaacagatcgtctatttagatttattataccaagatatgttacatccatctaaaattttttatattataaaacggagggagtacgtttctagctatagtcttaccgttacttcttgtgaaaatgaaagatggcacattcgtggatgtgcatatactactccagccagtacttctctctgtcctaaaatacaataatttgaaactggattgaacatattttagtcgtaggttgtattttttttagaattaaatagtacaaagcagacactcacaacgcacgcacactcacgaatttgaaaagcttataagggtggtatactaaccgaataatacctattggattttaaaagtacgatttcttcatgaattttatccgttagcgttgcatgataaatttaattttgtcatttatagaattacctgctggagattgggttcaaaaattatggtatctagggcagctgactcttgaagttccattagaaaaatagaaaaatagagaaaacttatattgctataaaagacattagatatataaccatatataaattaaattacgcctgcttttttctttatcagaatttttagaattttctttaacttgttaagagaatatttaggagcattaatcacatatttgatttaattttaaattttttttgtgttgtttatcaatcataaaatccaggtactatttcttacttcgtgcatgcatgcctgccgggcatatgtaaattctggtctatgcaacnnnnnnnnnnnnnnnnnnnnnnnnnnnnnnnnnnnnn

SEQ ID NO: 56359 - DNA, 1445 bp, Oryza sativa
  unsure (1)..(1445): unsure at all n locations
nnnnnnnnnnnnnnnnnnnnnnnnnnnnnnnnnnnnnnnnnnnnnnnnctcttccaccgccgccgccgtcgcgcgcatgcagtaaccttgcctccgccgtgggaagccaccactagcttgccagatccggcgtcacacaaatctgcggtgaagtatctcaattcgtcggttccatctgcgacccatctgatctcccacacgcagcagcaactgtcgctgatctgccgaaacaattgaagcactttacacgcagttggagtcttgaagaaatcgttgtaggtttgggcatttatgttttttcttttttttcctcttctttacgtacgtgaagccggcaaaaattattaggcaataaattgatttgttacagttagcacttagcaatacccatctaaactgtagattctttttcctctcagacaactgtccacaaccaaacaagcaaaatgtcaggctgcctggccaggcaagtttcatcaacttctcctatgcctttcaggcacacaaattcctcaggcatgatacttagggcaccaaccaaacagcctctaagactttttagcattgtccacattcatatagatgttaatgaatctaggcacatatatatgtctagattcattaacatatatatgaatgtgggcaatgctagaaagtcttataatgtaaaacggaggaagtatacgcttgcatgttgagctttgtgtgcttaatgggttgatctggcatgcttacatgtaggttttaggagtgctaataaatactatgcttgcatgttgagctttaggtgtttagtgggcattagctttatagaaagaagggattattaattatttagcatactcactattgattgtgtgctaatatgatgaagcctttgtcctagtgggccctcaagttgttcatgatgtaaccgaccacatcatccaatcaagacttaagttgtgtctcattgacttgacgtggatctaggaatctaacttgacttctggtcttccgtgcttccatccaacataaccttcaaggttgatctgtatggctagaagcattctacatggattgttattagctaagtttagtgttattagtacttacaatgagtagcactttgggagatcggtgtccaccgctcgtagcctaaagaggttgaaaagatcagagaagcccactatgatataactgggtggccccaggaagggcgcttggtcatgatgacccagtatggacatatcactattcttcctcttggagttcaatttatccacgtagtaccgacgcagctctcgagtaatagtgcccattctggctaattcattgtcttgatccaacggcatccctggccagaatgtgtcgtgatctaagatcttgagagcaacgtacacctccttatttagatctagccgtttgggaggtaggacaccctcctacctttcctttttctttca

SEQ ID NO: 56360 - DNA, 5718 bp, Oryza sativa
ccatctgtcaaccccctgaccaaatctagaggcctgctgggccggcccaggttcggtcgaaccctggtagcaccggctcagctcagccctccacatggacgctccagatgcactcctaatgacggttgcagggcatttctgacaattccaactgccataaccatcattgggaggctatataaaggggtcactttcttcattccaacacacactcaagcaagaagctttgatatctctctctctctctctctctctctctctctctcaagtttagttaatgctctagtgctaagtggagtagaataggatagttctcgaagtcctcgagtattcagaagatttcagtatggctctagtagcttttctttcttctttcgtaagactctcggaattaatagaatattcttctttatataccttcggtactttactctgtctgagtactggatttactttatatttgtgccgacatagttgtatgactagcctaccagagaggtgcagtggtgtgggtttaatgttcatggaaatgattgatctatgttattctagaggatatagagtaatatttgataatgtaagcatggtgcttagattattagatatcattaattgggcatatatgctgcaggacagtagaggtgggccgctgatggtgacaacttagtacgggtattcctccacgttagtatatattcctaagccaatttctggggagggtactcctccgtatttagctccggttggacggccatgacaggttgttataagaaactcagcaacccgaggtggtctctggaagctaaccaattgttataagatactaacaattgtaaacttttactttgcaagagctaacatgtgatctattactaggtttgtactgaatttatattttcgtttgtatcttaaaagaagttcagaagtggcgttgtacagattctttctttgtatctattgtggggttcataccgtatttacgtttcctgttacacaagcatggcttttttcaattgttcaaatcctattaagaaccatgcaaaaaaaaactattaggaaggtacagccatgcatctatggaactaagagttctcatgatttggtttctctttccaggtgctttctcacttccaatctttcatggaatggcatccatattgtgtattattaatcatgtcataagaaatggatcatttcaccaatcatatcattttattgtatacctctttgatatactaacattttggtgtcatttagatactggggtttgtcttcctgcttataaatactttgggatctatcaatcttattgtagactgcaaagcataatagaagatctaagaagatttaaaggtgacaactgacaaagtaagcatcatgatctgcaaaagatattcaggtttctcaggggatgtttatgcagtcatagcttcatcagtattcagagcgcacttcttaacctgtagatcttggatctctaatttccatttgtatcagctacgttgtgtgtttcaactacatactatcttattttctgagattttgtgggagtaagggtgtgtctctaaggtaatatttatcttgactttctgttcaattctagaattggttgattacactgccaatagaatttactaaaatcaagagtaaacatctagagacagaaaaaatctatatggaaaacagaattttattgaaagaaagagtcaaaatccaatgactaccctattgcattcttacctcttgcctattttgctttaatttttatctcagaccagaccattgattttattccaatgcaatctcttcaatttttgatggtttctcattgttaatgtggttcattttcttttgagttgattcgctctcaatgtaaggcattcattatcatgtaggtactgagtgttatacttgatttatcctgctaaaatatcagctcatgtgataagatggctaaataggctccttttcttccaaactcaatcttaatatgaacagatgtgctcagggccagtcctatgattttgagggccctaggcgaactcatcgtgatgggccctctaagctatatataaaatttattgatatatatatacgctaattttacttacaaaacggaaacaagtacatccatatattaaatttaatatgcttggtaattatcaagaaataaagtcgaccaaaataacaatatatttgtaacttggaactaatatcattattcattaacttaatgaagaatagaaccctattccattgcttcctatgaaaagatacttcttctgacatttcttgatgtaaaatcatcaagaatggtattaagatcaatattgtccaagatatcattctcgattgagtacatagccaagccatttaacatttcttgcgacatagttgatctcaaatagttcttcaacaacttcaattttgagaaacttctttcagctgaagctaccgtcacaggtacggttaagagaattcgataggcaactgaaacatttgaatagaaatctgcatccataacaaacttcagaatctcaggtgcggacattgaagaatctagcaaactcacttgcaacacctttaattctaaataaaaatcattgatctcaatatcggatgacgtactagattactagtattaggtgttggcccctcaccattatgggtccccggccgtcgcctcggctgcatagggccagggccggccctggatatgcttcatttatatgctagccttgaggttttcagaccgtcatcggcattaagatcatcaaactgcttgtcataatagtatagatttaagtatcaatatgctctgtcatagccatattatcaagttgacctgacttttttagttaatgaaaactttattgaactcagacaattaaagttgaccaaactatgtgaggtccacctttaatatacatctagatccttctttgatagcaaggtaccacgcttcatgtaacaactctgcaagctatatgacaaattggtcagatttaggtataattttgcatgcttatgcatgatactttcaacgtgatgcttgataatagttggattatcaagtttgaagttaaattcatgtcaaatatgcatcatttattgactcaggtatccctgtatgcagtgtcctccccgattggattttgagcagcgtgagtgtctcctggcacagccattatatgctctgctagctccacttgatatccctgccctggcagtgagcggcaaatacaccaacattttgcttagatgttacaactggtgtaaaagaaattatgattccacagcaactgggtacagatattattccctgatatattttgggttgttgctgtggaatgaagattactcacagccgtgtccagtcgagccagcctcttccggggtaccagaactactttggcaaggggcagcagccaccttcccactaccagccatcacaagatcaccaccccaactccacgaggatgatgacccaggcaatccgacaagcttctaaggtgctgattggatgctggtttccaaagattagttatgctgtgcatcatggacaaattatgttcatgtagttataaaaattttttagcccaagaattagatggatccgaacatatagaagttgtgatgatatcgtgtggctatgtatttaataacaaaataaaaaataagtaatggttacaagagtctcagtagcaccttagttcttgggtttgacttcccatggaaacgatttttttaggttttaacggtattgtgctttcagtgataggcgatgtacccgtcaacagcgaggcacctgtggtgacttcgtcaatattcaggatttgccgcccatgggaacgatttttttacatgcattttaaatttatctaattatatgcttgattgcgataatatatgatctctttagtttatttatatgcattatcaaatattacggtagtgttagcacagacaaattactagttttataaattacactataacttacaagatattacactgtgaatttgataagttcacagtgtaatttcaaaattccattataagttttaaagtacaatgtaagatccataagtattaactttgaatttcataagaaatcaccataatttaaactttcaattttaacatcccagatagtcaccgttgtacaatcatagcacaggacacacattaaaaactaacaggcatattcttttagcctatgtaggccagccaacaaacttccgttggcccatattgcttgcatgttaacccatcaactgtaggcccatgtccgaaggacagttggcccatgaaaacacacagatctagggatggcaacgaggctgcacccgtcgggttctactaccccatccccagagtgagaaaaatattccgtcaccatccccatccctgcacacggggaagatttctcctcgtcccgtccccacttgggtaagaagcacccgctgggtgcccatccccgaaaattatcagcaacatcaatgctatacggaagatagaaagcagcaagaagcataccaatgctatactccctccagtttcattttaattgatattttagacaatgacacggtttacaaaatatacctttgatcttatttttctattataatatatataataaataaatgcatgtttatttttattatagtgtatcttattctagtttatgtaaactaaatattttaaaagttattgatggttaaaattataaaagtttgaccttaaccttgtccaaaacgtcaattattatagaacatgcagcaataatgatttcatttagccatcggcaacaacaatacatggctaaacactaatgtacacagagttgctagaaatatggcgccactttttgtgtaaaaaaatagtcaatttttagaccctaggatatgtttcaagattcgtgcgagtgctctccaagagaaaacacgatcgataagttacagcaaaaggcttttgaccaactgagcacaaagatggtactcgttctttactcaaagtaattataattaataaaaattacactatagtaacttacatgccacttacattgtaattacatactaattacatatataattttaggacttacatatgtaattttgaaacttacagtgaaaatatattaaaattatatatgtaaattttagggacttataatgtaaatacatatcgataaaaaatacggtgccatgtatatagatagtcccataagaaaagttatggtgagaaattgtgtttaatactataattacactgcacttacaccttacttacattgtaatttatattaaaattacactgcacttaagtgtaaattttgtgatcgctagttttctatcttaatttaatttatattgtgtattataatcaagttacttatttgctatattgccacggctcgttaatggtcaactttgtgtttgaaatggcggtaatcagtgtgaagtccaatccgagactaaattttgtggcgtcatatatatagatggacccgatgaaaatcgtactttagcgtcaacaataactaacggggctgtctatatatcatgtgacggaaaatctcacctcctatcattcaaattttaaaccattggatgtgctttaagattcatgcagccccttaaccctcactcctcctgctccttccccggtttctagatcacgccgccaccctcctttttccgtcccacgcgc

SEQ ID NO: 56361 - DNA, 940 bp, Oryza sativa
aaaaagaaaaaaaacagagtttggaactgcggcttcattttgatagcctctgctcagtaggagatggcacacataagcacggcatgttgacacagaattatctattttgatgaattattctgccaaaattgacaattttaagttacaaaggtggaataaccagaacccacaaaaaatgagtctttggatggtattcacatttcccagcttaacatctgattggtctccccagtgcacccaaaaaaccagacaacctaacggtatattgtgttcctcaagaagctagtagcctcttaatttctgatttctgctcagacgtcagccttgaggggaatttgatgttgaacttgatcctaagatttcccttctttgatggatccttcggaattggcatgccctctcggagaacaacctcctcgtagccagggtagacgacattattgattggtactgttaggttccgaccatctagtgctgttacctgaactgtacatcctgtcaaggcctcagccaaggaaatcttctgtgtcatgacgagatcattcccctctcgtgtaaacagatcatgtggtttctcatcaatcacgaatacaatatccgcaggaatcacatgcggagactcgttacccttttcaggaaaagtaatttttgtccctttcttccatccaggttttatgtcgattgttaggatctcctcaacaaccatggttctcctgccaatgcagaaatacgctagtaaggcaccaaatggaagtctattgcaaagtatataaaaatggcatatcaaatattgaagacaacacaagataaacacagaatgaaacagactggataagagcatgtcccatatgacaaaaaaatggaaattagtggaaggcaacagtaacactcaaaataatccgaagcatagtactaaatagcggccactattgcagtagca

SEQ ID NO: 56362 - DNA, 7646 bp, Oryza sativa
gtttttcttcttgtgcctttggcagaaggatttgatcctctcaagaccatccaggagagaagatgaatcaatagcaaaagtaatgcgaacccaattcttcattcccagcacactccctgcatttaggcaacatagttaaattaggatacgtaaagtatatgtataaatacattattcgtaaaatagaaacattaacaaggctataacatttactttatttaagatattatattaaatctctagcttaatttactactacagagttaactaatatttaaagtggtagcataatattagatctctttgttagtttttccttcagtacttaaagtaatcaacatccataaactaaaaggacaaagtacgtgtacccaaatattgttggacattgaattatattttctcatataattaaggcatacgcaatttttatttacatgtgattggccctgttcttttcctcttacagattatggattcttacaagcacactttccaagctcatggatggtgcggtttttgcaaaatgttttctacatataagtttcttgtattttaaaacaacttttatcttttagatagtcaatatccgtttgtattctcaaatattataaaaaaagcagatgatctttcatttgttcatccataagacaaaaacaacaggtagggatataatgtgcctgtctgaatatcattgcatcactttgctaaattttctttcatatatagaaataaaataatgtcgtcatattcatatatcacatataaaaagtttacatgcaatcaataaaaaactcataaccacatatatttaaatattctaactaaactattatctattagtgattagagatgcaaaactaaaagtaattaactattaactttttttaagcaacaaaatcatagaataattttcaaagtttcataacaaaattaattaataagcataaatgtttagccaaaaagtaatcattagatttgtgagaaactaaataaggtagcatcacttatatgtcatggtatagcgttagagaattacaagaacataacaagtgaattgaataatataatattaaatttttaactttctttaattaaataggcacatacatatccatttattaacaaaaatgttagatgtacctgggcaaagaatcaccgactcttctttcgcaagttggcaacaaaaatcaacatcatcatggattccctccaaaagatataggttcaatttcacctgtttataggatttcaatgtaagattactggaagtgaagcttaagtgacaagtatgttgtagcaacaaaagaaaattgatgttaacatggcaaactacaacttcctaattatagcattattcttcaacacaatacaccaaaaatttctcatgactctgaattaagtgttttaggtgccaactaaattaaatatagcataattattttttgagtgtgataaattgatgctagtacagctctaatgataaaatgatttaagaggaaatcttaccatcacaaacatggatccttcgggcttgtgaggacaagtgatgcatttaatatcctttattcctctatagcaaatatctgatgtttccgtaagcaaatcaattatcctcttaaagaattcttccttggtattcttaagaatattcggtagagctccctaagaaattcaacaacaaaacatgcacaattcaattatttgagataaaatgaatacacgaggccaatataatatttttaaagcaagataccaataaataatctcagtataagaattgtatgcttactttaacgtaacattgaacttcacattatcacttaaataactacgcacctcagagtgaacacaaaatacaaacctcatcttctcaattaatttttaaaacatattattatgttttaacagaaataggatgaaatgaacataaaaaactgaattaaactttttttgttactttgatgaacttatgtttgattataactctgattcataagtactatttatttggtaagtattcgatagtatattttaaaccagtagtttttctcagctacaaacaatgctagacaccacactgtgcattttgaacagccatccaatttccgaagagcgaccacaacacatagtccaccaaacattacataaagcagataaatgaccaaaattataacccaaacattggcttgttaaggaaaaaaacactaacctgaatgaaagttgctggatcagttgaaacattaaggaaattagtaattaatgttgcaatctacaaagaaagtagtatacacttagaaaaatatatatttcaaatatcaattcacaaaaaaagtatcaaaacagtattaaatatatattttaccttggtttcttgtagagtcttcttggggtcacatattgctacccaaccaagtcgccatcccggcactatccacctctttgatagcgatcctatggttaatattggtacgatgtgcccaaagcaacccattgggacaaatggggaactcccaaaaaccaaattaccatacacctcatcagtaattaccaatatcccaagcttccttgctacctctgccacctaaataacaataatacatatgcacattaataagttgcccataatattatttaaacttttatcaaatttaaataaaccagctgaaccttggataaatgctcgtaagtgtacacattcccgcatggattattgggatttatgatgactatcgcagtagtgttcttgtccgcaatagattctagggagttaaggtcaatctcccagcccttctcaggaataagatcaaagtgacgaacttcaaggttgttgaacgcggctcgagcttcatagtttgggtagcctggtctaggaagcaatatgtttgtgccaggttgggcaaggattgagattacgacctcgatggcctgagttcctccagcggttaggaagatgtcatcagaagatagcttgtatgggaggtcgcgtgacaaatgatctgccacagcactatattcaaaagaaaggcacaagattaatcaagatatattatgatataattaacaatcacataagcaagcatgaaccaacatcacgtaaatgcctctttcaggaagaactgcatcctcggcgcaaataaaacatttaattaataatcatacatgaaaaaaaaaacataatgaacaacatgccattattaaaaaaaacagcatgtaaaatcctttctaaagaagaaatgcatcatcaacccagaaaaaccgaattattggactatatattcttctcccctgcttctagtccacaaaaggcacgattgttctcaattcaaaagagagcacattttccttcctttcttttcctcctctttcttttgttttttcccccagaaatccagcagctacagccttcagtcctacagctagcacagatgcacaatgaaggctccatccaggctgtgcgcccgccacgtcggacgagccgcagcagccggggggcgtgccagcacgcggtgggggcgggcgtggacgacgcggggctcgtgctcccccgccgcgggcgcgtgcgccgctcgggccgtacgtcccgtccatcgccagccgttggttccacttcagttctcctcccctactagctctcgccgaccacgggagtagtacgcctcgagatcgacgccaatacagtattcgcgcacatgtgacatgtgtaataacactacttcaataattgttttcttcatccagtttaaattcaattaaatccatggttctatatgggtttgaatcgaaacaaatcttccccgggattacattacagggaggttgtgagttgtgaccctactgacctcgtgttgcatatggggttgttgttttgccggttctttttttcaactctgaactccaaatttctcatttttcattagcacacttttcaaactgtaaaattatatattttcataaaaaaattatatgtgcaagttgtttaaaaaattcaaataaatctatttttcagtgctacagtccttaaaattatgaccaaagtgtgctcactacaacagagaagacccatgcagcttaattataggtgcctgatgatgtgtatatgaaatatatatcacccgtacatgttgcaaaataggaatcggatcaaagtgaacaaattatataactggtgggtaaagtagcacgcttttgttagtaaacaaagaatggtacgcagactaggggactgttttagtttattgccaaactttatcacgtctaaagtaggcagctccggttcttctggcaaaacgtttggcttataactgcaattgtagcgtttttagatttgcttatagactcaatttgcaagctgatttattttggccataagtgtggcgagctttttgtcgagtgtcgaaaaactatagcttgctaaattggtgatatatgctgtttggcacacaaaataagcaaatgaaccaaccagtccctaaacactattcgtataattcgtattataattatcattaatgaataaaataagcactattagtaaatacgtgttatcactggctcgattcgaaagtactctagttgataaattttttaaactaaactattcaattttgaacgaaaactggcctcactatatatggctcgcctcggctcagcttgctagttctcgttaacaaacaaatagttgagaaaatttaataaactaattttaataaaggccataaaaggcaaacatgaaccatgcacacgtagcgaacaattaatcggcaaagaaacggaagcggaaaaaaaacataaaaccaaaaccgaatatttgaactcgccggaaaataatgaaaacaaaaaaaaaacggaagtggatggcgtgggtggtaccgtcgcgcggcggggaggccgacgccggcggggtagcagttgaagtcgccggagcggagcgcgtcggcgacggcgtcctcggcctcggcggcggtgcggaactcggggaacacggaggggtcgccgtgggcgagcggcaggacggggcgcgggccgcggtcgtcgacgctggcgctgatcttgtaccgcaccgcccggatgctcatcttgtcccccgccgccgccatcgcgccgcccctcgtcggcgccgtcagcctccactccttgctgctgccgtcgctctcgccgccgccgttgctgctcgccgccgccgccgccgtcgtcggtgccatggccgtgctctgttttttgttggtgaattccggtgcagaggaggaggtggtggtggtgcgcgtcggatagctagtgccgctatatttgtaggagattctacgggtgtgggacacggactcgggtggggcacagcagcatgaagcatgcatgcgcgcctggtgcttggtggtggtgcacgaggagtatataagccccgttcgactcgaattagatacgaatgcgagatttttcggagcacgccaaacgagataattattataaatttatttataaatttaataaataaatttatttagtatttttatatattttttaaaaaggttttcgcacgaaacatatatttaataaacgtgttaatgggaagtgagataaagatagaggcccattgcgacctgatcgatcaatgttggtcagacgcaagccccggcaacattttggcttatttttggggaccgtttcggactcttgtggaccgtatatcgtcacggaggatgcggcaaagcatgatccatgcatgctatgcggtggttctcccctgagctgagtgacgaatgcttgctgctattctttatggaaaagaattatgtgaccattgcactaaggctatccccaatccttcatatcatctagtatccataacattaaatatattgtcacatgagtaaaaatctgatgtggcaagagagttaataagtagagagataaaaagatgaagaaactatttctcattcaagaaaccatctctacacaagaaccaagaataaaaataaagagattggttgataaaatgagagagaatgaagatgattggatgaaaatttaatttaaagacacaatccattggatatatagtttatatatatactgtctaaatgatatggtaagtatggaaagttggaaactacttgatagtttctgagtaagactgagttttaggcggtaacttcaaccaacaactttcttatttttggttaacacgcttttaaacgactaaacaaaattttttgtggaaaaaatataaaaaagttttctttagaaaaataaaatgaatctaaattttaaatttataatagctaatacttaactaatcatgtattattgagttttcttgtttcatttgcgtctgaaaatctccatcaaagccaccctaaaatatgaggcctcgtagggtgtgtttagtttgaggataagaaaggatgggttagacccatccgtattatttagaattggatgattccattatctgtttggcatgagggttagactggtctcgtcttttcttatagatgggaggatgtagtccacttgtcagtgagagagaaattatgttggactggtctgccaaattttgaggtgtgaagctcatccaaaccttggaatattcctttttggaattaactcatccttatcaactattaaataatcatattaaattataatgtattaggacatttcggccaatacaattgtaaccttttgggtttataataaaaaaatacaataattatattattataaaatggatcgttcacctcaaaataagtgcacctaggtaaaaggtatataagcgggtttgcaagcctgcccgcttgcacccttacacctaggtaaggatgtgatacactagacctatgaatctgtacaggctattcagattcgtagttcatatgttacatccttacttaagtacacttattttggaggtttttccctctgtgccattaagaaagatggtgcctgcttctgtgccactaaaaagttcgagcctccctctatgccatcgtcaaactttattgcgctcttcacaccattccgtctgtttttggtcgtaacggtgggtaactgcacagccaaatgacttagttgtccttagacttgagacggcacacagggaaaaacctgctctctctttctctctttgctttcttcgtttctctccctcgcgccttgcgttgcttggcgcggcgaggctaagtccaacgggcccgcccgccgaacggcccaaggcgacgggcggcccggtgtcccggctgggcggcggctgggcggcagtcagccctacgcggccggtgcagcggcgaggctaggtgcggcggcgcggccagcgaccgggccaaggcaacgatggcgtgagccgtggcgacggcggcgcggtgtcccggctgggtgacggcgggcggcggcgagccctgcacggcggcggcggcctgaaggtggccctgcagcatcggggaagaaggccgggacaatgaggaggatgggggaaggccggcgatcgggccaaggcgacggcggcgcggcgcccaggcgccggtcggccctgcgtggcggtgacctctcgatatctctcgcgggggccacacggccagatcgtcagaggcgccgtggcgggcccgctcgttgccgccaccaccatcgtcatcatggccatcgcgttcacc

SEQ ID NO: 56363 - DNA, 5999 bp, Oryza sativa
  unsure (1)..(5999): unsure at all n locations
gggcccacatgccagagataccaaacggttacacctaaacagaataccgacggaatgttgtggagggcgcgataaagttcgccgatggcatagagggaggctcataagtttttagtggcacagaggcaggcaccatctttattactggtgcacagggaaaaacctacttattttgagagattatcatgtaactatatttaaaagtggtactccctccatcccaaaatgtttgacgacgttgacctttttaaaaatgtttgaccgttcgtcttatttaaatttaattattaattcttttccaattatttgatttattgttaaatatacttttatgtatacatatagttttacacatttcacaatagtttttgaataagatgaacggtcaaacatgtttaaaaaaatcaacggcgttaaatattttaggaaggagggagtagtaacgaaagaaagtatgacgtagataaataagtttttacctatacataatttaattatcaactaagccaaattcgatggaagaagaactcatgcttgaaacggtataacaagtggcatgttaatttcgatcaattaatattggccagaatttgaccaaaacgatggagtaggaattaacagcatatagaccagaatggatatgccactcattgcaaatcattctaggtggttgaatggtgcatatatgtcatctactccctccgtttcatattacaagtcgtttatctttttcctaatcaaacttctttaagtttaaccaaatttataaaaatatatagtgatattttcaacccaaaagaagcatattatcaaaatatattaaatgttagatttaatagaactaatttaatattttagctgttactaaatttttttataaatttggttaaacatttgactaggaaaaaaattcaaaagactataatatgaaacggagggagtagtcaatgctaaaacggagttgataagctgatatctgctcatacttgtaaaatattaggaataatctaaggcatcctttgaatcacataaataaaaaaacagataaataagaaaaatatagaattctgacaggaatacaaatatgcataggtttgcaaaacacataataaacataggaatgaccatttaattggaccgtaggaaaaatacaagaatttgaggagagataaacactcaaatgattttttccattagattctacctcatgttaaatttcctccaaaatttacatggaaagagacattccatagaaattttataagatttcacagggttcattactgtagaaataaagctctctaaaatttctgtgaattttgaatttccttataatcaaaaggggactaaaataggaagatggtaaaaaaaaattgataagccgtgctaaggtcaccaccatcgtgtacccgtcaagtagaaggggctccagtccactgggccaagggcggagcttcatagacaccatcatgggccatgctcctatggtccccaactttcctgaaaatcaatgaaatcattttttttatgacatcagtagctagcccccatggccaataaattttacatattagcccctcaaatttctctcaagctctgttactggttagggacatttccatctagcaatggtgatttacacgggtgaatttaactatttgccactattgcatttggcaattataaaaataccctcttagttttcagcttacaaatttatcactctacataggtgacttcttaactatttgtcacctttatctacgtggtttacaaacatgaaaaacaacatgggacccacccgccagcctcttccttgtgtccatctccctctccgatgcacgcgggcatgacatcatgggcgaccgggtgcttggccaacctgacgcgaggtacttgaggcggacacacacccaagactcttacacaacaacgaagaacctctcaatgatgagcaggtggcgaccgcgccaccaaggtggaagccctacatgtgcgccacgatgcatgttgacaaatggcagcgaggaggaggaaggcacgttggaagccgtagaacctcatgcgcagcacgatgctctatcctagcgtcacgacaacgccgtcgtcgttggagtaggtccatcccgtcggtgtgtgtcggagggggggatggagagaaggggaaacacacactcctggggatagagtggcgagcgtcatccgcggcgtggagggcctacccctcatcgtcggtggtaggggtgagcagaaaaagactgagatcgagaaatttggtcatcaattcgttcctaagtagtgaaagacagaattttgtttggtcaattcgattagtctcatcggttaaccgaatagattgaaaagactgaattaacaaaaaaatgtctaaatgcaacctacaatccactaagttcaataggattaaactctattttttacatttctacttcttctaggcatgcaacctaataaaacctaataagagtctttgcttatagaccgagaccgaatttgtcggtcctgacatttttacgttgaaatttggtcttcactttttaaagaccgaaataaccgaaagaccgaaaaccgagaccaaaattttcggttagaccaaatgtccacccctaatcggtggggctagtgctcgaaagctactcactacaacggtggttgttggggtggcaacagcaagatgagagaggggtggcacgggaagggagtggtattgggggtcgtagcgactagggatgggctgggggtcgtggctcaagctcgccgtgactgtacaaacacgccaaagaagaaaaggaaggggagagtgggagaagctcacggctgagtcccacgctgtttttttcccatttgtaagccacgctgacgtgccacgtaggcaaaaaacctctttagagtggcaaaattgtaagctggaaaattgtaagctggaaaccaagagagacatttagataaatttatctactgtgatggttcccctaattcctctccatcaccctgacaggcaccatggtggcgaagggtgtctatggcgttattttatccaactctactctagtggaatggacagagataaattcgggtgctttggatattttagaaaaaaaaaactatcgacggtgaagacacaaaggaagaaaaactctttatatgatgataaatcgtactccctccatattttaatatatgacgccgttgactttttatctaacatttgaccattcgttttatttaaaaatttatataattatcatttatttcattgtgacttgatcatcatcaaatgttctttaagcatgacataaatattttcatatttgcaaaaaaaaaatttaaataaaacgaatggttaaacgttagtcaaaatgtcaatggcgtcatacattaacaaaatacggagggagtataattcatgtttatagactgcaattactggtataaacaggagatgtagagatcatgtgctgatgcattttctggaaacatctcaggatcatttgtgtagtatgagtatctatcaacagtgtctttgtacctctgctacacgtttctccgtggagacatggtgtgctcatcgttgcacttgaccttgctcatctggcaggcaccacgcaagcacttatacgtcagaatcatacagccaattcattgctgacaagaactaggttttcacagcacaacttggcacggacagacaggaactctcacttgtgtctactccacaagacacttcgattgcgccaaagcaagagcgaaattccacacttaaagttatgagcgatcattatccttgaactcttcaaaacaagattaacacaaacttatttacaagcactcaagtctttgaggtcacgtgttaccgaatggcgacatatgtacagtaccatggcggcgtagtgacatcaaacagtcgcattcagagcagaccacataactgataactacatgatgaacttacgccaagaacctattgtgacatatatctatatcacaaaaaancatagataatgcatgatcagctgctaaataagtagtgttgcaacttacaatatcaaggggtgcactatactccgccaaggttaatgatagttcaccgagtcgacaacatcaccaatccatccaggatggaacttttattcccttctgcttgaagccctgtgtagatgttattagtgcaacggtactgaaacagggtaaattgcacagaaaaataaacaatataaattttgaaattttaatatctgcaggaatcatcataaaacttccctactcaaacccatattaatatttcatgttctttaatgaataaagcattttatttacttgtaatgtttttattttaccatatcattaattaaagaagctgccaggaaaattttctactgtggtgcatcgaacaattatcttatctggaacattgtataagggtgatatcaacctaacaaacacatatgcaagcaaactcaaattatttactactctcatgtgcaagcaataggacactgttatctgcaggtaattgttcagtcacacagttctatatttagcttccatagtatgaatgaatacactacaccatgccagtacatatagaaatatgtagagactttgaatgtgagttgttgaacatttcagaacacttaacagaacaatagcacttggcaattgcatatcttggaaattcttaactagttaactgcagcagttgaagatcatggcagtccttaatcattggtcaaacccaacaatgttttcattttttttctcgaacatacaggagagctgagcatcgttatattaagaaggaaaagagtccaaaaggactcaaacaagcccattagggcagattttagtacaaaacggcttgccaaagaaatacaaaaggactgcgaccatccatgaaatagtttagttggaatgttttcatgttttcagaggaatattatctggcgaataatcatcagctaattctgtggcaaaagctacgcaaagataggatgaaatagttagttggaataattgggcataaagcattcataggtggctattcaagtctgcagttatatacccaggcttcctggaaaggtgggggaaactaccaagctgaagtgaagtaggggcacacagaatttccagtgagtgctgaattggatataggaaagaagaccaacgtgaaagcactccatttggccaatactatggttgtgtttagttccacactaaaattggaagtttgaagaaattggaacgatgtgacggaaaagttggaagtttgtgtgtgtaggaaagttcgatgtgacggaaaagttggaagtttgaagaaaaaagttggaatctaaacggggcctattttatattgcatttattatccctctcataaggtattttagttgcgcgtcgctttttgtgatgactttttggggtcttgaggggtccttttggatccctcgtttgtacatatttcttcttcttcttcttcttcttcttcttcttattaataaaataaggcgcagtcctcctgtgtttttgagaaaaataaggtattttagttttgggtatattattctagaatttcccacacagttctctttaccctggtgtctccaaaaattatatctcatctggaacatttttttttaaaaaaaaaagtaaggatgaccaccagcagaaacctcctgtcaggcacatgtatttaaccacccactataaagctaataagtagttcggattatgcagcagtcgtacccacaaaaatacagcatttctgcattagatatatgttcagatgaatgtcaaaacaaatgataatatatactttctctgagactctgattccatatacaaactgtttttatacttgtgcacaaggattaagaaagtgatcaaatgagttcgttgcccttcatttatacatagtgggatacatgttcatgagtgataatatgtattcaaaaaggacaaaggaaaaaagagatagtaaaaggtgc

SEQ ID NO: 56364 - DNA, 805 bp, Oryza sativa
aaaatagaattattttaaaaaaggcacgatgggccacccgtgccttcgggccgacctggcatagcccgactgctggtgggccgtgcttgggccggtggtgcagcccatgggccggcacggcatggctcggtgtgttggtcgggccatgccatgcctgggccgtgccgcttgtttggctaactatagtcgccacccccaagcagcaccaccgctcagctgttgtcacggtgtcacctactccaacacatttacgcaaagattttcgttatcgggattgctatatggcattcaaatgaaatttggggatgaaatcttacagattttagaccattggatccatgccaagattcgtgcatcggcttctctccaactccgacaggctccccttcttctccggcgccagcgacaccccgactccagagggttagggtttggagtgagggtaggaggggggatgggggagggggaagagggggtttcctccgggcttagagggatggccgtgggcggcagaggaccggcggtgggctgtggactccggcgagcggcggaggaccggccgtgggcggtggactccggcgggcggcgaggaggcggcggcggcgccgaagccgcggggatggaggagggcagtgggccggtgttggcggtgggggtaaagcaagggtgggattaggtggcggatccggcggcggggagccgccgaagacggggaagaccgtgggacggggacacctcatcgtcgccgccatgaggagaaagtgaggggggaaggggagggggaagggggagggggagggggctc

SEQ ID NO: 56365 - DNA, 16059 bp, Oryza sativa
  unsure (1)..(16059): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaagaatatggcatcagcaaggaaggagaaggcagtatctagctagttttactcccctgtatcttagaaaaatgttttacaacacctttgagcattcataccttcttttatatcatattatgtgtgttcttcgtttcttaggccagaaatctacaagatagaagcagctgttgtaattccagatttcttgaatcttggtatgggatttgcctctcaagagtaactctgaacatacttggttgggatagtagtcagttcttgtcgccttaaatgaaaaatcatgcatgtatagctcactgtattatataacctgataatgatgatgatgaatcgtaaaaaatggacggaaatccaagaatgcttcgtaaatatatgtagctgaaaataaattgactcggataaagctaggaaaaaacagaaacaaagtctcccctcattaattaatttagtaggaagagaagatgacaagagtgctatctcattgatagaaaaatagaattggcggaatattactccctccttccctaaatatttttgatgccgttgatttttttaaacatgtttgataattcgtcctattaaaaaatttaagtaattattaattctttttctatcatttgattcattattaaatatactactactatagtttttaataagacgaacggtcaaacatatttaaaaaaaaatcaacggcgttaaatatttagggacggagagagtattacccaacaatacaattaaacacgacgtacgcacgatcattagactcaatttaaattacgacaatacaattagccagtctctcatagccgaccgatcagctaagcgacatacacgcgtacatgcaactaaatttaaattacgacacacacaaaacctagacacacagcaaactaaatttaaattgcgacacacacacagaaacgaaccttagctagctctctccaacctcactaaattgaacatgacacgaacacacacaattagtacagctacatagtactacgctactactcctatatgggacacaggtgcatgcgtggcacggatcgatcacactagaaaatgatcgaactacgaacgtcggcctgcaggaggtatcttcctgggcggcgtagcgtccctggggctgtccgacttgatggagcacagctcgtccgaatcctcgccatctgaagtccgagttatgatcaagtcgtctatgtccagatacatcggtggcagatctgcaaagtttattaattttacagcaattaatgcatgcaataatcaagtaagcaattgaagctatggcaataatgcaagaaatcaagaatcaagaagaagaagaagaagaagaaagctagaagttatataccgtgtttctccctctctcgttgtgtttcactcacgctctgctgcttctgggatgatgaggatccctgactttgctcaccttcacctccatgctgctccccggtgcccttctttctaccagacttgagagctaccctgtgggccgctagatttcctgtaggttccacagccaactcacaggaatattaattttcttgacggggttacttatacccacagaaaaattgtgttatttttgtaggttttcacacagacccacagaaaaatagcgctgacaagtaggcctcaagaaccatcaaataaaactcaggcagccaagtcccaaaacctaattccccacccctcttcccaaaccctcgagccgtcgccgcccctctattctctccagatccgcatggcgagcgcctgtgcgataccttcgacgaacggcgggtcggctaccgagcctccgcccagcgccatcggcaagatgcagccgaccatcaccaccatctcctgccggcgacgagcttccaccatcccctccactgccggtgctagccaccccaaggcccaagctcagaacctctagatctggatgccccaaccctgggaaccacggatccagccgtatcgagtgtgggtgctccagatctcgcggttctcggctccggcagcgccggcaggagaatgggcgctgcccctccttcccctcctcttcagtaagtaaaagcatccaaaaatatgtgtttcaatggtgaggaaacggtttggagcacctctgtccatgctagcatgtgtttccgctgctaatcccaaacaccgatttgttcagatagccgccggcggagatttctaggagttcaatttaatctgctccaaagttgcagccaaccattctccttcaggatgaaaaagtgtaagtcatactagtttacacttgtggattattttggctttgatccgtattacgtgactgcccagtagtagatctagattgggttattggcccttgaccacaagtttaatgattgtcagtggaatgtcagtagatctagattgggttcttgtgtcaaaacctgcgttgctgcattcatcaactaatctagattggattagttgatccattactgttgttgccaattattattttttctcagagctctgattcccagatattaagcaagacaagttggttcccatattgtctacattatgtgatttagtttctataatagaaatttaattttcttggattacttactcctagagtataatatttattttacatctaaatgatttgtttcttgtttcagccttgtaagacaattatgtctggaccaactaattttcctctagccattttgtgaagacctaatgttgtggcatgacagattgacaggtactcccacactagagtccctgctattcataaaactttgtttgtgtctggtactgagttgtttgacatggaattaatctatcagtggattatcatgcactatgctttcttggtcacatttagttagaatgcagatgcttttcttatgctatttttaccttgcaattcatggtaaggattgtgtgaataatgagtattatagtgttttattttctctgttttagtagctaagaaaacatatttttagctcaggttgtatgcatgaaatcattagtgctttctagtctctactagtgcatatacatacttcacaagtccaagtccatgtatatcttttggcaagtcacatactgctacatgtgttggatagatacatgccatcagaacaataaattagtttcagtctcttgtttttaaaattttcttatgtacaaaccctttataatttaccttgttcatggcactttgtatttttcttaacaggccatagcttgaatctttaagtgctgcagttaaatatctacagaacgttgcacatgatgaaaatcaaggtatgcttctcattcagtggatgaaatctttcttagtctaagatgtcctagcatttgcaccatgaaacttgtcatttaagcatccatagaaaatgagtttgatcctattatcctagcatttatgtcttatctgaattggcagagtactacaggaagtattttcatggtcacttttcatttcagttgccatatttcattttcatgctttgtagttgacaaatttatgttgctcacttcagtttttcctgtactaatctatttgtttctctataactggggtattcagaatcattgttatttattttgtaatgaagaaaattatgaaattgaacctcttttttaaaaccttttagcttcctttgcccaaggttgaagcaccacggaacacggactgctgctggaagacaatgttcttttacatatgtttgatgaattgtaactgaacacatttatcttttctatggaccctttgtatattactaaatccggtttgaatgaatttgtatgtactgaacttagatggactatttatgtaagctttgcagacttgaattttgatgtatggattgtgattgatgttcatatatttatccaaatcaccatgtgtttttttttgggcgtggaactcattttttctgacggtggatgatggtttttcctgatgggtccacgtcaaaaataagctttcacaaacctgacgccagttgattttttttgtgagccaaccgacaggaattcccgacagaaatgatatttctgtcaggaaaacgacagaaaaatttattttctccgtggtcttttttctgtcggcaaactctgacggtgcacccacagaaaagtattttctgacggtaattcatattattctgacggttttcggcctacagggtagacctcttgatcttctttttcttctcatcatcctccttcttgtcttccgacgactgtggccgctcagcacggttcttctgcctgtccattggagcttaatttgctagctaactaataactatagctaatagctaggcgctggctaactcgatcgaaaagagctgcttatcccacagcttgtctgcaggttgcgatgacctatatttatagtcagtgtacatcgatcattgaattgatctttgttcatgcttacctttaatttgcttctgacttgctgcattatatataatccaggtcttgagatgaccagatcagtgcggcgcatggatgtgtcaaaagagatcactgaacaagtatagtacatgcacgtgaactagctagctactgtaaaatggatcggagtacattgcgacagagagcacatacgtactgtgaaacaaattaaacatcataatctaattcttgcacttaaatgtccaaatgctagtttctcgcaatctctggttgtagcagaaagagccttaattttggatcttaagagctgctattattacttgatgacgagaagtctctgtactttaattagccgtgcatccaaccaaagagtgcctccatgctggttctcatttcggtttagaagaaaacggagacggcccagcaaaccaaaacgacccatctgtgagcatttaatttgcatgtgtacgccttacgcatttcttcgctaaaaaaatagttaaaatttttcgggcttggttttgtatatatatctctctccctgcccaagctcgtccaataactatcgtgggcctttttttttttggccagacttcttcggccccggggaggcaagcctagggacaatgcatatttataaatgaacaataatccaaatgatttaagttatttatatatattattatacggttggtcagtgttggagaaatttattacttctttccaaaacaaattaaccaaatataaaatgtttaaattcataatattatgatgtatcgcatctcatatttaattggtttattgtaagatagagggaatactattaggtacgcttgatcatgtggtgtgtgccttgcattcatatgaatactactctcttcgtcccttaatataagagattttgacattttagttacactgtttgactacgtcttatttaaaaaatttgtgcaaatataaaaagcgaaaagttgtgcttaaagtactttggataataaaataagtcacaaataaattaaataataattccaaaatttttttgaataggacaaatggtcaaacagtgtaagcaaaatatcaaaatcccttatattaagggacggagagaatagtattcatatcaaatggaccaaatagaggcagctgatagatatagggatgtgctacacaaagacaagctcaatgtttatgtggtgtgatgtaatcttaggagtgagcccatgaatagtgggataatgttaaagcaattcgcacaatgctattgctatggctaggatttaagtaaccataagatagggccacatgagatagaaaaaaaaatacttcagctcttgtttatgaggtgaatgagagagataaaaatattttaattttgtttgtgatagaccttaagtataatgtgcaccataaactaatgctacttaccacaatatatgtgacttattttataagtgtaattattattttaagattatatttttcataaattattattgttgcgctaacgccatatcgatcaaaaaaagtgagcagaggggaatatgcatgatatatagcatatcacgggtatgattttgactgctagctgctgctgtatgtatgataggcacaaagctggttggccatgcatgtactgcgtttgcgtggtccatttgaccagatcgacgtgagccaaagcttaagtgcggtatctccaatagggaagttttttttgctagtatcataacacttatcgttttgctaaaactgaaatcaaactttgtacagctttaactatgaacaaaatttaaaatatttattttagaagcatggaaactatatgtatatattaatattgaaatatactttaataaaatcatacattcatgatatttatttaaatattgtaatagaaaatagtgataaagttgcttcttaagattgtgtcccttgttcaaaacaacaagcatatttttaaatggtactacctccgtcccatataaattataattctagatggttgcatatattaaggattgagaaaaaaaactataatcgatgctccttattaaatgttctatatatagataaaagtggaggggtagttgagggtaaaatagagataaatttgaatgagaagtgattaatgagaccattaatactatattgtgataattattttgggacaaatttaaatcctagaaatataactattataggacagatagtaactagcactctttttaaaactaattaatatgggtgttaaatgctgcgtgcatcttggaatgcgttatatataggagtatactactagtagcttgtgtgcctataaatataatcgtatgtcatatttaaccatattaattgtgatatatattatcacgattgcatgcatggtcaatataattcttttatttattaattaatgtaagagtttctggcatttagagtaaacgcgatgttacctttattttactatgtttataatatatatagtccagtatatatatctgatacattggttgacaaacttagtattacttaaaaaaagatgacatcaatagcagtttatttcacgtacggtaaatcaatgcggcgtacgttgctagacaaaactagtgcgtaaaaagtttcgagcacacgcagtcataataatgcagtaatgcagatgaccaaggtgaatggggtagtgcatgcatatatacacttggtcaactctgtcgtatacagtagtagacatgtaaagtactaaactttattcggtctcgtcatcgatatatcgtcatactactttactgtagttcatcagctctgcatttgcatatgcatgcagatatgattcgacgaccaaaattaattaaggctgtgtttaatccaaagtttgatccaaacttcagttattttttatcacatcaacctgctataaacacaacttttcagtcatatcatctccaattttaaccaaaattcaaactttgcgctgaactaaacacagcctaaggtgatgtcaaccacacgacgaagacgcgcgatatgaagcggtccttgttaggataagacgtactacgagcgatccttttggacctcatggtcagtactccgcatatccgtactgacgattatattgctggatggagcggcttgttgcatttcatttccagtagatatagattaattgtttatttctttatttttttcttaaaaatccagttaattagattgcacagatggttttatatatgatcttcattttggacgtcaacgaaattacaggagagtgaatcgtgttagcctagataaagtatggttgggctagtttgcccatataaatatagtttccgtttggtccactatgaactctgcttgtctacctaccccaccaccaccacccttttctctcccttggtgaataatccaactttttttttcgcgaaatacattacagacggagacactcatatatacaaacgtgcgcatgtaccctatatatctctatgaaatatacaaaaatgccaataaggagtacatgacataaaaattgcaaattagctccatcagcatagactacgaccttcttttttgaaagtcatggggatacgcaaatgcaaagcattcgagtggcaagttatctactccctccttccctaaatgtttgacgccgttgacttttttaaacatgcttgaccgttcgtcttattcaaaaacttttatgaaatatgtaaaactatatgtatacataaagtatatttaacagtgaatcaaatgatagaaaaagaattaataattacttaaattttttgaataagacgaacggtcaaatatgtttaaaaaagtcaacggcgttaaacatttagggatggagggagtaatatagaatttggacggaggacacataaactactattgccctctctgcaaatataccttcgaaacttacttccatctccacacgaaaggcagatacacaagtatctggaacatattagcaacttggatcggctgcgaggagggacttctgaaaggttacaaatacggtgcacaagtacgtggagtgcccacctaaaggtcctgtctagacctacgatggtgaggcgaagactgaggcacagttacacgctgttctattgtgagcatgaatgggatgatgttgcgtgccgggcggctggcttgggtcgctgtgtgtcaacctcggacgacccaatagatagtggaacccgattagagcaaggataatagtgagatatgcttatgtggaggagagagaaaaaaaggtgttggctctcatgcaagagctagctttgcacgtgctccaagacaaatacattaaatgtataaatgagagaaaaagataggagaagaaaaatcaaagataatcttagagctagctctgcacgtgctgtttttcggaaaaacccctttattttttatctttatagcgctacctctagaagcggaattttcttttcttcgcattgtatttctgtgaaataggagggctttttcagaacaaacacaacagggtgttgtccagtctgaggacatatgcgatattttgtgcaaatacgaggagttttttttttttgcaaaatagccttttaatgaaaccggctccaacccacggtgcagacccatagcgcctaaaattgcgtttggccggttaccgcctacaagcggtcactcgtgcgcgcgcgaggagccaactacagcaaatgggcgacgtgtaaatttacgggatagctaaaaaataaaaaacatgagaaaaagggtacggttaggctggttattgattgatgataccccatctaccatggggcatagagagaaacaaccaagcaagtggttgtgccggctcaggtacgcacggagcccagcattgagacctcatacatctacaacagttggtatatataagcagtagatggaaatacattgaaatccctaagttaaggagctgcaaagacagatgaagtagcactgcaaaacaaatgtccctcttaggaggatgaaatggactacataaacacgagtttcttagtgcccaaatatatcaaccacaaaggtctgtaattgagcatagctgcccctgattttagatatgcagaccacagtgaatgattttcttacaagttccaagctaagatcattctacagttaaactcatgatctcaccataatacgctgggttttctctgggttgacaaatacactgattatattcatgaaaatcattaagcagtgcaatactacctacatgactcagcgacacacagaaggcaacgacggacgaagttatggcagaaacactcttaattttgtaagtgtttttgtatttggaagatcaacaaatcttcttttggatagggaaggtcaacaaatcatttgctcaagcttaatgttctcgcaatatcttctcattgtaagtgataaaacgaaacctgttagaaacttccgtttgaaagaacatgttattgaccctaaggaaagaatgtggtattgaagcattccaatcaacacaataagttattaaacagttgctatgatcacaaaaatgttcgttcttttagaaatcaaggtacaaaggaaaatatctggtttcatgttggagacatggcagcatctgattcatattcatgcggataaatcagttatcacatcttctgattatgtagagcttgtttttatacactcaacaagctgcaaccaaatgtcagttcgaccaaagtgttctgctcacatttcctaattaagtatgtccctgttctgctcacatttccttagctcacaaataacagaggatttttatttcgaaaatactgctaaggcttgggatctacggctcgtcctagggtcaagggggctctgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccaaagccttcatcttctaggagctcctcttctgagtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcagggctattttgcaaacacgattctagtactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagatgtgtacatctttacccacaagacacatcttcctcatatgtaaccacgtgccacataccaccacggtatacagacgaaagacgtgacatagtttccaacccatcctagccatagacaagagtaccgacccaatcccacctacggccggaacctccgggacaggcaggtaggactgagcccctagcagcaggacaccggccctgtgccatgacatctcgactaccgggctgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttttggggattttgagtagagggggcggtgtgaatccaattccacaatactccaacaattccataatatctaggtgatatgaatattcccaaagtctagagttgtgaaaccgcctaatgttacctaattaaagcgaagcatctacctaaaatcatactagtgataccatgagtagagtgtccactagttggggttttgtttattctagggtgaacaaggaaataataacaataacaacaataataaggtcataacaaagataaataggcatggctaaataaaacagtgattacgcgggaatttaaataaagcgataatgcaataagttaaatcaacataattttacaaactgggattcaatatgttcaaagatgatgtgacttgccttgctcgctttcccaaacgccggcttcaacctccacgaagagcggatcttccgaagctgcagcgtctacacgtccaacagaaaagaaacggcttttactctactaaactccatataacaagcagaaacaaagcacaaaaatgggttcttgacttcttaaggaaaaattagagacttgaacggtccaattccgagttcaaatggccaagttatggccatttgaagtttatatgctctttaaatggatatttacgaatttcttcatttaaattttaatttaaaatcggatttattgcgtcagccgggagagaggagcgcgcggaccgggtccacgggagtggggcccacgcggcagcctctcggtccacggtggaccgggagcacgcggcttacgccggccggcgccgtgggtcccacgcgtcagccgcacctgagggcgcgggcggctgacggccgggccccacatggcagccacggggcgcgcccgaaggcggcctttccggcacagccgacgggaggcggcgtgcccgcgcccctatggtcgccggcggcggccataggcacggcggagcggcggccgagagaggggaggggagggggaaacgaaatgggcggtccacggctcaccccgggtcgacggcgacgacgggaacggcgaccggagcggaagaaggcggcggcgcggcacgggtcgacggggacggcggcgttctggcggtcggcgggcgaaacggaagggtggacgaggtcggcgaggacgcggcggagccgaaggaggcgacgccgaggcgggaggaggtccgaggcgacgacggcggcggaccggagctcggcagtgacggcggagagagagagcgatggcgcgagctcgattccggcggagagagagagcggcgagtggcggaaacggtggagggaggcacggggagcgtttatatagtgttgggagggggagagaacggccggataagggggaatcggccgcggaagatccggccgccattgatgcgccggcgaagttaggggaggagtttccaaacgaatccgagggagagagagagagggaaaagtgggggaaaagagggagggaatcacggggaatatttcccccctcttgattgcacgcggggcggacgggagcggcgggattcgcggcggcggcggcgctagggcacgggcgaggcgacgggtgcggcgggagcggcggaaggtaggggatgacgggtgggccccacccgtcagcgagggtggcgggcgggcccgcccgtcagcggcacacgcgcggggaggaggccgattgggccgcgggggagaggagagagagggagggaagtgggccgagccggcccaagaggtagagggggagggaaagggaactttttagggtttttctttttataaaaccattttaactttgtttatttcttaataattattatttgtgctctgaaaattccactaaaatttatttacgcattttaggcttttaggaaatatacaaaaatcgtccaagccttatttgacttttaactttgcacattttaattgttggaggctttcacatggattttacttattctatgcataattttgaggatgtattttagagtcgttttaggacgcgacagtgagttgaccttcttcctcgggctacaagtgaagcaagcacaagagggcactttcatctctcaaaccaagtatgtaaaggacattctcaagaagtttgggatggaagatgccaaacccatcaagactcctatgcctactaatggccacctagacctcgatgataatggtaaatgtgtggaacaaaaggtatatcgctccatgataggatccttgctttacttatgtgcatctcgtcccgatatcatgcttagtgtatgcatgtgtgctcgctttcaagcggagcctaaagagtgccatttgattgccgtcaagagaattctaagatatttagttcttactcctaatcttggcttgtggtatcctaagggttgtgactttgagcttttgggctattccgattcggattacgccgggtgtaaggttgatagaaaaagcacaaccgggacttgccaatttcttgggcggtcccttgtttcttggtcctccaagaagcaaaattccattgcattatccaccgccgaagccgaatatgtcgccgccggttcttgttgtgcccaactcctttggatgaaacaaactctaaaagactttggctacaacttcaccaaaatcccactcctatgtgacaatgagagtgctatcaaaatagccaataatcccgttcaacactctcgaaccaaacacatagatattcgccaccactttttgagagatcataagaccaaaggaaacatatgccttacacatgtgagaccgagagccaattagccgacattttcaccaagcctttagatgagaaaagattttgcgagcttaggagtgagctcaatatcttaaattctcgcaacattaggtgatgggtggttggctaatttatagtcaaacatgtatcactaaaatgtaaattaaaaaaaaattgagcttttgtgtcttgagatcacttcttggtagaagatgatcttgataccaggaataaagctcaaacatttcccctttatccaaaaaccccttttgtgataagttttgcaaaatcctttgtgtgccttttattgcgaaaatttggtttttattttcttcttgtgatgtatattgaccatggttatgtaatgttgactgttgactggtcatatgcatcataagtctctgcatgtccttagttctctatttcccttcgttgaattctcatctcctccttgtttttgggcctgactgccctttttctgtcaggccggaagttccgggcctccctgtccggaacctccgggtatcggggagtatatatactcagggggagttagaaaccctagtctctctcctcatttcttctctctccccgacgccagccctagccgccgctacagtgcccctagtggcgatttcctcttccaaccgtgaaaatttgattcttctccgtggaatcaaccacattggtggtaggaggatcttcctgcgatcattctacgatttcctctctcaaggtagcactttttgattccctctctcggttcattgtgttttttatcccgatctcttaatctgtgaacctagggagaaaaccacttggatagtcttgttcctgctaccttgtagatcagcgatctataggatttgttcacatgcactggctatttttgagacccctgttcttcatttttgccggccggaagttccggtgctcttgcacccagaacctccgggcgctgtccagccagcctgcaattcttgattctctcaaattttgcctaactactgcactccaatttgttgattcctgttgcagtaagcactatgcctcgtgagaaaagacagaaagcctctcaggatgtgtctggtgatgagagtcctcctattcggtttcctcgtggtcgtttgggtaaagagaaagtggttgaaggtggcagtggcagcggcactcgtacttctcctaggtttaccaggcaatccagcaaccgtccagttcagattcgagatgttgacagtggtcaaggaagtgatgctccttcttcaagaggtcgtgggagaggtggtggtcgcacttctagggctggaagggcgtctcatgatttccctgttggatctcgtgagaatcccgttcagctctacaagactcttggatttgacaccactcctatgcaccacattggaagacccaagtccaactaccttcatcagcttgccaagtgcagaagggaccgtttgcttgatccagagacacagcctgaggagtcacaggatcctcgttttaggacgttcacccaattggattggtataactcagtgattatagctagagacaatccaatggttgagatgaagtggattgattggacttacataaggaagaagaacaatgaagtgttcaaccaagcaatgcaagtttg

SEQ ID NO: 56366 - DNA, 2753 bp, Oryza sativa
tgctcctttcattatgaagatgattgagacagtcaccggagtgttctacatcaaagatgggccgccacaatccttttcatcctcgtgttccaccttcctcttatccagtgatacctagatccatcccttctacctcagctggtccttcttctagtgccccaccgcaatcctcgagctcttctcccatcaagaaggcacttcaggcgatcttctgtatgtgtgctaagactgcaaagaaagtgaagaagatcgaaaggcgtcagaaggaagatagaagagaggctgggaaagaagtgtaagatgattgtaaagatgaggtctatgtggatccttttgaggcttatgaggcagcccgcaatgttgccggtgaaggtccatccacctatttcaatgaagagtcttcccgatcagatgatgatgaggaggaggatgacgccgaggcagctgctgaggatgctcccactgatgttgacaccgctgcacagtccgatgagtctcatctctccggtgataccgagattgttccctccgatggagatggagatgagtgatcctcttcttctcttcatggtttcttgctttttggtgccttgatgccaaagggggagaaattgtgaattgaagggggttatttaaatcattttgcgttccgggtcctatgatctggaggttccgaccaggcagattccctcccttttatctctctctctatggacatgtaatcatattcttttatgattggatgtaatgactgttagatgctttattatcctttatgtcagtaagttagtccatatgaatgttgcattttgatgtgatgtagtgttcttttcatctttttgagtgattgccatgtcatctagtctttcttcttgcgtatcacacatcttttaagcactcacatctgcatcttatttgatgagggtagtgtgaagtttcttttgaggtttccttcatcttatgcatattgtattcatctcatttcattatatgcatatctttagggggagcttcatacttctctcatcattccaaatttaaattctattatctttttgtgtgctttaaccatgttgtcatcaatcaccaaaaagggggagattgaagatgcacttaaaccccctagtgggttttggtgattaatgacaaggtggttaaaggggactaacgtgtttatcaagtttattcacaggagtttagtcccaaagcaagttgtgatggctaagaatgtaaggagacccccccaatttgaatgttcctaagtgcaaaaaacatcgaaggtgattagactaggtttttcactttcgaaattgagtttaggaaaaaccgtactattaagaggggtttcaagtgtggttccaaggtatacaaagtgctcttagtcatatccatgagtctaaaggtttttggaatcatttttggaaatgattttccccgagacagagaggcctacccggaggttctggccggaacctccggacaccaaagtttattttctccccgagacagagagggctacccggaggttctggccggaacttccaggcaccgaagtttagctagattttttctaagtgctacccggaagttcttcgcacttttgcccggaacctcctggcaggtttctagttcaatcttgtgagtaacggctagatgacgtcacctagccgttatatatatggatttcgtccccaggtcaccctttagccattccacttcagctctttcatgttctagggttttctagccactcccaagcttcctttgcttcctccactctaatctagagcctatcttgtgagattgagagattagattagagtgtaggagtgttttggagatggcttgaagattaggtttgattgagcactttggataccttgtgggctgtcacttgggcttattactcttggagatcttctcctagacggttaggtgtcgcccgtgagcttccaaagatcttgtggatgtcccgggaaagtttgtgaagattttcctcacctccgcaaggaaacgaggtaagtgagtaaagattcttgtgctgagttttcagaggttatcctaggtagagcaacttgcacttgtggtcttttctagaaggaattgtgagttggatcttggtggtcactcaattctagaaaacgacctagaagtgttgagttgaaggctgtggacttcttctgagatcttttcataagtgaggcaaggggttaatcgagacccggctctttgagcacctcaacggagagtaggatctgtgtgatccgaacttcgggaaaaaatcgcctttgtctcccttgtgcatgatctgtgtttgaatctgctggtatcttgagaattacatcttgtgcaactctgagcctgatcatctctagctaggacctgttatacttcccctaatttcgtttttctctgctgtccggaagttcctggctcaagaacttcggaagttccgggctactcatcctacccggaagttccggtgttcatcaccaggaggttccgggccctgtcaatttaaccgctgcgattgttgagaaaatttcaggaaagcctattcacccccccccctctaggctacatctctgcacattcagaggagaggaggaggtacctcgatccgatcgtgcacacctctccgatctcagcgtcgatctttactcccggttggttttaccaaccaggactataaatagatctttagtcaccaaccgggagtaaagcgtatggcgatcttttttcccggttggtgt

SEQ ID NO: 56367 - DNA, 880 bp, Oryza sativa
attttcagaagttccgaaaatacacagaaccgtttgagagctctctggaaattttcggaagttccgaaaatacacagaagcgttctggaaattttcagaagttccgaaaatttttttcggaagttccgaaaattgcgttgacttcgatttttctcagatctggaattttcggaagttccgataattgtttcggaagttccgaaaatcccttttattgcactctaacgggcagatttgtgctgtgggtataaatacccacctcccctcacttgtgagggttgctggttccattccaattatttgtgcccttggcttgctctctctctctctagttcatttgagccttgcttcctcgattcatctctccacccgtgtttgatttggatttggtgtgtgtgtgagagtgtggattcgagcttgtgtgggtgcttcttgtggtctttgtgaagatttgtgagcaattgcatcatctccgggagttctttgcatcatcttttactcttggaggttgaggactcctagacggctagatgtcactcccgagccaccgatctacttgtggttggccaggagaagtttgtgaaggccggatctcgcctccgcaagggaagagatacctcttagtgaaaggaggagtgcttagtgcaacctcttgagaaaagggttagctaagacccggctcttagtgagttcctcaacagagagtagaatccccttaaggatttgaactccagggaacaactttgggagctacatcttggtgatatttcttcatccctctcctctagctttgcttgcttgtgccgctattggtctagttgctgattgtgccttgtattccctgttatagtcttatagatctagagttttcattttgtgt

SEQ ID NO: 56368 - DNA, 3779 bp, Oryza sativa
ccgatctgcgtgtacgcgcaggcgttcgcggcggggatgcgcctgccgctgcacccgttcgtcagcgacgcgctggcccacttcggcatcgcgccgtcgcagctggcgcccaacgggtggcgcgtcctggccgggttcgccgtgctctgccacttccgcggcgtcggcgcgccgtcgctcccggtgttccgccacttcttcaccctggcgccgctgcccaaggggaaggggtggtactccttccgcgccagggagagcgtccccgcgctgttcacgggcctcccgtcctccgtcaaggcgtggaaggaggagttcctcttcgtctcgccgccgcccgccgcgccgtggcgctgccccgtgcgctggggaaccccgtccaaggaggccacgagcgacccggcgctcaccgagagggaggccgccgtggcgcggcggctcacgcagggccaaggcgtcgtcgacctcaagacctacctctcggagagcaacctcgtcgccgccaagatcagcagcgccccggcatgtctgggaggtacggacggacgatcaaatgccaccaacaaaacgtacatcggatggtgcagattcctcaattgctcgattgttttcttctttcttgcttccagggacggaagcttcacggggttcgtcggtggcggccgggaagaagaggaaggtgctgggcgatggcgtcagcaccggcggtggcgtgcttcggtcagagctgcaggcgaaggacaaggctctggccaaggcgcagggagagatcagccgcctgaaggcgcagctggggagcgccaaggcgagggagctggaggaggcgaggcaggcgttggagtacgagcggaagctggggacgcaggtgctcaagtctgatggcgccgccgccggggccagcaagcgtcgccgtggcggccagtgatccacgttccgccgctgaacgccgccggccagcgattcggtgatgtgctaggtatttactagtactactactacttgccaggataatgagtagctttgcggagtagtgttttagcaaggacctttcatgtttcttcataatcagcatcagctgtgacagacagtgctgatcttggttggtatcatttcgcaacaaactgctaatggaaaatctgttcacagacaccaggtgatgttatgaatcgcaatctgcttagtttatctaccatgttaattagcagcagaaattgctagctactggaatgatcatgggtatgagggtatcccactagttgagcgaaatgaactaaatacatagataatatgcatcagaaagaacacattttatagctgatcttgtaaaacaagagcaaggtcaagttgggtaaccacaagtgaaccgcgcccatactatcgccaaatatccctgcaatctgccatcttccatgaacacaacacgagcatcaggcttctaaaagatggtattttcacagcaaagggtcattataatgttattccacaagtacaagggtagattctgccaaaaatattcatccagttgcaatcagaaagtgtccccaaaaaaactgcttgctaccttttttctttgtacatgttcagccgaaatgttactacagtaattgcaattcaattggtccatatttgcgctatacaatgacactacagctcaagatgagaaaactaaatgcccacaaagattatccaattgtatgtactccaagatttggctagtgcatttgcacggtccactccagctaccctttactcttatcattgctagttgattcgttgtcacttgttgaatctgtggagctattagatgatgccattgtgttggactgctcactgattttctctgcagcgctgctggaattgtcatcgcccatgatagaagcaaaagtgagctggagaccatagagtactaatccaattgagttgattccaaacacaaatgttgctaggtagcatatcccatttataattgttctgcagagaaaacgtggttcattcattagataaaaggattacaatatataacaaacaagagaacagtgaatgaatggagttgtaccttattgttattgttatttgacgaacctgcagaaaacaaaaggaggattccattagatgaattgtgctagttacaaaaaatatgacgaagactgaaattcagttcctctgtaagtatatggaaagttggtagcacgaaatagcacattttacggtgcataaatgtgttaaccgacccacgggaggacaacaagaaataatttttgttgcagctctcttagtatttgttccctgcatcattgttgaatttgtatgtgttggtaaaacacaacaataatttgcattttccatgccttattctccatttgtgaaataatattgaaatgggattcaattccttgctgtaaacttcaaggcacattggcgacaaaaaaatggatggtgattacagcagacaattactcaaagcattgcatagcagtagcgctaacttctactagaccattaacgaaggataacaagaaaatggcaggtaataatacaaatgaagcaaacttcaagttggaaaattcatttgaaaccaaaaaaatgtcaaaaacagcataaggtagaggggttcaaattgctcaaaactaatctgcaatccttacaagaatatagaattattcccacaaaataagtgttaccacactgaattatggtccacactccacacttcatcagagctgctacgaaaattgaagtgtcgacctagggctgtgttttgttcaccacaccaaaattggaagtttggttgaaattggaatgatgtgatggaaaagttggaagtttatgtgtgtagaaaagttttgatgtgatggaaaagttggaagttcgaagaattattttggaactaaacacggcctagataacatagccgcacaagtttcatcggcaaacttggcctgcaataaactatttttgttgaagtctttatcacttacactttcagcctttgaccagaaaactgcatagctctaacacaacttcacttgtgccgtgtttagttgttttggcaaaaaaatttgacgcatacggacacacatttgaagtattaaacgtagactaataaaaaacaaattacagattctgcctgtaaactacgagacgaatctattaagcctaattaatccatcattagcaaatgtttactgtagcgccacattgtcaaatcatggcgtaattaggctcataagattcgtcttgcaatttacatgcaagctgtgtttttttgtccacatttaatgttccatgcatgtgtccaaacatttgatgtgacgaaaaagttgaaagtttgaagggaactaaacacagccttaatggtttatgtaaaccagcattcattgtccactatgatatattgaattatcatccatgtggttagttcacaacctttattaaattgtccacgactccataaaatttatttgtagctattcacataggttcaatggcgcatagacatggcaaactagttccaaacaatggcgtatatacaattatacatttatttgtcggaacaacaaaaggattaaccgataaagtgaagtctgacaaaaatcaaagcaacacagatacttgtcatcacagacacaatcggacacatacagcacagcctcaagatccctgttactcatgctagatttcctccaaaacttatatgaatttggcaattccaatggaagttcaaagggttcggtcctttgttccaaaggagaacataggcaaatcttcctaaaaggatattc

SEQ ID NO: 56369 - DNA, 16012 bp, Oryza sativa
acggggggagaagaaggcggtggcggaggaggaggcgcggagaggagtggagcagcagcatggtgggagtggagagctgcttgccggtgctcggggagagagttcagtggataacgaacgggtcgggcgagaaagggtgtgatgaattattttcatttctaaatttttattttttaatatttacagaaatattataccatttaaaatatttacagaaatggcccccctgccgccaaagtggagagcggcaaggtgtgcacatttttcattgaggtctcttgccgccctcgtacaaggggctaaatgcaattttcgccatgttaaaaatgcattttgctaatttttcttttgcatctcggctgtctctcacgtcaccctgggtctatttttgtaaatatttttgccggtataatatttctgtaaatattaaaaataaaaatttaaaaatgaaaaaaattcaggtgtgatcggtagatgggctactttgatggaccgaggccttctccatcgtttcttggtggtggcctggtgtgcgtacggtgggggtgggtgctaagggacggggaactgacggaaagttggagaaataagtttatattgactccctcaactcatgcccctcattgaatcgcatccctcaacagtaaaatcgggtataacccattgcaaatcgactccccgagcagtttcgaaggtggttttatcccacgtggcatctttgcctccgagcaacgaggtaaggaataaaactgcagacgcagttgaacggtggtcaggctagctcctgcaacaaattggtattacaatgtcctaaccactttcatttcgtaccaaggaatctaattaaatattataaaatctatgtgcaaccttacaaactatagtccaaattggtggaagaagccttatgattctattttctccgtttcataatgtaagtctttctagcattgtacatattcatatagatatcaataaatctagacatatatgtgtgtctagattcattaacatctatatgaatatgggtaatgctagaaaatcttacattatgaaacggatggagtatctctcaagcagattgctagggtggacatctagtcaaactatagtgaggataggctcaaagtttaagtctaagagcctgttcactttgatttgatgttattttcaaccttaccaagttttggtaaagttgctaaaaaattggctacatttagtttactgtcaaatttttaaattttggtaattatataagaaatgctgtcaaaattttgacaagttgtcaaaatttcggcaactatgccaaagtgaacaggccctaagtcaataaaagcaaagtaaagtacgtacctttacctacatcgaattcaatgttaacataatcaaatagaaaagaaaacggaggagtgcattgccaacataaaagtgcattcttgattagcaagatactagagaaaaatacagaatcctcattgggtacacaaggcctttagctaattagcacaaggttattagctaaggagcgaacgagatgagcagagtagcaataatagactagaaccagttgacttgcccatgccagtgacttgcgcctgcattctgctggtagcctaatgcctcgggcactctcccctgtgtggtcgcatcgccacctcacaccatttgcctcgtagatttcaggcatatagcctccatcccaaccctagcccccaaataccaaatgaatgaggggggttcctgttacacgcttaagcgctagcatcagaggcagcgcgcactttcacggccctaagagcgcttagcgctgttttttttttataagaatgcgtatgtttcttccctttgtttaattaactgaaacaaactttcaactttgatttattcaagatttggaaacttttcaactaatatttgaaaactttcaagtctagatttgaacttagatttcaaaattttcaagccaagattttaatactttcaacttaaatctaaaagttttcaactcttattttaaaactttcaaatctttatttgaaaaatttcaagtcaatatttgaaaactttaaactcaaatttaaaaactttcaactaaagatttgaaaacttttaactcagatttaaaaactttcatctcagattcaaaaacattcaactcaaatttgaacactttcatctaaaaacttaaaaacattcttctcaaatcttaaaaactttcaactatttaagttaagatttgaaaactttcaactctgatttaaaaactttcatctaaggttcaaaaacattcaactcaaatttgaaaactttcatctcaaaacttaaaaactttcaactcaaattttaaaaactttcaactcaaattcaaaactttcagcagcaattaaagatgaaagattcaatttctaaaataaaaagatcacaaaaaaaatcggcaaaaaaacatttcacggcgcggcggaaaaaaaaagaagcgagaaaaaaaggaaaaaaaaggaagagatgggacgcgcgtgggggtgggccagaaactcgcgccgcttgtgctaatagcgcatacgcgctaattagcaatttcgaagaatgaggcctggtttagttggggaaaaaaattttgggtttggttgtcacatcggatatacggaaacatatttgaagtattaaacatagtctaataacaaaacaaattacagactccgccagaaaactgcgggacgaatttattaagcctaattaatccgtcattagcaaatgtttactgtagaaccacattgtcaaatcatggcgcaattaggcttaaaagatttgtctcgcattttacatacaatctatgtaattgtttttttcctacatttaatactccatatatgtatccaaacattcgatgtgatagcgtgaaaatttttgttttgggaacaaaacaaggccgaatcacgcctcgctgctacctctaacctcctacccccttcagttcctaatttgttgacgttttagacaggattacacataccaatgagtgattaattagtgttcctacttcctgttttacccctaacaaatacggtttcgaggtacaccaaaccacaacctgctcttggtttgagtggccatcgcatgcaaaactaaagctactagtcctaagttcgattcttggtgtccacttatttttgcactcatgcacaacgccggcagcgtcaaccacaacggcggcgccgtccacctgttgtgcgagcttcaccaccatggcgccagcgtcgacctactccacggcagcggtggcgtcctgcacgacctgctccatggcgaaaagtagtgcaaggaggcgaatagaaggcagcgccccgcgcagcatgcatgacgttggaaataatgggagtaatggccggctgcatgcatgcagggcaagcaggtccaagatgcaaaaaaaaaaaaaaaaagctaaaacgtcaagaaatatcacacaatacaatggttcaagagctaaaacgccaacaaatttcaaaccggagagagtagtccaaaagtacccaagtgacctatgggcccgcactatgtaacgccaaatcaaccaatttgaccgagcgcgtaccactttatcttctccctaatacagatcatcctcttcatcttcttcgataagcccaatatagatagaaagctctcatgaatctcaaaattaggatatacgggtctacctgctggcttcatccctgcttatttgtaataaataaatacgaaaacggttcttctcattttcctcggtaattttcattttcatttttcaatgggcatagcatctaaagtattaaaacctccccccgctgctcgctcgtccgagttttgcgctggcgtggatgctgccggagcacggcacgtcagcgcgcgtgggacggcgagtagatttcacggcctctcgtgagtccgcgatgattctgtgaactttgcagaaaagccctctccgttatagctattttgatatatgtcctcgccgtacttgttcctgtttaaatatattacgtttagacccttctatttctacgaaatctaatacgaacgtgacaaaaatgagaaaaaaggaccgcgccctgaatcgtggaaactgaggggtcttttcgtagaatttccttttcttacacgccatctctccccctccggaaacccccagccgcgtcaaaaaagaaaacgaaaaagaaaacgaaaaaactcccggccgctagggttccatcgccgcactcatctctctcgctctctcttgcgcgatgcgtcgcgccgcctagatctcacggagccgtggccgccgcccactcttctcccgttcaatacgcttacatttaagaatttaccacttaattcgtaagccattaagattttaccactaggatagcgaatttcttcatttcataccactcccgtcaaatttacagctcatccatctccttcgttcacactagtgtagggcgccaccgtcaccatcgccgggccctcccttgccaccatggcgcgtttctttcgccttcgtttgtcatccccgccatcgtgctcgaaggccggagctgcactccatgccattgcgctcgggtgagcataccagcgagtgatgatggcggtggccaagttcgagtactgcacgggtgcaacgacaatggcgtggtcggggatggcttcacgccgctgcatctcccctcctcctcgctcctctcccctctctcctctagcacgtgtgggtcctaccacttgagacgaagaactcatagccaaaacttgcttcgcgttcttgaggaggccatgtggatggatgacgtggcaacgaatatttggtttggggaggaggctgaacgccacatcggcgcaatgtgaatgccctaagggtgttcttagcttttcatgtcagcttttgccatcttctatttttgtcctcacatgtttttaaactacataacgtataaaatttagcactaaacaccctaaaattcagaaacaaggatacaatttctccccttccatcattctctctattccccaactaccacaactcaacagcggctggcagcacagcgagctccaacagaggacagcggctccccaacctcctcccaaacagcggctcgaagggcgacagcggcggcgcgagagctcgctgggacccctcctctcctggccggcaacgagcgctcagcgagcgacggcagcagcgtgggagctcgccggggcccctcctctcctggttggcaacgagggctcggagggcaacggcatcaacgtgagagcttccggggcccctccattcccggccagcgacgagggctcagaggacgacggtggcagcgaggatccgaagcggcgtgagagctcgtcggtgccctccacttcctgccggtgatgaggagacagagcgccgagggtgacagtggcggcgcagatccagagcgacagtgactccgacggtggagagagaggtttgtttcgatggtggggaggtggggatgatggtctacagcctggattccatgcttttatctgctttttccgttgagcttctcgtgtctcaagttaggatgtgtttagttccaggggtgtaacgtttttgaagtatacggacacacatttgaagtattaaacgtagactaataacaaaacaaattacagattccgcatgtacattgcgagacgaatttattaagcctaattaatccgtcattagccaatgtttattgtagcatcacattatcaaatcatgtcgcaattaggctcaaaagattcgtctcgtaatttacatgcaaactgtgtaattggttttctttttccacatttaatgcgccgtgcatgtgtccaaacatccgatgtgacgttttggcccaaaatttttgggatctcaacaaggcctagtcccgtattcctcacaaagaaatggtccccactgccacattagcagctgtcctacgtggcgagctgtgccaactcgccacattcctgcactgtgaagggacaacatcacaaaagtcagtcaacttgagaatcatatgaatcattgaatatggtgacagccaaaaatatcatcttgacttgtctagatctgtaggtagcagagagagtagcagatagcctgtgaaagagagcaattgcagagggaggcttgcagctaagaactagtccccatggagcatggcggaatcgctgcttctccccgtggtgtgcggggtgatcggcaaggcgaccgacgtgcttgtccagaaagtcacccgcatgtatggcgtcgacggcgaccgccctaagctagagcggcagctgctggcggacgccgagttgaagagcgagaccaaccccgccatcaagcgttggatgaaagacctcaacgccgccgccgacgaggccgatgacatgctcaacgagttccagtacgaggcgctgcgccgcgaggccatgagcctcgagtcactgggacacaaggtacgaagctgcatgaccccactcgagttccgttttaccatgagcaggaagcttgccaaagtgctcaagaacatcaacgagctggttgaagagatgaacatgtttggcctgttgctgcaagatgagccagtacatcaacttccttactggcagacgtactcagtgctgccatcaaatgaattagatgatatctttggcagagacgacgacaaggaggcggtggtgatcaaactgttgctcgatcagcgagatcagcacaagtgggagaacctcccatcgtggggatgggtggtttaagcaagacaacgctcgccaagatggtctacaatgactacagggttcagaatcacttcgagctaaagatgtggcactgtgtgtcagacaactttgaagttgtttcccttctgaaatccatcattgaattggctacaaataaagcatgccaactgcttgacaacgtcgagttgttgtgaaagaccaagaacagctatagaggggggggtgaatatagcaattcaaatcttgcccccgaaaatactcatcaagccggatttctcaaaatccttactagaatcgcggctattagagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacatggaaactctctcaccgagcatctcaaaatgattaccaaaaggagcaacctccacccttgcatccatctctctatttatagcctaagacccctaagacattgtctcaaatacccctagggcgaaaccctaactcagaacagatctggtccatccattgttccttctactcaaaggaaaagctccagatgattgccacctcatcgatccgaaccttcacatggtcttcttgctgatgaatccgcgtgctctccgtcttgacgaatccaaacttgccacgttgcctagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacggaggttgccgcgtacggttttcccgcgcgcgtccttgcgcatgcaagctgcctgcacctcctgagcccatgcgccatgggccgccgtcttgggccattgctgcttggacgatgcaggcctgccgagccgagccattcaccatcttgggccacgtggaacggctggattggcttggcctccctgccaaccaatcacagcgcacatgcacagctagctagcttgacttttccaccgagccatgctagtagcaaccagtacaatgcaagctcctccttgcacaagtacagtacgtgtacatgcatgtatgctacctacagcaagtactgtagcagcaatgcacttgcacagtcccttctgatttcttcgcgaatccgatgcttgcacacttgaccttgtgaagcctgttgcaaagacctcctcacacggtgttcgtccaccgtgtgcaaccttgtgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacatccggtacttgtcaatttcccatcacaaaagaactataaccacacatggtttcacaatctcccccttgatgggaacattgacaatctcaagcaaaattttgaaaatttgatttttgattcacaaagcaaaccattttgcaaaagcgaactttggtcattttgaaatcgcgaaaaatcaagaccaagtgacaagaagaaaaagggatgcaaatgcaaaactccccctatgtgccaaactccccctttcaccaagatttaaagcaagttttaattttcaataagtgcaaatttctctccccctttgtcaatgatgctatcaagatcaaaagagacaaaaatgcaagataaaaatgagatgaaacttgcaaattttaggttttgagagctttgagagttatctaaaggcatcaaaaggtagacatggatcacacagatacaagcatgtgctcaagcctagctaagcatgtgcataagaagtatgaaacaagtcatgaatatcaagttagtatcgccagcaagcaaaaagctttcaagtgaattagtgatttagtgtgcaaagctatttctagaagaagcttaaaaggaagcaaaccagctcataatcatgcaagatttacataatcaaagcaatgaacccatgctaatgtgctaatgcccagttcataaagagtatcaacatgataacaaagcatagaacatgagcttttaatcttttctcatgacttttatttttatgattttttttaatttctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacgcactcagtagcccggacaaaacagagataaatcttgtaaagcatgattgatacaaagtatggacgcataagcatgagcattcataagcatgtactgacagttattgcgaaaagaatgtaaacatggcatgagtatgagatggatacttcaatttaaacaaacttctagagcaagcattgcacattgattgagttcaaatgaatagttaatttaagcaggtttcaacacgcttgaacagcataacatgatcacacaagctacttaagcaaatgaaagctagacaagagatcaaactagcataagagtgatacatccatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcactcctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacaagcactagcagcagctacgtactcagcctcagctgttgattgagcaacagaagactgcttacgagaggaccaagagaccaaagaagtgccaagaaaatgacaagtgctagaagtacttttgcgatcaatcttacacccagcaaaatcagcatctgaaaaagctcgaactgaaagggcagaagagcaggagtaccaaataccgtactcaagtgtagacttgatgtagcggaagatgcgcttgactgcttggcgatgtgatgttcttggagaagcctgaaacctcgcgcacaggcacacggagaagtggatgtccggccttgacgcagtcaagtagaggagggagccgatcatgcttctgtactcgcgctggtcaacttcttcatcgtcctcatcaggaccaagcgatgaagtagttgccatgggagtagcgattggcttgcagtcggccatgtcgaacttcttcaggagctctttggagtacttggtctgatgtacaaagattccttccttggtttgcttgatttgaagtccaaggaagaaagtcagctctcccatcatgctcatttcaaattccctgctcatcacatcagaaaactgggcaacaagtgcatgagaggagccaccaaatatgatgtcatcaacatatatctggacaagaagaaaatcaataccactatgaagagtaaaaagagttttatcaacagcccccatttcaaaaccattttgaagcaaaaaggttttcaatctttcataccaggctctgggagcttgttttaaaccataaagagctttttcaagtttgaacacatgatttgaaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaagtttcttcaaagtccaagccctcaacttgggtgaaaccctgtgcaaccagtctggctttgtttcgaacaattgaaccatcttcacctagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaaagctgaattgacaagttcataagaccgatttctagttaccctttcacccaggcctccgatcatcgagtcaggcggatgtcggttctggatgtgtcggggagctgtcggtcctaatgtgccaccatcaatctcctcagctgctgaagatgatgtagttggtgcatctcctgaaggtgatgtagtcgaaggagaaccggtttcttgcactggtggtgtactgtctagaggtggaggaatagaatcatcatcatcatcatctgaatccacatccacaaagatgctttcatctggaacacctgaaatttctggtctagctcctgggctagcctcatcaaaagtgacttcacaagtctccacaattttgttagttgaaatagcataaactcgataagcccgagaatgagtagcatagccaagtaaaatgccatccaatgatcgagattcaaacttgtccaaatttccagatttaagaacaaagcatttgcagcagaagaccctgatatgtgaaacttttggtcgacgaccaaatctgagctcatatggcgtattgtgcaagatagttctcaaaaacacacgattgtagataaaacaagcagcagaaatagcttcagtccagaattttcttggagtcgtaaactcatcaagcatagttagtgccatctccacaagggtgcggttcttcctctcaaccaccccattctgttgtgggacatatggcgaagaaaactggtgttcaactccagaagaatcacagaaagattcaaatgcagaatttttgaattcagagccattatcactgcgaatggctcgaagagcaccaggaaactccaaagccaaactacgagcaagagactgaaagaagccaaatgtttcctcctttgattcaagaaaatagacccaagagtagcgagagaaatcatccacaacaaccaagacataccacttccccccaactgactggacccgagcaggaccaaccgtatccatgtgaagcagttgtcccggtccatctgtcataaccattgtaacaggcttgtgggaggaagatgtcattttcccatgacgacatggtgcacacacaagatctttcggaactttcaacttaggcaaaccccgaatcaaatccataccactaatgcgagacaagtggtcaaagccaatatgaccaagacgtcgatgccagaaaaacaaatccctattctctgtggcaatgagacaacgagaaggaccaggagcagaagagttgaagttagcaaagaaaactcgaccaactcgagaaatgtcaaaaacaggagattcagaagcatcaagaactcgagacctgtcctttttgaaacgaacttccagattttcatcacagagttgtgaaacagagagcaaattgtacttaagcttacttactagtgccacatctttcagcatgaatttgtcattgaccttgattgttcctttagccatcatgcgtccactgctcgcatccccaaaagtgatggtctcatcaccggatgcacgagtgagagaagtaaaccactcggcttcaccggtcatgtggcgtgagcaaccggagtccacaagccaagaattacttctccctactccaaaatcctacaagaaggacacagcagatctcgatgattcagtactggggttagtgaaaaatgacttaggaatccagtactgaaccatgcgagaagtacaagcatctttagtgttatgagcagaattatatgcaagatgaccatgtctgttttgccccaaccctgctaggtcacgtcgagggtgcacatctcggcgaggaaagcgagatacacaacttgaacgacaatgacacgcacactcgaacctctcagggactctagtagctcttctagtcctaagacgttcttgtcgctcttttctagcctttctaaagcagaaacctaccaaatgaccagctttcccacaataggtgcactcatacttggttttctctacaggcttggtttgtctctggttttgcttgtgctcaacttgttttggatttttgggtctaggtaactctacaggcttagacttgctagtcataggtaccatctttggttctgaggttttgggtgtactagaactagtgtttccaatgaaacctgcagacttgaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttataggtatgagttctctttcttagcagactcaagatcaactttcagagaaatgcatgaagaacaagaatcaatagatttgatagaatcaatgacagttttagcatcttttagttcagtttccaggatagcacaattagcacatgaagaatgaataggttccttagtagcaaaagattctaacaaattattcttggtcctaagcatggcaacttgttgtcttaattcatcattgtcactagtgagaatgggacaattttcacacctaccaatcctatcatgaacaaatttttcttttagttctttcaattccatctcaagcaaacccatatcaactttcatttcatagcaagtagagcaagcagcactagcactagaaggattcctagctcctaaagcacatgatttcaacttatccttgaggagattaatttcagaaagatatgaagcacaagtagaacaggtatcctcctcaggaatcatggatcgaagcctagcaatttctagcgccattccatcattttcagattttagtttctcaattttatacttagaagacctatacttatcactaatttcaatcatcaagtgtgccattctttctttgcttagttcatcatcaacagagtcattatctgagcaagaatcatcacaaagagaaccatccaaggaagggatatcatcaagacatacctcaggatgctccgatgagtcatccttatcctcaagcgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtggatcgccttcttcatcaaatccttcttcccctttcgcccttgtccctcgggcttcttggtcgtcttgtcactcttcttcttcaacttgggacaattcactcttttgtggttaggctctccacactcaaaacacacaaatggttcattggtttttcctctttttttatctctcacatttttgtaagctcttgagaattttctagcaaaaagagcaagatcatcttcagggatcttctctaattgctcctcagtgactgagtgtaaagcggcaagagagaagccaccatacacaaaagctgagtcattagaagaagtactaccagagggatcagctaccaaagccatcgagtgtttgaggcctttccgatggaaaacatccatctcatgggtttttagctttgagtaaagcttgtccatggtaaggtcactcagaggtgcactctctgtgatggaagtaactttcatttcccaaacaccataatcaagacaattcaaaagatggcgagcattatcattatcagaaaattcttttccaacagatctcaacttcgaaataatttctccaaaacgtttgaaataagaatcaatggactctcctgagtgcatctcaaatctttgatattctttatgaaattgattctgacgaaccaattgaatatcattgtttccctcatggaaattgcacagagcagtccacatgtcatgagcggacttgtggtgttgaacacgattaaattcaccagaagaaattccaccaatgattgcatttcttgcacgataattaaaatcaacctgagccatatttgcaggcgtgatgtcagcatcatcgggcacagtgtaaccttattccacacattatgcccttgcgactggaggtaggcctccattcgtgccttccaaatgacaaaattgtgtccatcgaaaacaaatggtttcgcagagtatttttcctccatagctgcgttcgttgccatggttaggttacaacgaacttaaccgggctctgataccaattgaaagaccaagaacagctatagaggggggtgaatatagcaattcaaatcttgcccccgaaaatactcatcaagccggatttctcaaaatccttactagaatcgcggctattagagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagag

SEQ ID NO: 56370 - DNA, 1513 bp, Oryza sativa
tgtcttggcacagatgtcgcaacctgaccaacgttagtccacacacacacttcttgcacatccggtacttgtcaatttcccatcacaaaagaactataaccacacatggtttcacatccggtacttgtcaatttcccatcacaaaagaactataaccacacatggtttcacatgttgcaaaaggaactacataaggtcgttggccggagaaggtttctgctcatgctcgacgatgtatggaatgaagaaaagaagaagtgagaggaagacctaaagccactcctgtcttctgttggtggtggtgatggaagtgctatactagtgacagctcggagccaacaagtagcatctataatgggcaccctagaatcccataacctagcttgtctgagtgacgatgattcatgggaactattctcaaagaaagcattcaataaaggcgtacaacagcaagttgaattggtcaccgctggcaaacttattgtcaagaaatgtaaggggcttcctcttgctttgaagacaatgggtgatatgatgagttcaaagcaacaagtcaaggaatgggaaacaattgcaagaagcaatactggggacaatgacaggggtgaagatgatatactacctgtactaaaattgagctacagacacctaccacctgaaatgaagcaatgctttgccttttgttcagttttcccaaaggaccatgagatggacaaagaagtgttgatccaattgtggatggcaaatggtttcattcaggaagacgaaacaatgggtttggaacaaaagggggaatatgttttccgtaatttggtttggagatccttcctccaagacgtgaaacaggaaaggtttttttttccgtttgcaaaatgcatgatttgatgcatgatttagtaaaagatgtggcagatgatagtgtaatttcagaacagttaatcccacaggaagcatataccggacgttgcatatcagcaatgagtcaaacagtgggattgctcaaaacatcatcttgtctccgcactttgataactctgtggttaccagtacatattaataacttaagacagatgtcattaagagatattggtactgacttaagactgatgtcattaagagctttgggtactgtccgtatgcatgattgctcttttcatagccaggtcatcaatccaaagcatctacgatatcttgacctttctgggtctgacatggatgtgctgccaagttcaatatgcacgatgtataacttacaaacactaaggctgaaccgttgcaaaaaactgagatatttactggaaggtatgagaacaatgagcaagctcatccatctttatctttttagctgtccattgaagcggatgccaccaaatattagcctactgaaaaatcttcgcactctaacaacatttattttggacactgaaaaatcttcgcactctaacaacatttattttggacactgaacctggccatggaattgaggagctcaaagacttgaatcaccttgcca

SEQ ID NO: 56371 - DNA, 5097 bp, Oryza sativa
gtctctcgcactcagacatcgttcatcaaaggccaatctatccatgagaacttcattttcgttcaagggctgacaagataatttcatcgacagaggaaagcaatggttctccttaaacttgacatctcgaaggcctttgattcagtttcatggagcttccttttggatatgttaaaacacagaggttttgggaggagatggagaggttgggtgtcggctcttctcctaactgcagaaacaaggattgacatcaatggcactttaagtgaccccttcaagcctatgagggggctaagacaaggggatccgttatctcctcttctttttgtcctggtgatggatactcttcatgctatgttgcagaaagcaatgtcagccgggttgcttgacaaagttaaccagtggagcagagcaccaaataattctctctatgccgacgacgccgtcatcttctttaaaccggttcgtcatcttctttaaaccaaattttgcatgcctgaaaacaagggatgcaacgaggaagaagtgttggagtcgcttaaacctcatgctaagctcaaaattttggaactacacggatatagtggcctaaagatcccacaatggatggaagacccacaaatgttgcagtgcctaacaactctccacttttccaactgttcaggatgtaaggatctatcgactgtgtggtttttggtctcgattgagtgtatgtctttatctaaaatggagaatctaaccacattgtttatgaatgtcgttggtgtgaaagccgaaggatactacatccctctacaaattttcccaaggttaaaggatatgacactaagccagttatcgaacttggagaaatggacagaaagtactgctggagaggccaatactagcttagttacgtttccgaagctcgcaacgctatgtatctctgattgtccaaaacttgcaagtgttccagattgctcagttctaaaagaattgaaaacatatggatattgcagtcttgcaatgagcttacttgcacatctaaccactttgtctgaactcatttaccgggaaaatgagtctatgagaatgtcgttgggctcatggccatctctcacgaaactacatattagttcgtcatataaccaaatggccactctggaggtcgacacaaaccaaggcccactagaaaaccttaggattttgaggctatatggcctcaacttcttcacagctgcatccggtttatccaaaatgcatcttgggctatggaaatgctttgcctttgtggaggatttgtgtattggtgcatgcaacgaccttgtgcattggccaatggaggagctcatgagcttgattcaccttcgatccctgtctattgaacactgtgataaccttgaaggaaagggttcatcatcggaggaaatcatgccactctactatctagagaagtttcacatcaaagactgcaaaagtctattggatattccgacgatgcctgcatcccttgaggagctgtgtctgctactttgccccagattagtggcactgccttcgaaccttggaaatttggccaggctaaagactatgagttttgagcactgtcatgacctgaaagagttgcctgatgggatggatggccttatttcccttgaagaattgaagattatgggggtgcccagagatagagagatttccacagggtctcctccatcagattccgacccttcgatacctaatggtagcaggctgccctagcttggaaagacggtgcagagaaggtggcgagtattttgatctgatctcctccattccacgtatagttgttccagtagcaaaacagaagtgacggaatcaacatcaagcctgaagaagcttgtaaaggggctcctcccctcctgctcactctcaaagtgaggtgtgtatgctttgctcttccattatttcactctgccattattcacaagctaattaattaattacataagctaagcgccgggagtttgctttggaattgccggaaaaattggatcctttagagtagtaatattttttcaggaatacgcaaggagcgcatcttttccattaagagaaataaaagttatttacatttgaaagaaaaaacagcatgggactgatacaggacattgacagttaatcctaggtctatctatcgcactgagtttggcaaccaaactccagccgagtttagttccaaaatttttcttcaaacttccaatttttctattacatcaaaactttcttacacacacaaactttcaacttttctgtcacatcgttccaatttcaatcaaactttcaattttagcgtgaactaaacacaccctccctcctgaattgcagcgcaggaatcgctgggtttgctttatgccaaagagaagcctcgtcagccatccctttggccacatctacccaagatctgcactgctgattgagagtagtagtattctttagagtagtagtattcacgtaaactttgtgacttaggcgcagtctccatgcctctggtgatctttgtattctttttctgcagcgaacatatagcttgttcttgaagatgaacagcatcaggaggatttctgggatgagcaaaagtctaaggtcccctctgcaatttataaagagaaatatgagagcatagttttcttcagggagctgtaaaagcgtgacaaagataatatcgattaacctcctggaacacaagtactctgttgagtttgatgctatccaaggtgagatctttgcctcttgcatttctatttttcctacacatgttgtcagaaatgttatggacatattcacaatctcttaatatgtctaggcgtgattcaaagatggataaactcactgcagtttttgtattcctctcaatctgaatctgtgatgggtggccacaccagcaaagccccatcagggaaggaggatttcctcataacagtggatgagaagcatgattatgacaggtaggttataattcacttgttctagatcatatacctgtgttgttggaactatttttgagaagcacagctcgtttcaggctgaagacgcctccagttacaccactgtttctttccatagagacggaaaccaaccaactcctctcaaatgattttccagaagaagcaacctatccctcaaccagttaaaccttcagcttccagggtatactatctgctctgtattatcctacatctaaaaaaaaaatcccagatgcagcttttctcctcaactgaaaaccacatttctagaacctgtttctttttttttttttttttgccgggtcggcgaaggagccgaccaaatttcattaagattgaaaggggaaagttatagattttacacaacattaaactgtcgagccggggactaacacccctggagagcagaaaccgggggggaggggggggtgggtggcgcgggctactcctcacaacactgaaaaacacccgcagctctccaaactgcaacttcctctttaatatctgccacaaggtgcttagccgtcttgcttctttggtcgaaaactctgatattgcgttccttccaaattagccagctcaccaacatgaaaaaggtgtcaaaagcagtcatgtagcgcgtctgaaatagaacttgtttcttcatcgaagagcttatcttgatcttgactttatccatgagagctttctgggaggacaaaggcaacaaaaaaaaatcggttacccacacctgactcatcatcaaagaacttgttcagacgggctgcaccatccatctccactgagaataaccaaccttgcacaattgaaaagagatcaacttacgcaggcataatgagcaggcaaacctgttgctgcaactgcacctacagtttctacagcaagtaggaatgcaaacaagaaacactctgacagatgctacgtacgcaagccaaggcagtaccacaagtggactcaagaatgtgacgaaacctgaactcccttacaatgcaccgaagaatctgaccacaacaagatctatatttacatgccgtgcgccagcattggatgtaggtgagaaaatagaaaatggcaggataagaagaaaatcatgcccacctgttgcaacaatagggaccaaggagcagagattagatggcaagaagaaaggcctaccagctaaagtgaaggctgtgagcagtagcaatgagtctacttctaataatggtggccgttctggtgaggccacaacaatgaacggaacgagaaaaacagatgggaagaaagagcacatgtcaaagcatggaaaatcggctgaagaagtgaacatgtcattttatacaagtttgtttttacagtttctagtgttctctgcttcgtactcttctttttctaatgattcaaaggacgaaactgttttgcatgatccgaaaaacatacatgttgtaaccaattaactatccggtgcagatgtgacttcaaatgaggaacttatgtgttttatgggttcgaagtagaaggcttttacctgtgctattaggtatctaggcaaaatgaacagacctctttttcatctacatattctagtaggtaagatttgttcacattgctagcaccattgctgtatcagtatacatgcatgtaccagtaatacttctatttgaagaatcttgccacaaaacgaaccaacacatggagtatctagctgtaatatgaatggtaatcggtttggagcctgatgcaaggatcagatttgcaagagaaaacagcacagcaggctatcaccagcatggccaccaccagggttcacaattccgataccaccttccatgccaaacgctggcagcacgttggttttcacgaaatccgattgaaaaccaacaaattcatatcggtcggtctttgtgtcaaaaatcgattggctttaccaaaatttcgaatggaaacgttgaaattcttatcgacagttggaagtgaaaacatcaatctgtttgtatcgaaaaccgattgattttgtcaagaaaccaatgtgaaatttcaaaaaaaaattgtttactaaaaatgtggaaaatagtgaaaaaaaaaagctagaaaattgggaaaatttctaaaagttttggcatgccatttctat

SEQ ID NO: 56372 - DNA, 8421 bp, Oryza sativa
aataatgaaaacaaatgtttaatcttctatgtaaagataaataaatatatgcataggattgtaggaatgctaaccttactaagctagtctaacaagttttttttctggagtattctgttattaaatgaaatgacaacaaaacaagctaacatgtatttccaaacgaaaatgttataaagggaaatgcatgcacctagatataacatagcaaaggacgatggcaccgaaaacctagaatgaactaagtaaagtgcgggaacagacaaaggtattggacctgtagacttttttttttttttttgctagtagtagctcaaactaggtggaaggtttggatatatttctaaattcctcagcatgaactttaattttgaagccattgcctctttataatggtaaacagcattcccttgacagttgattggtcaccctctcatgatatgttattagcgggatgtcacgatggaacggtaccttttccttacccaacaaaattattttcttatcttaaatcatgtgacctttgagtctttcaagttgctgttctgaaagttctgtgattgacttttttatattccaggttgctttagggtgtgtttagttcacgttaaaattgaaagtttgattgaaattgaaacgatgtgacgtaaaagttgaaagtttgtgtgtgtatgaaagttttgatgtgatggaaaagttggaagtttgaagaactgctttaccgacaacatgtctgactgtagaactgctttactggtttaaaagcagccagttactggagttcccaaatcttcgcttttcttattctgttctgttttcaaacaaaactaaatcatgtgttctgttgataaacaggttcaaaaccttttatgtgtgtaactgctgaatctgctcccatcagaaccgtgtcgtgggcaccatctgtgaggtagccagttgtactgttactctggtctattccaaaagataatttttgagttttgactcttgtcattctatcagtaaggaaaacgtgaatacctttgtcactggtggagaggatggtctgaaattcggggatttaaggtaggtgttggccttgttgtgaactgaagcaatgtttaaaacatctttcgaactactctcttatcctgcatgaatttctaatattatgtatgggtcctcagaggtctgaacattgagggtagtctctcccccttcctctctgaattcgtggcacctcccaatttctgaaccattcatatttgtttctgtttgtttcctaatggtaaaaattccgagttaacaaacaaaagataggcacgatatgcagaatatgttattatcacatggaccaatgatgtcagtaggagtttctttatgaatccagtgcgatatacggtttttttctttagcttttcaatgggcactaagaaacttgttctagaagctgcagtatgtttggctatgaatatactgattgttatggttaatcactacctgtcacagcccccttggatttgctattgttttctaccgtttttgttttgtaatatttgggaattttagtgcatctcataagatatctttgctgcagagatccatatcgtcatctttgggagttaactactgctcgaagggccgtaataagtcttcaatggttgaaggatgcaaggtaatatttgttaagcactaaatgtacttgtttttcttcactaacacggtgtttacgttgttttccttgtctttgaaacactgcactaattttaaatggagatgtatgttttcattaatgttggaacacatactagaaaccatatttgctagaatgttgacaattattttagtcatgtaatttatgttcatagggcctgtacttctccgttagtgtgtgctaaggtggatattgtctttgtttatataattagttccattaaagcatcagcgtatttttttaagtaattctatttgcactttttttttgcaaacgctctatttgcacttgtttacataattattaatataaatgtttgtatttgcccacgtaccttctaaatgagatgcaagcttccttcactggacatggtcttgatgtattactggatcaaagtagacgtgattaaatagaccacattgtttcattcatggtgatattgtgtgtatatatgccagacataccctttttactagaatggtaatgttaactgttatattttttatctttgtgttcagaggtattgtcatatcattggaagatggcgcattaaagttcgttagcttgttaagaatcgcaaatgatgttcctgttactggaaggccatttgttggaacgaaaactcagggtgtttctacctatcaattgcctgaatatttgatctggagtgtccatgcctcagaaattacaggtgcatttcacctcatgtccaaccatagtagatgtcaagtatcggaatattggttatagccttatatcaatatttagttccacacatttgagcagagtaaaaatgtcaaatatatattcatgatagttcatgaatttgtaattttgttttgctgatatccaggctatgcggcttattgtgtggctgatggaactgctgtttgctttgaggtaaactaaacagcacataaactattgatttatgcatgctattgtgattctctataacattgctaaataaatattcaacttactgtagcttactccgagattctaggaaaaggaacctgggagaaaccgtgtaccatattttctttgtggttcattatcagagggaacaaccattaaaattggtatcgcattaccaaactctcctttgtcaaatgttcctctggagaccaaacgggctactaaaacttgcaaagatgtagctcaattgcatgttatagaagaagggaaacttcttaccaactcaggtaatcgctgtcacctgcaacttgtatcattttgcttgtacctgacatgcctgcttaaccaccatacagaatgcaattgtgctataaatccgagcatcagagatggtcaacaagatgaacctgatgaaggacaagaaactggtgccatagttttagctgctccttcaatgcaagagaactttggcacaagcaccagcaggggtagcgaatcccctgaaaattttgaggtatttcctcctaaagctgtagcaatgcatcggttgagatggaccatgaataaaggtagcgagaaatggttgtgctatggaggtgctgcaggcattatccggtgtcagaggatctaaggaacaagagcacacttgaggaatctccttgtatatcaggaaaatctgcatgtgtccatctacacaataaactgttgcatgctgtggtatgtttcatccgtttctttcctctactgttattttgatcaccatgtccattttgggttatatgtattaacttcttgcactgtgcttgcaatataacagattatggccctgtttggttcatgggctaatatttagccctcaccttttagcctcaaattagccctcagagatccaaacaggtgagctaattttgagctaatatgaattagcccccctcaaaacattagcccctctaaggggtactaatggggctaatttcgtgtggggaccatcaaaaagcagctctctctctctctccttctctctctactctctttctactctctctccaccttttagccttgaattagcccatggatctaaacataccaccctaggctaatgtttagcctaccaattcatgactaaacattagctctcaaaattagccctgggctaatctttcaaagagggcctatctttggaactcccgacggagctgtatagccttatggactgaagctttacctgagctgcgaggttctctgtgttttgggaccagcaattcattgcatgttggttcgaaaatagaaaatattgtcactccatgcgattcttcctccacattactctgaaataagtgcaatatgtgcctttggcgatccagattcgcaaaatctgttgtaattgtaattgtaattgatagctattcttattcatttcctgtaacatatgtaagatcgcacagattattgatgcagctaaaaaactgcacgatattaggtgggatttcatgcatcgctgtttaagttttggaagtcatacagccttgttgcttcataatatgtactactctttttaaggattgttgagttgttaggctgtcgaagcttttttaaacaaatcaacagcaatgtgttgaggcatttcttcgctgctgtgctcaagttctcgtagggagcacgaccctacgacataggagcatttctgtccttgctccttaccagataaagagaagatctgatgtatctttgttaacacgatatcataacagttgggtaaacacgatataggagcattttcattattggagagagaatttggcatatttacatttcacttagctgtctttatcaaagtgatatttcgggtgaaactgcaggatgaagtactgtacaatagtaataaacgtggcttcccttaaaaaaagaaaaaaaaacatggcctgttaacatccctaatgtcaatgttcttagtgtacaatacaactatacatgcataattctcagtcgctccagttatcctcatcgactacaaaatccatttgcctcttgccatcatcttcctgcagaggtttagcagtgctaacaatcaaatgcctaaaaaagcttatgcaataatatcccaatatgcccgactactcctgagaaatttgaatttgataggatgtaggaaaattctacagaaagatatatgataacaagaaatagaaaatataccatttcagtaaatgctggagttgatggagaccacacaagaatttgcctgtcattgctgccagtataaagctcctgaattccaaaagactcagcaatggtattgatgcgggaacattcagggttaacagaggataggagtagagggaagacttacttgttcttgtgcactatagtagcagcaattaacaggttcatagtgcccacggaatgtttgaaatgtcataccagaccataaattgtacgcctacatgaatttggcaacacaaggtgaagtataaaattcagcgtccaaactgagaagctaaaaaatgaccacaccttaatgcttgccatgcatgggatgaatacaagtgatggatcctcagtgacagctaattgtagtggtttgctagtctgtaatcgcatagcttcaaaattgaccaaagtattacagcctgaatcaatatcccaaagtcttaagcgagaatcagaacctgaagagagaggataacaatcattaatgcatactgcatacaggcataacaagaagatagccataggcaataattcctttcaagcaatagcaatcgaatgctcatagaaatagcaattaaattcaatcaacctgagctaagaaggtacatcccatctgtagttgttcttaatcccgtaacagcaccataatgcgccgttgcacgattttgactagaagacaaaccagggtgcaatctctgttggatatgtccatgtccagggatttgacttttgtgcaatttgtgtgactgtttcttactcttgcctgtcctctgctgtgcagagtaaatctttgaagaagatgaaggttgtaaagagttcaaaggatcctagtcaaaattaaaaatgaatacattgatcatttgcacaactagatcaatgagtttgcgcgtcatttctagggcacaacaatcaacaagaaacaatgtatgcagaccttatattgtaagaattggagcactaaactgatccatagcacctatatactgacactaatatgtgagacaaacctataaattaatagccgcagaaatcagcttttacttgaaggctgacagtattgatctgtagcattacaaccataatgttttacttaaagctgcaacatttttgaagcttttgcagaaaataaaagtggaagtccagctttagcgttgcaaccaaatattttgaaaacaaatgtaagtgatggataatggtgaccataccttatctgaggtgccctcaagaaaaggaggccgccttcctagttgagaccgtgattgatcaagaacaagaaagcatccagctcgtcttatgtcccaaaatcgtattgctccatcacaaccaccgctcatcaaaatccactcacttgaagtagaccactccaaagacatgataccatctgacatgtcagataccaaggataaggtggtaaccatacaaacaaagcaagcatattttcatcactacactagaagtaagcaactaaccacgatgaccagacaacgtgtgggtaaaggctccagaagcaatatcacataaacggacctgaacatctgcacttccagtagcgatcagcatatgtgttgttgcaattggggacattgctgcactgtacacttttccaggcatcttaaaatccattacgacctagaaaagaaaaccaggcaaaaaatcagaacatcaggatcacaccattgccaccacaaaggaggcaagacaaaagaaaaattagcaatcgacaaagcagatgaaagcatacttgagtcgaattagtatcccacactttgacatactgatcaaaagaagctgtcacaaacagcccagtgtccacaggataccatacggccatagataccgcgaacttgtggccattttcatgctgcttgtccacaaggagaatgctcctatgcttggcaatgaacccagcttcgtattcgatcgcattctgcacatcaaatatagcggctgatccatccgatgcgcccgagagcaggtaccgccgctctatcaaatcaacctgaccatattgtcaaattacaaaacaccagcgggagcgactcaggaattgcacaccaaatacgcaagattccatctacagggtgtacaaatcaaattgatctaaaccactaaggtgagagaaggagaaggggagtgagggagtgagaagggggtgtacctggagagagttgacggcgccgttgtgcggggtggtgaactccttgcggttggagagtgcgagtgaggcggtgcggcgcgcccgggcggcggtctcgaagcgccgtgccccaagctccccgcgttccctccgcctcaccgcctcacaccacatccactcggccgcgcacgacagttgtgtccctcttctcagcggtgacagcgggcgatagaaacggtgcggtgtgccagtgagggatgagcggcgcggccgagcgggagctatgctgaccggagatggagaaggattcggcggctgcactgggaagcttctattaaattaggcagtttcaatccgtgttgatttatgatggctcggatcctcccgtgtcccgtgttcgactcacatatggcctcatggggcacctgatggatgtttgtctctggctaatcatgaatgatgagttgtggtgtgaacattgataaatttacatatactataaaaatactcgtgttgcaatgggtgaatactattttaacattattattgttatacggtttagataggataaaattcactataggaattcgcttggattttttttttaagaaaatcacaagctacaattacaagtccaacttttatctcaagttagcatgtgagtgttctttaaaaaaaagatttcttatacgactccttttgtattttcaaaagaaaacgagcttaaaatctaactcaaacacatatctgtatttctaaaagcgtacgaacttaaaaaacaactcaaacacggatgacgtaccaaaataccgataaaaacatcttcaatttttataatagcagagatagagaagtgtttcgttataatatcattgtttaaatgggcttgatagaatatcataagttaaacgaagagtgttcgctacgatatcgctcgttcgttttattatcgaaataaaactaactaaatttatactaccaccatctttgtatatatgacgctggatctatatgatttttttaagcaacttttgtatagaaactttttgtaaaaaacgcaccgtttagcagtttgaaaagcatgcgcacgaaaaacgagagtgggcagttgggaacgaggggaaacgaactaagcctaaagctgttactgaaactgccaatcctgaatacaaagtaacagctaacaagtagtcttcacaaataaaggtggggctcactgacttagtgacttctagataaaggggatcatgtttcgctactcctctgtgccttaaaccataacatcaaatggtaagctagaaagtcacaatgtgcataaatgatcatcgattagagtcatcaaacaacaaatgagtacagattaaggaaatatatctaccagaacaaaagtgacttaaacttagtgaattagtaataaaacaagtaaaagtgcaactgcattttgttcatgacctgaaaaaaa

SEQ ID NO: 56373 - DNA, 806 bp, Oryza sativa
atgtgagtatttttaaaaaagatttcttatacgactctttcgtattttcaaaagcaaacgagcttaaatctaactcaaacacatatctgtatttctaaaagcgaacgaacttaaaaatgactcaaacacggatgatgtaccaaaataccgacaaaaacatcttcaacttttataatagcagagatagagaagtgtttcattatatcatcattatttaaatgggcttgatagaatatcataagttaaataaagagtgttcactacgatatcgctcgttcgttttattatcgaaataaaactaactaaatttatactaccaccatcttcgtatatatgacgttggctagttcaaacccggccgcctcacaccacatccactcggacgcgcacggcagctgtgtccctcttctcggcggcgacggcgagcggtggaggacggtgcggtgtgccggtgagggatgagcggcgcggccgagcgggagctatgctgaccggagatggaggattcggcggctgcgcttggaagcttccattgaattaggcagtttcaatccgtgttgatttatgactgctcggatcttcccgtgtcccgtgttcgactcacatatggcctcatggggcacctgatggatgtttgtctctggctaatcatgaatgatgagttgtggtgtgaacattgataaatttacatatactataaaaatactcgtgcattgcaatgggtgaatactattttaacattattattgttatacggtttagataggataaaattcactataggaattcgcttggatttttttttt

SEQ ID NO: 56374 - DNA, 1340 bp, Oryza sativa
  unsure (1)..(1340): unsure at all n locations
tttgtctcacatactatcagaggcacaccatttcctagccacaattttacagtgaaagattggcgataaatgtcaacttacggatgacggcaatgaaaccaaagaaaaaaaactaccatacggatgagactaacatgtgaatatgcagatttagagacctaggagaaagaggacggggagtacaccaaccttgggaatagttgtcgcggactcggggaggaggcggaatgcgacggncgncggtcgacggcggggcgggtctagggttttgtcggcggcggcgggtgacggatttgggttgggaggtgtgggagaaatttcattatgtacaatctaatacgctgaactttaaggctgtgttcgctatgggttgttcccaacttggaacagtagcacggaaaacggagcgatccattagcgcgtgattaattaagtattagctatttttttttcaaaaatggattaatttgatttttttaagcaacttttgtatagaaactttttgcaaaaaacacaccgtttagcagtttgaaaagcgtgcgcgcggaaaacgagggagataggttgggacaatggacgtccgaacacagcctaagagtctagcactcaattcgtaagactttaaaagattttaccactaggatagcgaatttcttcatttcatactaatccagtctagaggtgaaaacggaacgaaaaccatctttattattttcgttttcatattatttttagaatcggaatcgaaaaaggaaaccccggaaacaaatattatcgataccgaacaaaaacgaacaggcgcggatacggtaatgaaaatttatcggaataaaaaaccttttaaactgagcttcaaacttttatcaagtccaattctcaagtctcaacggtcaacaattcatcgtaaaatacaattatatcaaatgaaatattttaatggggcccgactataagctggtccaagatgagtcaagcgctgagggagaggcgtgggtcccactctctttttattttatcttcttttcttttatttctctctttcctccttgtctcttttctctctctccctatctcttttctttctctgcttctttgtgcttctcgaccaggcagagaggggggcggcggcgaggcagggggacgacgcccgggcgtcgggcggcgaggtcaggcggcgaggcgtcatcggtgttggtggtggtgaggaagagtcgccagtgggcatcggcgttgaggcattggtgtcagcggcgtggacggcgacggtgaagcacagagaggggcgagacgccgggggcagggacggcgagtgacggcggggggaggacgacgcgagacgg

SEQ ID NO: 56375 - DNA, 20833 bp, Oryza sativa
ccgagtgatgatggcagtggccgagttcgagtactgcacgcgtgcgacgacagtggcatggttggggatggcttcacgccgctgcatctcccctcctcactctggccactgcatcttccctcatcatcgctcctctcccctctctcctctggtacgtgtgggtcccgccgcctgagatgaggaactcgtagccaaaacttactccgcgttcttgaggaggccacgcggatggacgatgtggcaacaaatatttggttttggggagggaggctgaacgccacatcggcgcattgtgaacgccctaagggtgttcttagcttttcatgtcagcttttgccatcttctattttagtcctcacatgtttttaaactacataacgtataaaatttagcactaaacaccctcaatttcagaaacaaggatacaatttctccccttccatcattctctctattccccaaccaccacaactcgatgacggctggcagcacagcgagctccaacaaaggacggcggctccccaacctcctcccaaacagcggctcggagggcgacggcggaggcgcaagaactcgccgagacccctcctctccttgccggcgacgagcgctcgacgggcgacggcggcggcgcgggagctcatcggggcccctcctctcccgggaggcaacgagggctcggagggcgacggcagcagcgcgagagcttctggggccctccactcccagccagcaacgagggctcggaggacgacggtggcagcgaggatccggcgtgagagctcgtcggcgccctccacttccggccggcgacaaggagacggagcgccgagggcgacggtggcggcacggatccagagcgacggtgaccccgacggtggagagagaggtttgtttcgatggtggggaggtgggggtgatggtctacagcctggattccatgcttttatctgctttttccgttgagcttctcatgtcttaagttagggtgtgtttagttctagggatgtaaagtttttgaagtataaggaaacacatttgaagtattaaacgtagactaataacaaaacaaattacagattccgcctgtaaactgcgagacgaatttattaagcctaagtaatccatcgttagcaaatgtttacttagtatcacattgtcaaatcatgtcgcaattaggctaaaaaaattcgtctcgtaatttacatgcaaactgtataattggtttttttttcatatttaatgctctatgcatgtgtcataacatccgatgtgacgtttttagctaaaaatttttgggatctaaacaaggccttagtcccgtgttcctcacaaagaaatggtcccccactgccacgttagcagctgtccttcgtggcgagatgccacgttcctgcaccgtgaaggcctgaagggacaacatcacaaaagtcagtcaacttgagaatcatatgaatcattgaaggcggtgacagccaaaaatatcatcttgacttgtgctacgatttagattggatgaggccagagcagaggactcatagcctccttgctttgcttcttgggtgtatcatcaataggtagcagagagagtagcagacagcctgtgaaagagagcaattgtatggcagaatcgctgcttctccccgtagtgcacggggtgatcggcaaggcgaccgacgcgcttgtccagaaagtcacccgcatgtatggcgtcgacggcgaccgccgcaagctggagcggcagctgctggccgtcgagcgcctgttggccgacgctgagtcgaagagcgagaccaaccccgccatcaagcgctggatgaaggacctcaacaccgccgatgacgaggccgatgacgtcctcgatgagttccagtacgaggtgctgcaccgcgaggccatgagcctcaagtcgctagggcacaaggtacggagctacatgacccccctagagttccattttaccatgagaaggaagcttgccaaagtgctcaagaagatcaacgagctggttgaagagatgaacacgtttggcctgttgctgcgagatgagccacaacaactttcttaccggcagacgtactcagtgctgccatcaaatgaattagatgatatctttggcagagacgacgacaaggaggtagtggtgatcaaactgttgctcaatcagcgagatcagcacaagtgggcccaattgtggggatggggggtttaggcaagacatcgcttgccaagatggtctacaatgactacagggtttagaatcacttcgagctaaagatgtggcactgtgcgtcagacaactttgaagttgtttcccttctgaaatccatcattgaattggctacaaacaaagcatgctaactgcctgaaaccgtccagttgttgcaaaaggaactacagaaggccgttggccggagaaggtttctgctcgtgctggacgatgtatggaatgaagaaaagaagaagtgggaggaagacctgaagccactcctgtcttctgttggtggtggtgatggaagtgttatactagtgacaactcagagccagcgagtagcatctataatgggcaccctagaataccataacccagcatgtctgagtgatgatgattcatgggaattattctcaaagaaagcattcagtaaagaggtacaacagcaagctgaattggtaaccgctggcaaacttattgtcaagaaatgtaaggggcttcctcttgctttgaagacaatgggtggtatgatgagttcaaagcaacaagtcaaggaatgagaaacaattgcaagaagcaattaggggacaatgacaggggcgaagatgatatacctatactaaaattgagctacagacacttattacctaaaatgaagaatgctttgccttttgttcagttttcccaaaggaccatgagatggacaaagaagtgttgatccaactgtggatggcaaatggtttcattcaggaagatgaaacaatgggtttggaacaaaagggggaatatgttttctgtaatttggtttggagatccttcctccaagacgtgaaaccgatcaagacattttctttcactgctgatgagtctataatttgttgcaaaactcatgatttgatgcatgacttagcaaaagatgatataccgaattttcctatgataatgaaatgagtctaacagtgggattgctcaaaatatcatcttctatccacactttgataactgcatggttactagtacatattaatgacttaagacagatgtcattaagagattttggtactgacttgagacttatgtcattaagtgctttgggtattgtctgtattcgggcttgcccttctcatagccaggtgatcaatccaaagcatctacgatatcttgacctttctaggtcttagatggatgtgctgccaagttcaatatgcacgatgtataacttacaaacactaaggctcaacgattgcctacttctgacatatttaccggaaggtatgagaacaatgagcaagctcatccatctttatcttcttagatgtccattgaagaggatgccaccaaatattagcctactgaaaaatcttcgcactctaacaacatttgttttggacactgaacctggccgtggaatcgaggagctcaaggacttgaatcaccttgccaacagattggaactggagagctacggccaagctggaaccggtcggttgggctactcagagagttctctgataggggagagggggaaaatggctggggagcgagcgcgtgagggagcgccctcaccgcccggtggacggccactccggtgtccgacggccacattccaaaccccagtttggttcctggcgcgacatcgtggtggggattggggaccacacgttaggtaaggctgagaaggaggcggcttggatagaggtgagaaggaggaaaggagttcattcaatggcgacctaccggcgcccaaccactcgtccatcagcattcaaggcggtgagggatatcccctagtggttgcagggaggtgtttcaaatgccttggcctagggcatcagaaggcgcagtgtaccggccagattcgttgcttccgttgttggttttcgggccatcttgcgagtttttgcaccgagcatgacgaagtctcttcaactcgcccgtgctcagttgctcagcctgcttccctcgcttctctagctcgcgtgcaccctgctgctcgccccgttcagccgacgccatgtcctgctgctcgtccagcaccgcatacagctgctcctacttctcgccagcgtccgccatccccgtccgctgcttcgggtcgcacgcgtcccggcctgctccgcctgccgactacagagtggttgggcgagctgaggaagaagctcatccgcgggacgtcgtcaagtcttccaaggagatggcaggttttcaaatctgcgcggctagggagcacgcctacatggagggttttcgagtcggcgagccggagctgcggctggggactggccgttgcgtgctgtcctggacggtgggcatggagcacaatgaagcttggctcaaccagcactcgctgttggccatggttctgaagacaagaccatcggtctcaccgggggagatgttagaagccatcgtccagcacaccggcatcaacgagagcaacgtccgtgtcgacgtgacacatacggaggattttctggtgttgttccgcatgctgcaagatcggaaccttgttctccattgctctcatgagattttcgtgaagggggttcccacgtccttcaagctgtggagccgccggagttgggcagacagctcggacttgaagttcttcaccaagatttcgctcgatgggctccctgctcacctgtgggagcgcgaagtggtgcgcaaccttgtcaacgagctcgagggggagctcatcgagagcatccctgccaacgacaccagatgtctgggcctcttcgcctggttcaagaatcctaacaagcttcctcaacggcttcaggtggaggtgcctaagaagataggggcgggcggctcctggaggaagtcgtcttcgagctctgctcctcctcgagcgcctagagcacggccctcttttactgtatggcgtcttcctccacgttgaagaggtgaacgatcccatgctgctgcatgcccctgataaattctacaacgatgatggtgacgatgatgtgacaaggcgcaacaccttcgactgctgggctaagtggttcaacagcgcaggtctgtggccatcggaccggggaggcagcactcgctatggaggagcatcaggttcagccgggggtttggaatgccaagcgttcgatctcctgccgtcggtgatacagcaaccagtccgtcttttcaacacggaggaagctgtgtcggccatcgttcgtttcggttcgtcggctacgggggaggatctgctcccgtcttctccagacgctgctgctgtcgtcgggacgagggagctgggcacacaagtgccggtaacgcagggtttcgaggtagcggcgacggctgttggtgtggctgcttcggttacccctgaggttggcgctgcttgccgtcgtcctatggggtctggttctctcctcagctgagacgatcaacgcgtcgcttcaggtggcgcaagtcaacgacgtttaacaattctcgccgttgactcaggtgatggtgctggtctcgcccgaagtggtggtcgacactgtcgaggtgatctcgccgtccctacctcgtgtgttcgagcttgctgtaccgggtgcaggggcgatatgatcccctgttgctgagctcatgttgccaacgaggtgctcgcctgttgtctccgattcgctgcgtctgacggaccaagagcaaggcggcggaggatggtgcggcggggtcgaggtacacgccccgacagtctcgttcgtgttggcggtcgaggagcaaggcggaggttcacggtgcagttcgccgatgctggcggacgagaaacatgacggtggcccacggtacagagaggtcacgaggtcaacctctcctgtggcacaccattgcactgtggacaaggttcacggtcgcaactcccaagacgaagagagcagtccaaggccagcctcggcgcctgcttcctgctggtcgctgcagaccacaccgctccctgctagacgcctttgcttcgacgacctctgtttggatcctccattaataggggcggttgaaggcagcagcccccaaggtgggaactcagcgggggaacattttcgagctggaggtccggctcctactgaagtcgtccgtgggttgtatttggcaattcctcaagtagcccaggaacaggtggtgccttttgaccgtgtctactctcgacgaaaggaggccggctctaaattgggcatgttgccaactcagatcgctgtgtcggcaacccaggaagtgcagagcgcagccgcagcggcccaggaagcaatcctcgttgcggccgatgagaacatgtgcgtacaagtcaacatcttcgtcgacgctatctccacgccgtcctcatcgtccgtcctcagcaagccgcctgcctccgtcccaatcaccaagagcagatgccgcccggtgatcccagttgatttcaagccttggagaagcccacggctggctctgcaaggctcaggcgcccgacaccactccatctccaaggcacagcgggtgactatgaagaatctgggaatcattgaagaagaagaggaagcaaacgatgaggcgatggaggaatatgttcaactcttcgacgaaccgctgccgcctcaccattttgaggccttggcggagctgcttcatcttgaactggcggagccggagttccaggcgctagcggatgtggcacctttggcagttgcttctcctgcttgattttgtatgctgtgttagccgggggctgggggtgtctggttgttgtaatgtcaggagtgagtttcaatcttctagtatggaatgtaagagggctaaacaacgctgtgaagtgctccctggtgaaggagtctgttgtttcctccaatgcgttggttgtgtgtttccaagaatctaagttagaagttgttgatcgtgtcactgtctttgaactttgcggccctgattttgatcgttttgaatttcttcctgctcttcaaactagaggtggaatcattgtggcgtggaagggggatctattccagggcactcttgtccatgttggacaatggtcggtgacagttaatctggattggcgccagggagggagatcctgggctgtgacctcggtgtatggccctcaaagggatgatgagaagctgttgttttcggaggaattgtctgtcatcaagaattgttgtttgggggaatggatgatagccggtgatttcaacctcattacagcagccgaagacaagaataacacaaggatcaatcggcgcttgatgaatgcttttcgcagtaaggtgaacgatctagaattaaaggagatgtatctttttggtagaagatatacttggagcagtgagcaggcaatcccaactttggtgaaactcgacaaattgttcatttccactcagtgggaggatctcttccctgaagctcatctgcaggctctaagttcttcaggttcagaccactgtcctcttcttttaacctggggtaaccgagtccctaagcaaaaaaaaggttcaaatttgaaaccttttggacaaagcttgatgatttcaatgacgtagtgcaggagtcttgggggagtgaggtcgatagctctgatcctttctgtattttgtatgtgaagatggcaagattaagcaaggcacttggtaaatggggacagcggaaaatcagctcgttcagattacaacttcagattgacatcaatggcactttaagtgaccccttcaagcctatgagggggctaagacaaggggatccgttatctcctcttccttttgtcctggtgatggatactcttcatgctatgttgtagaaagcaatgtcagccgggttgcttgataaagttaaccaccggagcagagcaccaaataattcgctctatgccgatgacgcagtcatcttctttaaaccggttcgtcatgaggccatgctagtcaaagccgtgcttgatctctttagtgaagccactgatcttcttcccaacttctccaagagtgcagtttcaccaattcgctacacagaggaacaaagctccttggttcaggatattttacattgcaaacttcagaaccttccaatcctctatttgggtcttccgctctccgtgaggaaaccaacaaaagcagagttacaacctctttttgatcgcttggctaaaaaggtggcaggctggaaatcaaagttcctttcacctgacgggcggctctgtctgatcaaatcaattttgatggccattccggttcactttctctctgtgatgcagctgccaaaatgggccatcaaggacatcgaacgccgctgcaggggtttcttgtggaaaggtcaagaagaagttaatggggtcattgcctagttgcttggagagccgtcagtatgccagttgaatttggtggtttgggaatcagggatattgagcttttcgggaaggttttacgactgaaatgggagtttaacaggcttgaacatgaagataggccatggacaatggctaattgggaatctgataaggatgtccgcgacattttcagctcgattgcacagcacatggtaggagatggccgtcgcatcaatttttggagaggtaactggctgcctcgtggggaaagtattgtaaataattggcctatcattttctgctttgtcggtcgaacgaagatcacagtggctcaaggactgacgaacaacaggtgggttagagacttgcaggggtccatttccaatagggcccttgctgactatctgaatttataggatgagctgcaacaagtgtctcttcaagacgggcagtcagattcggttttatggaggtttacagcaagcggcgccttctcggtttcctctgcatatgagttcttcttctacccttcggtgaagtgcccccacggtgagctgatttggaagaccaaagcgccggcgagagtgaggttcttcctttggttagctgcgaagggccggtgtcttacggctgtcaacctcagcaaacgaggctggccacatgatacgacatgtacactgtgtcgagctgcgccggaagactgcatccatctgtttacaaaatgctctttcactaacagagtgtggcatcagttgagaacttagctgaatgtggcgtttccccttcctgatcagctcggtctacagcttgcagaatggtggctgcaggtgcgtctctgttttcggtcaaggtacagggccgcctccgattctctgttcatgttggtctgctggaagctttggaaagaaagaaacgcaaggattttttatgacagatcaagggtggtagaacacttggtggcagacatcaaagaggaggtcctgatctggagagcggccggaattttttcttgcggggagtagcagcatgttttttggccccctgtaaatagttttcctgttctttttcgaggtttccctcgactcgacagtataatgttgtgtatattgtattaccctcttttatcttaatgaaatttggtcgacttccttccgccgacccagcaaaaacaggttggaactgtacaatttgagtaaaataaatagcagggaaaatggaaaagatgccaatctccatctgaagcaaaatctaagtgaactagtactttcttagggtggtagtatattttgcatgcctgaaaacaagggatgcaacgaggaagaagtgttggagtctcttaaacctcacgctaagctcaaaattttggaactacacggatatagtggcctaaagatcccacaatggatgaaagacccacagttgttgcagtgcctaacaaatctccacattttcaactgtccaggatgtaaggatctatcgactgtgtggtttttggtctcgcttgagggtctgttcttatctaaaatgaaaaacctaaccacattgtttatgaatgtcgctggtgtgaaagccgaatgatactacatccctctgcaaattttcccaaggttaaaggatatgactctatgccagttatcaaacttggagaaatagacagaaaatactgttggcgaggccgatactattttggttacgtttccggagctcgcaaagctatatatcttcgattgtccaaaacttgcaagtgttccagattgcccagttctaaaagaattgaactcagctagatgttgcagtcttgcaatgagctcacttgcacatctaacaactttgtctgaactcatttatgaggacaatgagcgtgtgagaatgtcgttgggctcatggccatctctcacgaaactagatgttagttcgtcatataacaaaatgtccactctggaggtcggtacaaaccaaggcccactagaaaaccttcggagtttaacgctatatcgcctcaactgcttcacagatgtatctggtttctcaaaaatacatcttgggctatgtaaatgctttgcctttgtggaggacttgtctattagtggatgcgacggccttgtgcgctggccaatagaggagctcatgagcttgattcaccttcgatccctgtctattgaaacttgtcgtaaccttgagggaaagggttcatcatcggaggatggtcaattacatatcccgatgctgcctgcatccctcgaaaagctatgtctagtatattgcccaagattggtggcgcttccttcgaagcttggaaatttggccaggctaaagattatgagtttgcagcactgttatgacctgaaagagttgcctgatgggatggatggcctcatttcacttgaagaattgaagatttggaactgcccagagatagagaaatttctgtagggtctcctacagcagctccccacactcaaagagctacttctatggggatgccctagcttgcaaagactgtgcagagaaggcagtgagtattttgatctggtctcgtccgtccaacacatagacatttcaaaaccagaaacagaactggccgaatggcccgaatcagaaacagaacagaccgaatcaagatgtaacaagaacaagcagcttgtaaagaggctcctcccctctttcttgactctcgaatgaggtgcgtacgctttgctcttccattatctcactcttgtcaccttttccatcattgtcaaatgacaggaatagaggagccaaaaaaccaggatgataaattgataagctgtaccggagaaagaatcgggattaccaccttattacgggcagggcgacgaacttggttgctggggtgggaaggagcggcggctggattgtagttgttatgttgttgacaaaagcctcaacttacttcgccccctgatcagcatcagagcctccctgagctgcaaaggaagtagtgaaaacaggggaggaaatacgctgggagtcaaagtcaggcgagtagatggagtgctgcacagaagcctcatgaatcaagggatcaaggtgccgctctagcaagctgagcacatcatcatcctgcgaggagaagcaagtgtcagcttgaaggaaggcgtggtctcggatcggagacctcggagaaggcaaagcatgtgagcgtagcaagtgagcatttgctttgtaaacggcgcacgggtgcaaaacttgaaacatttgcccaggaaatcctgtcaaaaaattttgggttgtttgatgataaatctgcctttgatgataacatcaagaaaatttacttgcagttgtacaagaaaccactctctctggtgtctctgcagataatcgcgcatttggtcgagaagggtggctgcaagagcattcgcctgaaggccacaaccaagaagtctgcggtggcgccggtataagcatgaccggagctgtgctgcaaggtcgccaagcaatttaatgaagtctttcccgagctcacttcgcaatcagctgtcccggacttgcttcagtatgagtgtcttgtgtctgttggtagaaactgtgtctgcaactcagcatcacctctgtatgcagctctccaccccttcttgttgtgtttctccctgtctatctgggttgtgtttcggcaagaacggctataactggggattgctagtttgtatcttagtcgatctgtgtttccatgtctcaagaaaatgttttccactttaattggaatgttagaggtctaaatgccagagccaaacaagatgctataaaacttctcattcaacaatacggcgcgtcgattgtctgtctgcaagagacaaaactttcagctatctcttcccaaatcctcctcaactctcttggacagagatttgcatagcaatatgctgcactgccggctgatggcaaagaggtggaatactgcttgcctgtgatgaaaattatttctatctctctgatgtctttctcagtcaatactctgtatctgctactataaccatgcgcgaagaagggcttcaatggtcgatcacagttgtatatggccctcaactcgaagctgaaaaaattgaattcctggctgaactagagacacttcaacccaccatgaaaccagcttggatggtgatcggagatttcaattttatctacaaaatttctgacaaaaataatgatcgtctcaatagaaggatgatacaacgttttagtggtctcctggataaaatccaagtgaaagagctgcaccttcctggtcgtcgcttcacgtgggcgggagatgggacaaatccaacacaaacaaaaatcgaccgagcgtttatcacaactgattgggatttcatgtttggagaagcacaccttttccccctctcctctacatgttcagaccacgcacctcttttccttgttggaaaagagaaaagaagcaaaccacctcaattccgttttgaagccttttggttgaaaattccaggttttttggaagtagttcaagaatcctggcacagatcaatctttgccaccaaccctcttgcagttttcaggatcaagctttgtcgactagcttgtgatcttaagaggtggaacaaaagtcaggtgggggacattgcgctgcaatttgcggtggcgactgtagtcatttttcagcttgacgtagcacaagaatcaagaagtctatctgacaaggaacgtctgttaatctctaacctgaaatctcgagtgctagggcttgcagtgcttaacaaaattaagatcagacagcggtctcgactcacctggatcaaggagggtgatgttaattcaaaatttttctacctaaaagccaactcaaggagaagaaagaatttcattcagtctttacagaccccaaccggaattgctgtcacaaaccaagataaagaagaggaactttaccgtttctacaaagaaagattgggtaccaatttccaaagaagtgtgcggttgaactggaactcactacaaataccttcgggacttggctgatcttgaaggagacatttctgaagaactcaggaacacaattttcgagatgccatcagaaaaagcacctggaccggatggttttatcgaagccttctataagtcagcttgggagataatcaaaggggatttgctggcagccatctcttctttcatgaaccttaatacctcacaccttgcagatttgaattcggcttttatgtctcctcccaaaaaaaagatgatgctagcagtttgttcacagcttcaaaaaaatcattaccaaagttatggccaatcggctggcaccgagactcaatgagttagtctcgcaaaatcaaagtgcgtttgttcgtaaaagggccatccatgacaattttctttttgtccaaaatatggttcagctccttcataggactaaaaagcaaagcctgttcatcaaagtggatattgcgaaggcgttcgacacggtatgttggccttacctccttgatgtccttcaacaatttggtttctgcactcaatggctcaactggatctcgaatcttgttgcgacgtcttcccaaattcttgtcaatggcgcgccgggacaacagatcttccatgcaagaggcctgcgccaaggtgacccgttatcgccaatgctttttatccttgcaatggaaccttttcatcggattctataagcagccgaaaatacctccatactttccccgattgatagaaatcgggtcagatttcgatgctcgttatatgccgatgacgttgcagtgtttgcaaagccgaacatttctgagcttaacatttttacctagctgttaattgttttcgccagtgtccggtctgcatacaaacggtgccaagacagagattttccctattaggtgtgaagaggtagaccttgcttctttgctgcaagctttccccggcatcgttaaatctttcccctgcaaatatcttggccttccacttcattatcgaaaattaaggaaaattgattttctccccctcattgaaaaaataggggaaaggcttcccacttggaaaggtcgattcttcacttcttcggggcgcgagacgttggtaaaaacggtccttagctccatgccaattcaccacctttcatctctgcacatgcccaaatgggttttcaagaggatcgaccgctttcgaaggtcctttctttggaaaggtgaagacccagatcacactaatcctggcagctgcttggtcaattggaaaacagtttgcagaccgaaaagaataggaggacttggggtccctgatcttgaaagattttccaggattcttcgtctacgctggttgtggttccagtggaaagatgaggataaaccttgggttggcatgaaagtgccttgtgatgatactgatagacggttgttccaagcagcaaccacaaacgtattgggagatggtaaaaaaatgaatttctggcacgatcattggctccaaggtaaatgtccgaaagacatagcacctctttgctttcgtctggctaaaagaaaacaaaggtgtgttgatggaactctcttccaacaactggattacctcttttagatatcttacatcaattgaagaaatcaatgacctagtgcagctgggaggtttacggcaagaagttcaactaccacaaggttctgataatatttcctagaattggactactgtgggttgctacacaagtaagagtgcttactcttattaattcgaaagatcctacacacgtgtcgattttaattccctctggtcggccccagctgaaccaaaattgaggtcttttggctggctcattctccataaaaaacgttgacagctcaaaatctgctgcgaaggcattggccttgcaactggatttgttgcctctacacatgtgctttcgaggacacaaatcaccttttatgggactgtgcttttatgagagaggtgtggaccttaatccaatcctggcaaattttagctcccattaacgctcagccgattgatgctgggaacagttgagcagatcacagagcattgataccaaatgaaagatatccaaaactttctcctcacacgcgtcaagtgggccccacctccaaccaaagacagcgaaaaaaaaggcaaccgtcctcacgaaaaggaaaggcgcagcccacaacctccaccggccaccgaagctctcgtctcctcctcccttcctggggaagcgcgaccatcccctgaatcccccaacacccccaaaccctcgcgagccccaaaccctaggatccattccattcccctctctctctctctccccgcggccggccgcgatgatgcagatgctggggctacgcggctccgcgtccaaggaccgggaccggggccgccgcggcggggacgaggcgtcgccgggccacggctcgccgtggaccccgtcgtcgtcggcgtcctccccgcggtcgccgttcgcggggggtgggggtgggcggccgctgcggctggtgtactgcgacgagcgggggaggttccggatggacccggaggcggtggccgcgctgcagctcgtcaagggccccgtcggggtcgtctccgtctgcggccgcgccaggcagggcaagagcttcatccttaaccaggttcgctctcgcccccctcttctttttaccaatggttgaacaaatctgtcctgtggatcggcactggaacactagtaggatcctgataagaatctggaagaaataaatatcagttcgaggcactgtaggggacactggtagggaaggttggggtcttggttggcggcgtaaacatttcatttagaaataggaagaaaagacaacatttcgtgggttgtatgtctcgtgcagaaattgcattgcaaaagtaaaacttttgcttaccgtgttttttcttctcaataaactttccacctgcgggaatcagttttggtccctgttttttcttctttccgctatacattctttcagaaccgtgataaaggttgggtgtattaaggcatgcaactttcctaaataatcaaagagggccaacttttcttatgcattgtgtgtactaccatattggcgtattgctgcccggttactttggtcattgattcgatgaatttatggatgactgatgacacttacaagattctcctgaggatattttatatttgttagaccttaacattgattctggtctagtggaccatgaaacatcctttggtatttatataatgacttattaaggattatgatgtcttgaaaataaaatcggaaaggaagatggactaagtgtggtatattttctattttgtggaattgatgtatgctaacaaggtttaccataagtttcattttttttgggtgtgaaatgactgcagatgtccttttactcctatcagagcatgacctgtaaaagtatttctattagactttgtagtttggagaagagtctgtttttgacatctcaatttcttgcatttgaagcctcgttagcaaattcatatatatcaagattttgattacggagtactttatataccagctaattatcttgtcaaggagtaatctgctctatttctgtgtttttgacagcttctaggaagaagcagcggatttcaagtagcaagcacccatcggccctgcaccaagggcctttggatgtggagtgccccaataaaaagaactgcacttgatggaactgaatatagtcttttgcttcttgatactgagggcattgatgcatacgatcagacggtgagtattgagtaatacctcgatgatcccactttgttgctaagcctcagcttcttcaaatattgatcccatgtgttctctatgtgttgtccattcttcaacaaacacctgttcctttgctatttcccaaatgtttatgctgtctcatgcacgcattgacgtttatgcaacagccctttttatgtatgcatgatttagcagactgcacccatctggagttattgatgtaattgagtgttctcctggtgtgttatcaaacatattcatgcttacaattctggcctacctatggcatactgatactgttacctttatctgcttgacttttgcttgtatgatgtgtaggtcagtaattaaatttacctttatcatgtgatgttaccaatgtaatatattgccctggtgtgttgtcaaacatattcatgcttaaaatgctaggtttcctagtgcttagggtatgagtttatgtgtacttgtatagaagctcaagtagaggaatatgttcaagctttgaagtcctttccatatattttaggattactttcccctaaatttatggactagccctagtggtatggtagctaccagacctcatcgacctcattcttgtaccctagtcccaattttccatgaaatctcaacagatatttttttgaataatttttttattgtggtgagccaaattatgaaatttcatgatgcatacaagtaaaaactgaaaacccggaatttcagatcatagaaacctgctgtgcttcatgtatacatcatcgtttgataagtatggaaacttgggaagtctgaatatccatctgtctgctttcctgttcattttcacatttttgtttttctggtcgactagaggttcaaaacaaggcagcaatttgttctcaatgaattcaaggtagtgcactgatgagatgatctatctggtttatatccccaatttttgtttaacatcatcactcaattcatgtgttttgcttattgaatggaagaggttttgatctaacaattgcttgatggcttatgcaaatgcatttcccttattttcttgtgcattttctgaaaacagttcagcattgtccaagattttgtttttgtgatgatgcaagaaaagtagtaatgaaaaagaaaacttttaatctgtagtctatacattactgacttgtttcctctttggcagggcacttacagcattcagatattctcactggcagtcctactttcaagtatgtttatatataatcaggtgtggtgcaattatgtcttttgtcttgatccttccgttctggcatatgaccgaatttcacttaataaattatgggatttttcattcttgccttatctatgtacaccttatagtattatctggtatatcatgcatgctttactgtgagttattgaaggaaatttacttcaaatgccaaaatttatgaaaaggttcacagataatttatactttggctaaaggttgtctaagtatctttatggtttgagaattcatattttaattgagtttgagttgatgacggaatcttaaggtagtgcaacatagcgatgctgctgctgcattaggggttgattttagagtagagaaagaaagcagaagcagaattttttttaagttggaaaagaatgttgggtagatacttgaatgaaagaaacagtcaaacaatttgtatgcactcccctcaccatttggcaatgactaaactgttaaacacctgaaagggttgtttcgagacataaaaattttattgatgacttgatgctgccttgctgtatagaaaaccagcattgtgcccatgtgttgtgactgatcttgaataaatatttcacattcaattttaaaagtcagttgttattaaaaaaaaatccatacatcatattatcaaccagcaatctcatatatgcatttgcaaataatgaaatactttggcaaaacaaaatataacacacatgcatatacataaatatatcaacagaagatctggattgagggtgtagagaacacgatcgccagctcctctttttaaggattaaaggtacctgattgacttggcactatctgtctgcaactagaatggcttcaataggctgtctgttcttgtggacagacgataacaaaatggtccatttatgtactgaggtttttggtagtatcttttttggccatatttatttttctcttaccagtgtagtgcccaaagtgcgttttaaataaataattaaatatatcataagttcaacttaaaaatgaaaaataattagccttgaatgcaacaaactgcatgcgtgcattgcatcaactagccatgcatatatacatgtgtgaagacaatgcaatcctttacaaacaaagattacaaagtattaataagaatatttattgtccaaataattaattatgttccaagcatatgtataatgtattagttatttggtaatgtgtcagttttgttaggaaactagaggtatggtctgttaggaatgttaatatcctactcttgagtgtcaagttagatcacaattttctctattattgatgctatgatgatgtgacccccgaaggcatgagaaataacataattgcaatgtgttttatcttttggcactaaacatgttgaaatgcacaataaatataccttactgttctttgttctttccatttgcagatgggtggtatcgatgaggcagctcttgatcgcctttcacttgttactgaaatgaccaagcatatccgtgtgcgggcaaatggtgggaagtctactgcatcagagctcgggcaattctcacctatcttcatctggctactgagggtaattgatttgtgattttgatcttccttttccatttattttttgtaaactattgaaggatttctctagtctaagatacctttttttaggatttttacctagatttagttgagaacgacaggaagataactccacgagattatcttgaaatcgctctgaggcctcttgaaggcagaggaaaagatatatcttcaaagaatgaggtactctagagtactaacacctgtaattttctttttgtagttttcattgtgatttacaattttattaattgtttatttgaattgtcttagatccgtgagtccatccgtgccctctttcctgatagagaatgtttcacactagtgcgcccattgaacagtgagaatgaacttcaacgccttgatcaaattcctgtaagtcactttcccttctgttatcactagggcgcatatggatttagggaaaagagtggagataggaacaaggaaatggagcgagtcataatgcaccccatattccaatctctatcccacctttctatcccaaagtccagatgcgcccttcccgtgggatgcatgctgaaataagtgtgcacaacatatctgaaagaactgtgggcaccacttaaattggaccattgtcttgttcgcagatagagaaattgcggcctgaatttcaagcaggactcgatgaattaactaggttcattttagagaggacaaggccaaagcaagttgctggtacagtcatgactggacctgtacttgctggtgtaacacagtcttttttggatgcaataaacaacggagctgta

SEQ ID NO: 56376 - DNA, 5464 bp, Oryza sativa
tatagatctgcgttgcctacttgtatcatcttgagtttagatgcctttgatatttgactgcagagtgttgaagaagcagaatgccgtagagcatacgattctgctgcagaggtctatctttcagcttttgatcgcactaaacaagctgaagaagtaagttaaaaggtttattcagtatatagcacatgctacaaattccattatgccttaactctgcatttaggatgctttaagggatgcacatgaagctgctttaaggaaggcacttgaagcatatggtaccgttgctgttggaactggcacttcccgtatgcattatgagaaagttcttagcaacttctgcagaaaaacatttcaggtatctgcagttttactctaattattacatcgaatctggtattgccgttaaacataatctgatgttgtggaatcatacatatcgaacaagaagttaatgacacccttagtcattcacataaataacaagagcaccgttaggtgtaaataaaaacatttcttaacaatatccgctggtttatttgatcatggactatgatgttgagaaagtaagtttttttgtcttttatatgtttgttggccttaaatgttaatattaacatagttaatagtaatcaagtggtaaaccttgttaagaaagcttcaacttgttttcattttgttaagctcaatcaactattcatcctattcctatctaatgcttaattcctctaattgatatcatgtactagcctttgatttatatgctggtatattcaacttttcgtacccaagaagtgagttgagaacattcctttagcgtgacagaatttcaattgagttagtgcacaatttgatattgattattttttaggcaatgtgcataagacttgtgcatcattgttttaagattgaacggagcaaagttgtcacacaaccattcacccaaggcaaacagaacgacccaaaatagaaaagaattagcagctactccctccatccacaaaagttacacctattacttttgtcaccaagaccaaggaaaaattaaatcatcttggatgctacaaaatggaggagtgaatgcaagcatgcaaccaatgagtatttagatgactccttggattctaatcaaacatttaatttatctcttcatttaaatcttgaatgcataaagactacaaataggaacaacttatttggaaaaacccaaatgtgaaataggtgtaacttttgtggatggagggagtatcttgcaagagctttctgcgatccactacatgattgttacatttgttattgatataagatccaacatgtagaagtctcaagccctctaaagattattttgtatagtgtatatatctctatcttgaattcttgattaaacattgtgttgttgataaaatatcaaataatagggtatgttataatggatgcatcatgctgcccccacccccaccccccaccccccaaaaaaaaaggaaagattaccttcattttataccaaatagctaaggatatgatatatgcctgtaaaattaattgagattcttctgtgtgtcattcttcgtatgttcccaaatattgcattgtggcttactgatgcctttggttcttattcctgtggctcatttggtttcatggacttacatttgtttaggaatacaaaaggaatgcctttttagaagccgataagcagtgctcaaacatgatacaaattatggagaggaaactccgagcagcgtgttctgctcctggagtcaaagtttctaatgtgattcaggtatgtaccgacatctatgctcctttaaaagactccaatggtgatggtgaatgacatctgccatcacccagcacaactgccatgtgatacccctaaatagtgagtaggtggactcctctatagacagatgtacaaacacatttaaaagcagctatgtagattgacatgcatgtaaaaattatgtgaaataattagtattgagtacaatgggaatatttttattatgacttttggggctttagagcatacagtgggggttctcttgtttaaattccaatgcaaaagcacaggcatttagctaatgacatggatgtttgcttgtggccatacttacttttaagtatgactgtcaatgatccaattaagctaatttgctactattattttattctcgatactccttatgttatttttcacctggtgtttttatggcattaacagtgtccaatacacaccgttgaccattgctttaataattttatgttcataaaaaacagtaaatacactgatgtcagtaaaaacagtagctttgatggaagcttttgtttcctaccgtgacattctttcatggaagctgctctggtgttatttcactctgtatatgcactcaagcagagaccacgttacattttgcaggtcctggaaagtttgctcactgaatatgaaacttcttgttctggcccaagcaaatggagaatgcttgcagcctttttaagacagtggtttgttcctgcccctacctaattgttttaatgcttgcacttacagatattttgaatttgcttttgtctggagatgaactggatgagaatctacaatacgccacctatcttttggtcaagtgagactatacaaaatattatttttctatatttagccaccttagtttctgctgacttgatcaagttgtttgtagaaatttgcctgctgtctcaactgtcccaacaactgataactttcatggtagttatgttatgttgttgaatttgaaatctcgaatggcaattgcatgttagatcatgtgttgagtggtgcaatattagatgctccatacccaaactgtagaatataattgtgttccagtcaattaattgtggtaatactaccgtccatctagtgcaatacagctgtagtaatttgttcaggaatccatgacatcaattattttcattccttctctttttgtaaatctattgtcaagttaaagttaaatgggtaattctggattttcattgtgtgttatcaagcctgttaattaaccatcatttgaatatggatcctttggtcaactggtcaactagttgcttagcaagcatatctaaaagttactacatctttttcttgcagtttggaaggacccatattggatctctgccttaagttagtaaatgaagctgaatcagagaggacttccttcgcattgaaatatcgttcaaatgaagatcagcttgagcttctaaaaaggcaacttgaagcaaatgaggcccataaatcggaatatctaaaacgatatgaagctgctataagtgaaaaacaacgagtttctgaagatcacagtgctcatcttgcaaacctgaggaccaagtgtagcacactagatgagcgctgcttgagcttgtctaaagaacttgatcttgtacgccatgaatgcactgattggagagtgaagtatgagcaatatgttactcagcaaaaggctgagcaagatggattcatttctcaactagcaactcttgagtccagatatagctctgcagagggaaagttgggagcagcccgtgaacaggcagcggctgctcaggatgaggccacagagtggagggataaatatgaaacagctgctgcacaagctaaagctgcattggagagattagcatctgtgcaagagcaaattaacaaaattgcccatgaaagagagagtggtataagggctgagtttgcttcacatctggaggaaaaggtaggccgtacccacaacatgtttcatatgcttgagtaagacggtatatatgctgatagcatcttaatattgacaggaagaagaaatgaagagattagttgcaaagatcagacatgcagagagtgaagaaagtgtgttggctgagcgcttgcaggtcacttaaccttcatcactacctttcaaccacttcatttagttgatgcatttattgtatgagtgctagttttctaatgctgacatgttttttcaggtagcggaatcaaaggcacaaagccataacaaggaaactgcagccttgaaggatgaaataagagaactaacaggaaaattagaatttctaagagacagggcggtatcatttgaaaagcaagcaagaatgcttgaacaggaaaagaaccatcttcaagagaagttcttatctgaatgcaagaaatatgatgaagcagaagaaagatacaaagctgcagaaagggaagcaaaaagagctaccgagttgtctgatgtagctcgaaccgaggccgttacagcccaaaaagagaaggacgaggcacagcgcttgtcaatggaaaaattagcagtgattgaaagaatccaaagacaagttgacagactggagcaggagaaagtaaatctactggatgaagtgcagaagatgcataaatcggaaacagatgccttgtccaaggttgccttgcttgagagtagggttgccgagagggagaaagaaatcgaggaattaatgatacagagcaatgaacagaggtccagtaccgtgcacgtccttgagtctcttttgtcaacagagcgtgcagctagagctgaagcgaacaagcgtgcagaagccttgtctttacagctacagtctacccaaagcaaacttgatgtactccaccaggagctgacatcagttcgccttgttgagactgcactggacagcaagctccgtaccaccactcatggcaagaggttgagagaaaatgaagtaggcatggagtcggtccaagatatggatattgatcgtccggagaggagcagaaagagatctaaaagcaatactagccctctaaagcatttccaatctgaagatggcggttctgttcatatgggtgaagacagtgtcacagtcagcacagacactaaagatggcaatccagatgggtataaaaagctcacgattgcaaagctgaaagaggagcttaccaagcatggatttggagcgcagttgctagagttaaagaatcctaacaagaaggatatacttgcgctctataagaagcttgtgttgggcaagtaaattacccccggtatctgcagaaatgcttgaccttatgcttgctgagctgtgtgaagtatgtggtggaagcgtttcagtttgcaatgtgcatttactgtttattagtacatagagtagcatgctaccaagtaggttatatttaacaagagagatgcctgattgtttagggcatttggtggtcctgctgattcgattgtatcttggtgtaaattgatcgatggttggtttgcgattaggattgcgtttgctagtttgtaattgtgtgaagattgctaggcttgtacatctgtgctaatttgacaaatgtagtgtttggctggctatcaactatcgcctgatcactgcccgatttgccgtatgtgttattaccactgctgtttagtgccggcgtaaatgttggccccgtatgcagggtaaatatatctag

SEQ ID NO: 56377 - DNA, 9005 bp, Oryza sativa
ccccacttgaaatgctaaaatgcttcgtacttttttatacatactaaacgtatgccacatacatattcagaaaccaatccagtactgaacaaggaataactttaaaatgacatgataatagagctaattacccgttttattctaatatttcccgtgaaattttcatcttcttggtggtgcctttgtacaagtcagctagattgcaaggcagtcggttctcaattggtgcagccttctggggccgttggggagcatgcattgatgcctcaccagggaactgagagaaggacccaaatatatcattgtcatacatcccaaactttgatccccgcatgcccctgtcaacacctccacccataccacccatgccacccatgcttgagaatgggctggaaaatccgaagaactcagcaaatatatcatccgcgcttcgagggttgaaccggaacgtcgacccatcacccccatagtatgaagacccaccaggcccacctgctccaggaggtggcacctgccctttgagcccctcttctccgtactggtcatagactgctcgtttctgggaatcacttagcacctgaaatcatgcaaagaatatgaattataccataaccatccagtcaataataaagtgcataatagggttccaaatttccagtatgagctgcatcataattagctcattaatacctcctgcagcaatttttgttctaaaaattgaatataacatgccattccctgaagttacaaaacatacgtaaagatcaaaaagaacagtgggcaaattccaaaataacaaagaaggtggcacaataacatcagaatccagaaatacaaaaggccattgttcccaacctaaggtcaaatgttccatattgttgcatgaaatgaatcgtctcttgagtaacaaaggcactacattgctctgtttggatcccacaagcaccgggaaaaaatgcagcattttcagatcaaacagcattgctttgcagcacccagatcttcctaccaacaacatcgcatcgcaagaacaacctcgtttaggtaatggcgaacaaaaaaactacttcaatcggcgagcggagaggaaatgggggtaagattgatccctctcgtttaggtgcaccctctataccagcccccattcttggcggaccaacatcaactagggagcacaccgggcgcatatatacagatcagaggcgcaaattcgcgaacgatggggaatgcgcatatagatacagaagaaggtgttgtgacctcgtaggcctcggagatctgcttgaacttggcctcggcctccttcttgctgttggggttcttgtccgggtgccacttcatggccagcttccggtacgccttcttcagctcctcctcggtggcgccccgctccacctgcagcagcttgtagtagtccacccccataatgaatctcctctcctctcctctcctctcctgcgcctgcctgatgaatctcgcaacgcctctctctctctctctctctctctctctctctcctctcctctctcgcggtcgaggagcggagatgcggtgggtgatggaggattattttttcttttcttttccttttgcaatctcgacgggaggagaggaaagaggaggaaggacgcagcgggagggtgtccacgtcacgtcggttttgccgacgcgagggctcctctgggaaaatggattggcatgtgttgtataaaagtcattgctgtgttgggaactttggacataaccatttctttagattttgttaatatgtactagtgctatattttgggtgatacatgtcggtgagatttggcttattatcttttttaaaaaaaaagagtttggatgttgtgtcgataatgtttaattaagtcatattagtacaatactagcatgttacaatgggaaaaaacaaaattgtaattataacaaagtatgtagtataggagatatgtgataacatcatcatgatcatcttgagaaaaccatttgatatatccatgaatattctcgtgattttgcttgagatagctatttccccgcctattataaatcaaaatatttttccagttgaaaacttagttttatagtagctagtactatatgctctagaagtgtgtacttatcaatatataaatattaaatatgttcaaatgaagacatatataaacattgttttgttaacttcatcacaaatgatcattctcggatcgcataacaataaagtttcattacatatgttcctttttctactcttgaagggttttgtatttgttttcttacgatggcgtgctctaatcgtcaaacaacaaaccaagtgcattgcaacactcgcgttggataaagtggcacatatcggtgcagacattcataaagtagtgtttccttgtcgaattgttatgctacgggaggaatttcaagaatatataaaagaaatatgaaaataaaagttagaaattttgatgtccgcattaataaactgcattactatgggatagtatttttcaaagaacaaatctttgtatttatattgtccgggtttgttgtgtaactcccattaaccttaagcatctcacacatgtaatatccacacactacggtctctcggtggttgctcgtcctgtctttcaattattatatatgttattatagaactttgggcataaccatttcttgattttatggtattatgtagtactattatgttttggattatatatgttggtgagatttggcatgttatctttttgagtttggatgttgtgtcgatattattttatgtcatatgtgggcaagatttaacttgttattcttatagctcaagtaaaaaaaataagcatgagccaaagtctaggcttgatgacttttgatctcgatctaaggctcaccattagcctgagttttgaaggttgatagtcataaaagagggtatttggatttattagatgcttctgttgtctatagtaatggcatctgatagtaaactctaatcatttgagctgtggttgataagtcataggaaaatatacgatacaaaataatttattagtaagacttttgtacatatattatttgtggtttaaaattcattgttggcaatgaaaacaaatcaattctaaagttaagtttcacaatttaaattttggttacaactaataagctaacacatacacgataaaaagcccaaatatctataccaatcgtgggtccaatagaaaatgaagtaactctaaataaggaatcaatttattttattaaatccatgaaactacgtaaaggaaattcctaaaatttggaaagtaattatctcccaatataggtcaatggaataagccaccctttcaggaaatatgaaaactaaatccaagttcaaatcatccacacacaaactcaaataaaatggtaactctaaatatattcgctctttgggcccaatcctcattccccatcttttcttcccttttgtagtccaacccatctgagcatcatcccccctcccccctcccccaacctcctgttggaccggaccatcaaggcagcccggtccagctcgacacggaatggatcatcgggctaccaaatgtcaaaagacttggatccccttcaaggatgatataaaagcatgtacaatcttgcatttagagagggttctataaaagagagaagatgatagaaccgactctatacactataagattattttcagccactcctagcttagggccaaccaccggccattgtattcttgaactcacatgccatatgccattgctctctgaaatgaatatatcaataccacatcttccttgtgttaatcacagtgggtctcactctccatggcaccctgtggttatatacattacagaagttttcacaaagcatatatttttgttatgagatctacacatagtacgttgtctataaataaacactacatatgccctaaggtactcagggagggtattacttatcaccactcaacaccgtatttaccacctccacaccagccatctccactccactccacctttaaccatgtgtgggtagagcaatgtagtaacacccttgtcaacgaatacaactgatttaactattgtgtatatatcccgaaagagaaaaaaagtaaaacaagagcgaaaaatgttccgaaagaaaaatatcaaagaaaaaagagggcctcatcatttgccttataacttatagaccaatgccaaaaattaaaatattgaagttgattttaatatttattaacatagtttctttttcagttttatttttaagttgtcaaggacacatacatgaaagctttacttataaattattttttcactaataaactgatggagacttcgtgtaagggcattttgctagttaatattcctagttaccaatagaaccttgctatacgtacgacttctccatccgactggcgtacgaccaaaatcagtggcgatcctacgtgtagtttctcgggatcctcgaaccccgggtaaattatccaattcttactaagttatatcatgttaattagtatacaattaaaaaaatagataattagtacgtattgaacccccggtaatttctgttctgggttctccactgaccgaaacagcagagcagcacaatacatgacggcgtgaggcttcatgtgatgtatagcatgatgttgatgccgcgcggcactgtttgtttcagcttaagattattgaactagattactataagctgaattataaaagctaacatagaataatctgtgagttgtttgtttccctaaattataagctgtttgttagttgttagccacccaataatctaaaaaaacacctttagtggattgctaaattatatagtaatctggcttatagattataataatatatcataataagctatatgtttttttagcttatttctaataattcagattataataattctaagctgaatcaaacgggtcatccaaaaagtcagacgctccggtcgtttgtgtagcattttcgttactaatattagggcattttgctagttggtaccgatataaaattgggcctacactacaaaaccagtgtaattcagaattgagcccacggggcaaccattctgctccgcccgtacccgtcgcgtccacctctccagtccagtccgccaccgcgccaccatgaggatcgacgcggcgatcctcgccgccgtcgtcgccttcctcctccccctccgccttctctccctcctcgcccgcctcagcctcaccggcagcgccggcgacctccgccgtccctgcgcggccttcgcgctctccgccgcgctcctcgccgccatcttcgccctcccgcgcgaccacgccagggagtgcgccgcggcctccgtcgtcgtccccgatgacggagagggtgccttccgcggcgaggtgcggtcggatatcgagcagctgaagctccagctcgccaggctgggtacgtggggactggggaattagcggcgacccatacccctccatcgattcttttcgtggcctgagaaattaatgtatttttaatatcgcgtatgagttctctccaatttcttctattcgtggcctgatctgtgtggtcaattgctgaattatgccgcgcgcacagagtctatgtgggataacaattcaaaaccattggatgggaaaagtggtcctttggaggaggatggagaggttgtgagagcaatggggctggatattcagtccctgatcaatgagcatgagaatatcaaggtatgatgttcttttaggatttgtcatatcaatttccataatccatagttctgtaattggttgcttacagagttacggtgtcaaaaattacggtctacacatgcatgatgacggttcttgatcctcccattaagaccagtgattgttttttattagggacagttctgtaacaaggagcagggaaacactcatttctttgtctgattgtgtaggaaggaagaccaaaacaaatgactaaaaataggtcacttaattagtaataccatgcgcttcacttagcaacaaaacattacacatatatatatacaaagttacatttgtattttcgtacatctatggattcgtgcgcctaggaacaacctatacctggtaccttactgtcattctgataagttgcatttcctacttttggaattttggttaaataacagaatgcttacaaatcatgcattggtcttttgtgccttccaatcttgtaggaatcactttgtggctcatattctgataatactatcaaggcaatggaaaaggaggttctctctctctctctctatctatctacatgtgtggccccgtaaaattgtgcacctttttctttttcaactatgttatgtgtcaccaatcaccaatagaaacagttacattaataacatgtataaagtttctcaagctgtccatattcaatgtttcttcatacaaatgtatatgcttcattgagaggattatcatgtcttttttctgctagaacattgagtttgcagtatttgtgttacatacaaactagaggatactgtttctattcttggtctttattttcagccagagatcttatgtaagataaaaattcctatttgcattgctgaaggttgttcttgagcatcagcaacctcattccaatcgtgaatgaagctgttacactcaaacgccagtcccttgaactaaattaggttaactaatattgcaactggagtaactaaccgcattatttggaaacactttaagagtacatgagtatggaaaaatggattacaaagtaaatagtgacattttgtaagcatgaagcactgaaaaacatcaaatactagcattcatctaaactgaaatgccatatgatctggtgaaacaatttctgagtaagttaagaaacctacacataaaacgtactaccagtaatgcaacttgtagatttatgaaatattttcccttgcctatgattacactttataatggttttaatatctcccagtattttcaatcactaccggctgcaaaccaatcagaaaagtacgggtgatgtaaaatttccatgccttcccttgcaccaatgagcatatgctcatagcatgcttagctttgtttgtaccaatcttaggttatttatgttgcccttgcacaaaatgaattactttgagagcccttcattataattattatagtataatatattacgaaatctggttcaaggtgatcatctcatggatattatgattacagattcaaattctaatggatgaatcaagaaagatgaactccaatattcacaatatatggtcaatggcaaaggatacagataatagagtcagcgctctgcattcagatgttaatatggtaaggttatcatcagttttgattgccatgagtaactaccaattctataacattttattaatattagtttttgatcatgcatttgatttattgtgttttttcatctgagattagaaacctcacatttgaatacatttttttaaaaatgtctttcaagcctaaatacatatgaagactcagtattgtgctatcttatttggtaaataaatttgatgtgttgcaatattgtcattctgaatgttctagttcaatcttgatgtgttacttttctgagctattatgatttttttgggggtggaggtattttgattaattcatctcatcagcattgtgataaaaggttcaggttctaatggatgaatcaagacagatgaactctaatgttcgtgaattatggtcattggctaaggatacagagagaagagtagagggtctacattcagatatgagaaaggtatcactatctaggttattatttattttgattgtcttgactcttgaggttgttagaagctgcattgtactgttcctttgtgcatataatttatttgaatttgttatatgagagtagaattttaatttttcaaattcaagcacgtctaaatttatactcttgttttcacaatgtttgtctatttaattaggatatggcattttagagtgcttgtctatcgagaaaaccaagagtttagtcataattctactctctacccttaacctaatgcatgaaaggggttgagtcctaattgtatcatgccgtttaataagggcaatgtaaagccgttctgtagttaattcttttatgttaaatgccaccttggtctttgtgaatggtggcgtatgatgactacagtgtctagcatttgcgctgacactcttatattcaatggagggaagaggagaagagagatgagaacttgtgaattcagtgaccctagctgtaagcttgtacataaggtctcattgcatgaactggtagttgttgctctcgatattgttttctggccatgatgttaccgataggcaatagtgaggtgttctatgaccaattatccatcgacagcacgattgctcctccaagctatgtttcttttagatcaaaggcttttgcgcagctttttactaacaaagcataacgattgttctcctccaagctatgttggaattctattggccttttttgccattctatttgccttcaaatatcgtcatgatgttaacttatatcctacacatgaaattaaaatataagccgcttttgttgtttgtacttcctccgtttcatattataagactttctagcattgtccacattcatatatatgttaatgaatctagacatgtatgtgtgcctagattcattaacatctatatgaatgtgggcaatgctagaaagtcttataacttgaaacggaggtagtaatttatatctattctctccagtattggaagatttgatctgatttcctatttctttcttactatactactctaagtgatcatgatggtataatatgggtttctatgctttttaatttttgttatatactaaaaagtaaaaacattagaaaagtatagttaatagttaaatgtaaatgtgtacatttttatctacctgtgccatatagcttttttggcatttagatggtca

SEQ ID NO: 56378 - DNA, 1816 bp, Oryza sativa
caccacccctagcggcgtgtcggcggtgaggctgagtacccactgctagagcagcggctgacggccaacatcactagagtttgaagagctagggcgccgccgaatggctggagaaaggatatagtgatggtttgtttggggagcttctaactgctgcaacttctctcagaatcagaagctccgcaaatagaccaacttttggtccagattctgagaagatgtagttgtagaatccaaaagctcccctaaaaacttttggaacccagcttttccagattctcaaaaactggctaccaaccagctacttctcagaacttaagctcccccaaactagcctagggagggtagctggagagggccgggatttccggtcactggcgagatggagagggagggcaaccggaggtgggaagcggattcctgggcattgctgcagcggatcaatgctgatgggaattcgtcaaccgaatgggaacgagagagagagaagaggaaaccgatggtctttctcaccaggtctctctcctcctagccttatggcctgagaacgtgcgtcgtggactcgtgggtgcatatgcacgaaatagtatttccgaagcgcaaggggcttctttgactgattttaacaatggttattgcatgtgttcatatgtgctttgatgcgtcaagaatattaaaatcattttaggagaaaagatatataattgataaatactagtacatcgtatggtagagtaagctgctgaaagtgcaacatcaaacatggacatgttaacatattgaaaacgaatagccatgggtaggaacaaaaaggagttggagaagaaaaaacgatgagagaagagttggtagcaacatttagtaggtatcacattgttttatttggtaagaagaatagtttagatccaaactgtaaccaaaacagtaatgaagttgccaatcaacttataggacacaattttttttggcaatctaaaatggcctgaatttgctgggattttacgagaaatatagcacaagttgcgttcatgaaaagaaatatagcacaagttgcgcgaggtgtctacaaatcgggcatcaggcgctgttccaccaagcagatcgaaaatatttcaatcgtttaaaaagctaaaacacaaacaaatcactttatgaaatattttgttacaacgtatgaaacaaatagttttcaaaaaatcgggtgctgtttcaccatatataaaacaatgtttcagcaaatagcgaaaggatgtttcaattcactgcaacatttgatctatacatagtgaaatattacgagtacacttgctgaaatattgttggtaaaacaaaaattaaaacggattactttaatagaacattttcataatatgtgggtaatttgttgcaacaacgcatgtggtgggacacgtggtgggaacggcacagaggaccaggaggaggtgcgggaaggggctggcaccgatttttatggcgctgatcggacaaccgatccccaacattttcgcaagttgtgttcgcgaaaaaaaaaatattgcacaaattgcgttcgcgaaaaaaaaaagttattcggcgccagtaggcccagtacactctttccttcggccagaatccctttccggcccaactctgagcccagcaccgttgccttgaatcccattttcggcccagcccaaacccatattccaacggtcggggaacccgagcttcaacgcgaaaaaattcgaactcccgcggcggcgcctctctctctctctctctctctctctctctttctccgattcaatggcgactactcgagacctctcggcgatcg

SEQ ID NO: 56379 - DNA, 2473 bp, Oryza sativa
  unsure (1)..(2473): unsure at all n locations
ccacgaccacaccgccgccgctgtcgccaacagacgttgctagccgaccaacactcggccacacccagaccggccgtgagccgctgtggacgctccggataccgcggccgccgtcggcagccaccgccgccgacagcaccacctccaggagctcctgccgacggctgacgccgccaccgccgtgggcctcgcaccgccgtcgccaccgcgacgggcgctcctgccacgagctcgccctgctgccgccgccgccacgtcgtcgcgagctcaacaacgagctccttgaggtagctgtgcttgcggagcatgtcgatgacctcggcctttgaccgggaggcgaagaaacagagctcgacggcagccttcgggtcagacttgacgaggggcggaagttggtgactgtgtcatggccgcggaactgccgtgccgcaacatcgtaggcgtgccccgcctcggcctcgctggtaaacgtgccgagccacacgcagtcgcgccgctcccggccggagtcccctcgatgcccaggacacaaccgcgtncatcaccgcgctggcaccgntgcccacacgctgcatcgcctncgtcgacacagctgtcgcgcctgtgccttcttgcccatggacgcaccgctgttcatgtcatcgaagaagcagctcgaccagaggccatggctacggtcaatgcagtaggaagaaaagaggagaaacgaagaaaggacaagatgggaatgaacagaaaaggatattaaaaaaagttttttattggggcccatttgtcagttggtgtagaatttgtgatgctgccacatcatcgtccgtgtggcatgccatgtaggatcctggaggtgtcatggcagtttgtgatcggattgacacaatttaacaagttttgggatttggatatatgcattttgagagtttggggactcaaatgactcagtcgtacaagtttagggaccggctatgcactttacgcatactataatgagggagtccccaaccttccacaagcactaaaagactttatcaacttatgttgtaagtataaatatgcgaaatataatggattgaataaaaatatggtacgtggatgtgagtgtttgcatgagcaaggaactcttatcattttcctcttgttgcaagctaagttcatgatacgccttttttttttgtttgcattcaaaccagtagccactgggattttttttaatacacaaattcactgcttggcttgcatggaaaataatttattttgctttttcttagtgtgtaatcaatcaatttcacttagggttctgaaaagagtagaagcagatttccatcaaagttaaaaaatgcattttatatggagaagaaaattttctgttaggagactttcaacagtgaaactttctattaggagacttccaatggtaaaactttctactaggagacattcaacggtgaaactttctattaggcgatttccaacaggatgaaaagaaactttcagcaggtagccagttagctttgggtgatgccttaaaagacttccaatatgaattgtattcagcaatcggaacattcatatcaagaacttttacacaattactttctatcagactacatattcataaggtagaaaaaaatgcatgaaaactcatctaaagctgtgctaaagctatgcatggtcatgctagacaacagaatagctgctttctctacgtgtagataagcacgtgtctaacaaagcttaggacccctttgatttggaggaaaaacataggaattttggaggattttaatcctataggaaaatttcctatgaagccctttgaaacaaaggattgaatcatatccaatcctttaaaattcttatggaatggaaatcctatagagattttggagaaaatttagcaagagtttcaacctcctggtaactttcctttgagtctatctctctcatccaattcctgcgtttttcctgtatttcaatcaaacggtcattcctgtgtttttcctgtgttttgcaatcatctgttttacacttacattcctatcaaaatcctgtgtttttcatattcgtctgttttttcattcctacgattcaaaggggctttaatgtggtacatgaccaacgtaggccccctttgattcaaaggaaattcataggaattttaaaggatttcatttctataggaatttttccaatatagtcctttgaatcaaaggaaagaatcctatgtaatcccatgaaattcctatggaatgcttcttcccatgcaagatttggaggaaatttaggccccctttgattcaaaggaaattcataggaattatagaggatttcatttccataggaatttttcttgcaaagccctttgaatcaaaggaatgaaccctatgtaatcctatgaaattcttatagaatgtctcttcccatacaagttttggaggaattttaacaagaggtaaaacttcatggaagaaatcct

SEQ ID NO: 56380 - DNA, 1203 bp, Oryza sativa
taatgtcatgatttagtatattgctgtcatagtgttacttagcttgccaatagtcagcgaacttattgccaatgggaatgataggaccccttatctggtttgattcatgttagaaataaacagacaagccaatacatcgttttatagtacgaagtaattctatggtttcgtggtccaataatgcttcatattccaggtgtgcttgcacaattcaaacagatgcaccataggaattaatttcaacacccaaataaatactaagatggtgtaaaagccatcccttatggttaactgatatatgatgatcttatggaagtcaagaaagcatctcactggtaaaaataattgaatccctgatttcaatattcgtcgtaaaaaatcaactgacagagaagcatattagaatatcactcttttttttcactactacctgattttattgttttatcctactgtagaatttctaatatatcaattggacaattgagctcacaaagtcagactactaccagtgtaccgctcgttgcacggtttaaatgatcaactctttcaaaattatcaactgcagcaacctggttactgaaaatttcacagacaggaattagtttgcgtgctaaaaacgagtctagaaactatgtcaaaaaccttctttctttcttttttcccccttcttctgaggaacaatgtgccaataacccttctatgtcattcccccacaaaaaacgagtagagggctagaggctccagggcagagagatactcatattaggaaggagagagagagagagcaatgagaacacctgtggcgcgcgcctctcgttgcgcggtgggggggagggaggggggggtcttgaggctactgcccccctgccggtgctcaccagtacgagatcttgcgccgccatctgaagggagacgatgaagtggtcgcggcggcgaggtggccatcgccgtcggcggcggacgcgaggggggaatagagcagcggagcgagtgccacactgccaccattagttcattaccaaggactagaatgaaaatttttttggatcgcaaccaatatagcgatctaatataatgtagggactaaaatggaaaaacgatacaggtgtcgctgccagccaaactgtcaatacaacgaaaaaaacatttgatcgctatacgcgattcaaattcaaccagtggcggtctaaatttctagat

SEQ ID NO: 56381 - DNA, 1813 bp, Oryza sativa
ataaatgtgattagtctcaagatcaacagtactctcaatccaaaacttgaaatatctgatgattgacattttattcattcaataatgcgcatatgaactatctttgtttgttatcatacaggcaacatattcaaaccacataagtccattatggtaggttttaaacattccattatgataagttttaaacacaaaatatgggtattctgaacatgtggggaaaataatagggggcatttgtgatattattttgtagagaagatcgtgctgtaatcaggcaatcacagattaccattgtccttttgaatatattcctaactgatttgttcgtattgaaagaaataggaagaaaagagatgttcaatagaacttctgaaaatcaagctcgcgtaggtaacgtaacagtgaagaaagtgatcgcagcagacctatggtgttctatttggcagtttggacttctttttttcattcaatgggaaggtgtcttgtggggtcatggccattagaattatgtggggggaaaggactagtgaactatgaaaagataatatgtaactctgctgttcgtagctgtactttcaacaaacatccattaatttccagacaaactttttttaacttgtacctctcttgtccgtgagatggctccatccgatggtacaataggaaccctctgcacggaacaatcaaaccggtaaacacaatgtcaagatatatagacaaagataagtaattggacaaaatcacaacctgaggtttccaccctagctcatctggacaacggaaggtggcttcgttaacagcctgattctcaagagcaaaccttgttgcaccactattaactccaaaatggatctgaacaagtttcaaatgataattagtttgactattcgagtggcattgaaggcaaatagaaacttccttattctttttctgataggacagcattgcaatacgcaaggtgctgactgcattacatcattatgtaatatggaatcaaggaaggtggataccaacccaaattacttgcccctgagccgatgacccattctctctttctgcaatggcagattccaaaaccttatataatgtgccaagtgccccctgccctgcagtttcaagcactgtgcagcttccaagtacaaggtttttcggcaatcctttcttttctacgaatgatttaagattgcccacaattttctcagttgggttctcagcaaccccatggaacttcttaaatccggtaacatggacagtaacaactgaaggtccttctgaacccatttacccttatgagttatgagagagaacagaaaacactatcccaaaaatctgaacagaacaaagatcaataaatggataagtattagcaaggcataaactacaccagacaaaaagcaggatgtcacgaccatcactgcatcattatgaacttgctaaaatcctaagcatcaggcaagaagaaattatagcgggcagtttcatatgcctcaatgaggctcctgagcatacaacatgcaggttgcagggaggttaacagcagggcacacaaaaggctgtaacactgtaaaagtaaaaaatgtatgacccctaagtaaatgtgaacaagaaccagatgattttttttatctgcacaaggacgacattaagaaccacaatctccagaactgatgaagcaatcattgttcttcctttcaaccaaaaaaaagaaagcaatcattgtcctaaagattttattaagaagtgaacaactcaagaaataatatagtctcacagaaagcgagaacaagtaggacaggtaacctaatgcttt

SEQ ID NO: 56382 - DNA, 6766 bp, Oryza sativa
  unsure (1)..(6766): unsure at all n locations
accatcacctatcctatacgaatcgactgaaacttcctgaaatcgatctgcacctatagaaaatgcacgcaaagaatcctttcttgaaggatgttatgctcttaatagtcaactccacgtctctaccgaaaacttaacagcgcagaggaccgcacaaatcctcaaaccccaattctccaatcaaacaccaggcaaggcatgaacacacaccaactgcagcaaaatcaaagaggaaattcactcaacccaagaaccaatccagccaaagcgaccacctttgaggccgatcacctcagaatcgcacccccaaaccccaccaaaaatccactgtaagtcagcaagcaaagaaaccacagcctacacgagcatccaacaacaaaaaaaaaaagaagaagaagggaacgaattgtgcacgggcaaacaccaccacccaggtccccaaccatcagcgcccccaccaaaccacaccatccaaaggctcaaagcacaaaaagctctcaccttggggataacgcagcagcagcggcggcgacgaagaaggaatctcgtagcaatttttctcctctttcttttttttttcttcttctcagtcaccgcaagaagagaagaagaagattcggggggatggaaacgggggagtggacgatgagattgcagcgaggggaaggcggagggaggcaaaggcgacgccttttaaagcgcatcgcgcaccaccacccagtcgatgaggagtagaacagtcgaactgcagaaaagcaatcgagagaggaggagagcgagacggaggagaggtctctcgtctcgtcggggctgtggctgacaggtgggccccaccgcgatgccaacgccgcttcgtggactcggtgcagccgcaagatagctgcgcacaacatactactgcattgattgaccgtgatacatggttgcatgcaaaaaaaaaaacacgaaattacggatactttagttaaattataaaaaaaatataaatttaagatgatgttttataaaactatagatttagcactagatttatcatagaacatatttaaggtgaagtatcgtaaaactacattttcagtaataaaaattattataaactactacaggttttggagtttaaatccttagcactagtgttatgtttgtgggtcataaacatctaagtttgtgattagattgacactaatacaatagttacctgctcagttttctttcagatggaaaacgagcactgttagttttttttttctttcaaataactgatggggcagtttgtttttggatattattcatcgtacagaaaaaaaaatgtaattattggcttttttctacttggtttattattaaatgcacttaaacatttttatatatttgcaaaaaaaaaataaaaaagatgaatggtggaacatgtatcaaaattcaacgacgctgccgtgtattaaaaactggacgaagtaattttatagggatttagactgtataatggatatactactcatgtacatgtacatgtacaatggatatactcatgtacagtagcaggctaaattatttccagaaaaatctgcatgtatattgtatcatatcatattccgtttgcaggttgcagatataataatttagcaaaatgctgacgccaaagtttggcaagtaggagcagagataaggccaccagattcaggctgcagcatttggaattcatccaaaaggtttggttcagaaaacagaacagaacagaattgcttcagaaaagaaaaaggaagaagaaatcatgacaaaaccagcgtacgagcttgacagactgagcccacggctctctgttcttgcaatctccaatgatttgcagcagctgcgcgtgtactctgcttatgatcttatggttgatgcagaggccacagatcgatctcatatgtttcttattagttctcatgagcaaggtcgttaaaatcacgattctaaatcgaaagttctaagtaggatgacaattatataattatatacataaaaaccgtaaattcttcgtacaaagaattgtagaatcacacacttaaaaaacgcgaatattaggaagaacctaatatcgaataattagaaggggtgatgcttcaaatccagatcgtctagcctaccattttgtagagctaaccggaagacctctgtgttagattaatgggctaggcccaattaaatactaataaattccattggcccacattaagtgctatgggtaataataccacattggaaatctaagtgaagaggtctcaacttaaatacggagctagtggagagtctctgttgactggttgagatggtgcgcggataaccaggcgggcgcgaggcgaggcagacagctgttgcgccctcttgttttgtaacggacggtaataaacacggagaattgatttcgtatcaatgaacgattgttttgtaacggacggttacggaattaaacgtcgtgaattgatttcgtcggttacggaattaaacgccgtgaattgattccgtattaacgagcgctctcttgttttgtaacggacggtaataaacacggagaattgatttcgtatcaatgaacgattgttttgtaacagacggttacggaattaaacgtcgtgaattgattccgtcggttacggaattaaacgccgtgaattgattccatattaacgagcgcgtcagttacgaaattaaacaccgcggttgatgactccgaacgttactctcgcgctcgcatatatatactccgcagcgaccagaaaggactgaagaagttctttaacgactcttgcacttcgagttcctcctcctctgatcctaagctgcagaatccttccccggttctgttcacctgcgcgcgcaggtgtaagggacgagcaggtgcctccggaactctgtccacttgagaacttgcacggataggcgggcaatcaagtttttggatagcgcttcaagcgcgactgctcttgttcttcgtggctactgttgttgcatcggcgccttcaccaagatgtcaatggagattggaaacaagaagatgaacgacatcaacggaggcaatactgcctcaaaatccagcagtgggacgtgttctcggggtatactttcattctcccgattctattagatgtttctttgttaatactcttcgcaatggcagcattgcattactatgtaaatgttgaagcttatttcatattaagcatactcaagttgtatacatctaacactgtcactagatctactcatattacaaatgtcatgtttattgtcttaatattttggattaaaatatgccgaattatgaccaaatttccaacaaacgtttctcataatcacacacttcaattaagatcgtacaattgtaccataattttgaaattttgacagatccattgccaatttctgatgataactactcggaggcaagcttgatctgaatcttgtgttcttcaatcaggcattgccaaccaccaccaaacatgtcctgcttcttttactcttttgaaccagaagtagtgagctactacgaagaaccaaccaacctacaatagaaaagtggattaaaatagtgtcagtataaaagaaagatcattaacaaataacaaccataaaatggtacacgcatctttgctgttgctcagttggattttcctgaatgattcaatcgtctgtgcagataagaatagccttgtagccatccaagttggtctcttctgacgtagatgtgagcccaaaaaaaaactgtggaaaaaaaggcaaagcccccgggatcaagaagttctcaatggattcgcccactgtaaagtgtaaaggcattaaaaggagagatatacagcacagatagaaatgctcgtttgcatcatgcgaaatcacttggttgtaacttaaagttcaaactagggaattcgctaaaaatataactgacttcaaaatgagaaacataactctaggtgctaaaaacaattattagcacctgaagaactgggaagagaagcagagaaacgttcgtacactgagagcaaagacgaacaaattacaaatgcatcaagaaacaatatgatacacaacttgttctcctgcttataatctccctttaccctttattctctctttttttttgggtactcctaactttcttgtgctcttatacaaacaagtacctgctaataatactgtattatatataaggaccataatgttttctaagcagcttaacatagtaatgattatttcttacagttatgccgtagttgcttttgcaaagattgtgatggcatagtactaacttccagtgaaataatgcatatgtcttgtactcttgttagagattgatggaagaagaaagctcaagaaaggttgtgaatatgtgcgtgtttttgcaatctatcactgtggacctttagtagtcttagccctactaaagcgagaactgacgatttatttgtagcacaacaatcacttctgtaagattctgtattttgattaaaaataaagctgctccatgaaatgtagtactagtgatcacaaaatggtagattctttttgtgcttagttagttcaatccatgtgacacgtttttactactaatttcaacactaatcaaagatgattttgctgaagcttctttattttgtaagaacattagtatgcactgtaataaaaggctaaggtgccatattcttccattagatcaccagctttactcccttctggaattgtttatcaggctagattcaccgtcacttgcttgaaccatttatctaaactctatgagcagaaatggaaataattacagttcattaaacactagtaattcttggaatacagactcaggtatactgaatgcttatggtttttgactggtcaatgtttaatccctactagtgggtgtcatcagtaatgaattgattgaacactccaagaaattcactgcagtagtgcacaaaatcattttagttgtcccttataataccaaccattcatcttgcttcatatgttcaaccactggtggtttatgtccttccaatactatgaatgggttggcaataaatcacataccaggcaaagtatcggcagctaaaagcctagaataattcaccagatggaataaattaataagtaaacaccatgcaacccgctaaataatccataaacgtccttttaaggtcagagaaatgctcaggggtttttcggctagcttcacaaggtggtgggctagccgacctaagttcgaaccctcatcctttctatttatttgatagtagttccttccttaatattcactttttttaggtcacaccactgacattagtgactatcacatatattatatgtgcaaaaggctggaaaagaggtaggtaaaagtgccaaatcgtataccggattgcaattgataattgatagggacgcaagcatctgttttaattctttgcacatngaagcaagcaaaaagaatctaatatattgcatgcaattcttttacacgttcgtgaaaaaagaagcaggcaagaaaaatcatgcataaattggatttccgtcttctagaatctggaatgaaaactatgcacactagtaatatttaaaagagctatcatataattaatgggttcatcatcgctttcacctggaatatagctgcgttggagccacatccttcttggaaacccagcaggaatttaaacaggaggcagagaacaattgcagcctttattattattattttttttgcctatcagatgcctttgttttggtgttcttatcttatcctggcaatggcatacggcatgatgcacatttcatccatccaaccgtgatagcgaaatctggcaacaatgtctgtctttttttttactctgcaaataaacaggcttgtcatcaagattgaatccgaaaggactaattcagctcatgcttctcagttctgatcagttgatctttccaacagagatagcttctcgtgtttgtcgaaagttcagtttcaggttcagagatccatcctcaattactgaaaaccacacatatatttttcccaagaaagtgtgcaaaattcagaagataagtttgatgaatgattccgtagactactagcaacttgcaagattaaccgagacagacaagttagagagtcaatccatttttaagataatgaaaatggattacatcttcagcttaagacacacaaccataagtttgctaaaaaaaaaaagagtgtcagtccataatatgattatgacaccacaaaattggaattaacattatcagggaccaactagtgatcaagctactgaatgaataataatcggaatgcaaaaccacacagaaatttccgataaactaatccactagaatcacaactcctttttgctcagattaattttagacgaacctaatctagctggtccctttcatatccgaaaagaaaaagaaggaaatctgggcaccttgtgatgatgcccaaccgcccatttctccctacacactcattccgtcctccatctgtttcaccaaatcatggcattaaaaatactcctaatctcgaatcctccgttaggttggaaagacccacgaacagatcgatcggtgttttctttctccttcgagcttaaattctcacggaatcaagcactgagaagacgctgcaagcgagaaaatctctacagatgtagcgggtgatttcgttctagaaggttctagaactagtttatttaagtaaatttcataatcccacgtattatgggtccaaaattgcataaaaccacgaaaa

SEQ ID NO: 56383 - DNA, 1936 bp, Oryza sativa
aggacaaaagtggtagcttgttacggtagcttttagtaaaagatctttttcttagcatctcatttgttgttctatgctgaaatttctacacttaatcatgtgatgtagcgcacctctaatttggttggttaggtttcattgctcatactgggttctgaactggtgggtgatgtttgattcaaatgccttttacacatcttccgtatctaatctgctttttcttgaatacacgatctgtaggtattcagtttgagaacaattgtgaagttggtgttttctccaagttgacaaatgcctattgtcttgttgcaattggaggatcagagaacttctacaggtgcatattttgtcagtttaagatgttgggaaattatttgtggaagcgtgggaatgcctaactcataactgctgcattatttgttattttgcagtgcctttgaatctgagctcgcagatgttattcctgttgtcaagacctccataggtggtactagaataattggtcgtctctgtgtcggttagtacttgagcttggatatactaagtggattaatgcacttgccttcttgtttttcgtttaccaatttgaatctttgatgtccaggaaacaagaatggacttctcttgcctcacactaccaccgatcaaggtactctatttttgtatcttttctcctataaatctttgctgccatggctacatcgtttctgctagctctgtgctattgatgtcatccacatgttggctatatgtgtcaataaattagtaacttttcacatggatatagtttttcagtgtatgttctttagccacactccgtttttatggacttataggaaaacagaaaatcttttctaagctaaataatgtgtacatgtactgaaagaaaattttatctacctgatgattataggtactataattatcattgaaattactctataattattatcagagttacagttacttgggtattgcacagagggcaaagttgttaaggcaattatggacttacactgtctgccgcattattatttttcttttgtacgagcacaggcacatggcttgatagtgttgtagtatatttggaacttgttttcatgtaatatccaaggccttctggatattgtgactatctgctagacagatacaatcaatcatgccagttggatatacattccatgcttgtgttgtcgaattgattttccttagcagcttgattggtttatgatgctgtgttatgatattttgtcatggacaaaagtttcaccatgaatttgtagtaattctatgttccctgtgtgtttgaattgttctagagcttcagcatctgaggaactgcttgcctgatcaagtggttgttcagcgtattgatgaaaggctatctgcgcttggcaattgtgtagcttgcaatgaccatgtcgcgcttacacaccctgacctcgacaaggtaagcctatcttcgtatatctctctagtgatgtttcttgacttaatgcttttccctattgtctcgaactaaatatgcctgctgctcaattctccaggccactgaggaacttattgcagatgtgcttggggttgaggtgttccggcagacaattgcaggaaacatccttgtgggaagctactgtgcgattacaaacaggggtggcctagtatgttttttctacttcatttctgttccattcgatctgtgtttgttacaaatgttctttttcttattgtacaacaattgcgaaacaggtccatcctcatacatccattaagatcttgatgagctgtccacgctcctgcaagtccctcttgttgctggaaccgtgaaccgaggcagcgaggtcattgctgcgggcatgacagtgaatgactggactgctttctgtggctcagacactacggctactgagctatcggtcattgagagcgtctgcaagct

SEQ ID NO: 56384 - DNA, 1701 bp, Oryza sativa
ccctcccctcatgatggcaggtcagtcgaatgcacatgacgatggtggtggatggtcggtttggctacggcggatggagatgacagcggtggaggctctcggtggcagctttctaggggcattggcggttaggcaagctccagcgtccagatcttgaccacgaccaggcgaagacgtggggactatggttgtaggtgagaggtgactgtgttggctggaaatgtaacggaggtttgagcaagtaacagattcgggttggcgtgatatatttgtcaaggtgaagtttgttagtgttaggtggagtttgttagagtttgtgatgaatatgtttacaaagtcggttaaagtttaggacttagagttgtaataggtattaggactagagtaagagtcggactctatcctaggatctctcataagtagaagggtgtgcttgttgtaacttcatggcaacttagcatagcgagagggagcagctgccggcggcaaccggccgtgagtcgctgtagctctgatacactgtaatatgctagatcgaagaggaacacctgtaatcagtgccccgaagatgtaggctgcggctgaactccgttactaaatatcgtgtctcggtgtcattatcgtgtttggatctcctatggtgtttcttccgcgtttagctaccaatgtcgatttcggagctagttttataacacatatagatcttacaaaaatatgaattagctcagatcaatactatgaaattctttcattttaagactacatcaaactctaagaacagagtcctcatcgaggtagatgaatgttaaggacagctctagctctagttcgaagccacagttcacagaaggtgcacaaaactttggctctcgatagctacaatgttgacatcaatttgttcaacccacgtaaacgaaaatccctccaacacttgcgtatgccctccctgcacgaactgacaaaaatccaaatgcatccgcccgtctctagttccacttcccttcttcctttcttctatcctttcttcttggcgctgtcatgttcagcgatcctgtagagtacgtgtcgtgcattgcaggtacgagacaatgactaaggcttcgttcttttcttcaacttgagacttaaacttctcgttttccgctagtgcggttttaaaactgttaaatggttaacttccttattttttgttagcacgttttttaaatgttaaatagtgtgtttttttaaaaaaattatatagatgttgtttttaaaaaataaaattaattcatttttaaatatatataataattaaaatttaattaatcatgtgttatcgagcttgcacattttgtatgcgcagaaaattttcttcatttttgaattcattttttctggttttttctttctttttttccttctcggttttttaacatatacgtatacaaactttttatacgtatgtacaaacttggtatacatacgtatataaagtatgtatacttgtatacgtatatgtatacatatgatgttttttttggttttttaatacgtacatatacatagtttgcacacttcgtatataaagtttgtacacatcgtatataaagtttatacacattgtcgacgatggatactcgtagatcggatatagagggtattggggtacgctggtacgaagatctatgtaatacgacatcaagcaaacaagaaataggg

SEQ ID NO: 56385 - DNA, 3378 bp, Oryza sativa
catcctttattcaagcacacaccatatatttaatatacgccatgcatcatggcgatcgaagctagcctagcagctgggaaaggcgatgccgcaggcggcgatggtattgcgggcgttggtgctattgatgtaggacgcgtacatcgggtctctcgcgtactggcagaagcacccgtccttctcctgcgcgcgcaggttggagcagcacgacttcgacggcgcagtcccaaagaagatcgggaccgcgcacgccgacagcttcccgggatcgcactgcaccggcggtggcgcctgcgccgccaccaccgccaccgccaccgtcaccgccagaaccaccatcaccgtcgcttccgccgcccacttcgccattgctcgagctacctagctaggcgcaagaaccgcttggtcaattgattactggttgatgtgatgtgatcgatgcggcagttgactgctgctttggctagtggtggtgtaggggaaagcacgcacgtcccgggtatttatagatgatgagaggtgttgcagaaggcagaccatttcatgtactcctttagtaccaaaagaaattggtttctatagctcagactttatcatagtagtactagtgctacgactgtgttcttcttgataaaatttgttgcataacattataagtattgtaattggttaagagacatcgcaaatacgtgacattgctgataggcaccacaagatttatataagggaaattttgctacaggacactccttatatgtggttttagccctagagccctgcccaaactcacttttgggggaaaacactccataaacgtggtaatttgccagtggacaccacgccgattaaaataataattttcggttgaagaggagagtgaaatcgcgtgaaatatcaaaaatgcccttgggcctacatgtcatctctatcttctatctctcttctcctcttcttgcccacatttcgctctccaagccggccttcggccatgcccgcgcagggggaggagctgcgcacgagcggcgggcggcagcgggggaggagctgcgcgcatcctgctcctcctcgaactcgtcaccatcgtcgtcgtcgtccgccactgccccgctctgcaccgccggatccgcgaaccacctcctcgccggcctgcgtgctgtgccagccaccgccccgctccgcgccgccggtgaagacgggcgacagccgacggagatgagctggatgcggcgggcacgggtggtggcgggcgggggacgagctacgcacgtcctcttcctcctcgaactcgtcaccatcgtcgtcggcagcagtgtcgtgattcggcgattgggatgagagaaaggcggcggcggtggcgatgagtggctcggcgttggcgctggagatgcggtgcgggagctacgacttgctcgcgtcggccggcggcgggaggaagggtgggggcagagggtgagggtggcgaggcagcggggagaaggagcggctgcagctgctccaccgcgcgctgcggctggtgggccgccagagggccggggtgctgctgctgctcgccgttgcctccgccgctgtctgcgcgtgcacggtcgacgaccggcggggagcgacatgtgggcaggaagaggagaagagagataggagatagagctgacatgtgggcccaagggcatttttgacatttcacgcaatttctctttcctcttcaatcggaaattattattttaatcggcgcggtgtccactggcaaattaccacgtttatggagtattttcccccaaaagtgagtttgggcagtgtcctagggctaaaaccacatataaggagtgtcctgtagcaaaatttgcctttatataattagcaatagcgacatccgagataatatgttaccatttccggtgaaaaagatgagagagaaatttcaaaaggacaaaaatacccccaacctcagtagcatgtaacccaggttcaaccaaacgcactcaccgttcaaccccatacctgaaattctcatccaaatctaaccctaggtggttggaggtggcgagcgaccggctctgggaatcgacggggggtggagctgtgaaattggtaggcgtcgacggcattggggatgatgtcgccgaggaagaagttagcagggaagaaagtggcttttttttacgagcattgaggttccattaaagccccacaattgattcccagatccgctcgcccaccgccgccaaagccaccgccaccggctgcctagggttaggtttggatggggatttcggttgtgagggtgaacgattagtgcgattgagtccggttgaacttgaacaagatccaataggccaggccggtttacatgctgttgaggccggaggcatttatgttcttttgaaatttctatcctatatatctttttcattggaaatgatacaatattgtctcgggtgcgctacaaccagttacacaaattttgtgatgtccattgatatatcccaaccaattagatgactttttggtatcatgtggtaaattttgccaagaagaacggtcgtagcactagtacttctatgataaagtcagaactctagatgagatggcagtgaaactactactactatggaaatctactattggtgacaaacaaagtcaacgagttgattattgtaaattattgaaaaataagatgttatgggtttgtactatgttaaacttccttgggtttgactaaatatatagaaaaaatataacatcttctacggcatacatcaaattagtttaattaaatttactattgaatatatttcataaaatattggttttatggttaaaatacagtgtattttataccaacttaatcaacttttaagaagtttcatttaggacaaactttcaactacttataatataggatatagcgtatatatagtttttgcatcgttatataaattcatggagtgctcgagacatcctgctagttgggttaattcatttttttttgtaaaatttgcaaaatactcctgcattgcactgggtaatggtaaggtggatgaggtttgacctcaatgatttatccaagcaccggagcaaaatcataaacatcgacggagtgtaattaccacaaaaggtatatttttgtttgaaacaatggctctacacgttcgggatgtgaacgatgatcttgatgtgtgtgcctgatgatttagcatgggagaaacagatgggtgaacgcctgaattaaatttcaaaatatactgttcattcatttttttctcaaaaatattcggtatgcaaaaaattttacaaaaatatatcgccggtctcgcacaaccattacacgaagatgatgtgggaatgacgtcagacggtatcgcgcactggaagcgcgcagcg

SEQ ID NO: 56386 - DNA, 2311 bp, Oryza sativa
aatgtgcgataccgtgccatgccgatttcattagcgattaattaattattgattaataattatttaatcattaatcaggataattaatcactaattattattagttaattgttaattgagtaattaatcactaatcaaaaggagctgtcagacagtgtcgctcgttgctttagcgagaccgttcggtctcgctattccgttacgcgataccgcccacgacgtcattcccacatcatttttgcgcaacagttgtgcgagaccgacggtatatttctgtaaaaaattttgcatcccgaatatttttgagaaaaaaatgaatgaacagtatattttaaaatttaattcgtgaacgactcggttctttgcgctgtagtcaattgatgaaaatttagactgaggtcattaaatatttttgcatcacacgttttcttttatgaaacttctactgccttagtttcataaaaattgaatttctacctttaaatctttgtcccataaaaattttatgtctactaatgtgggacctaacaaaacaaattgattacatcaaaatttgtttccttgtaatctcctttctttccatttcatctcttaacctcttgtctcaaccttatttttaatcaagtttatatataatgtgtgtgcgtgtactgtgttcattaaataattaaggttaatgtgatcatttgtttatctttataatttgtccttaatttcatagaaatttttttttatggaggtagtatagtgttttcaaaaatggatgacttttttttgcccgtgcattgtataatcacacaatacaatagtgcaacgttttctccagttagtttgcacacgtttgccacgttgagttggccggctgggccagatcagcacgagcagccggtcaagacttatctctctctttctcgctctctcatcgattcttgttcaatctctctcctagctcgtctctcgtcagtgtcaagagaaagaaagggagaaggtgaacgtacccgcatgataattaaacctaaatcgagaaggtgagtagccggtggctgcgggttcgccacctccttctcctcctcccgtcctccgcctcgaccctcccatctccactcaaggtctgtggaggcctacagcggaggacggctaacaaggcggagatagacaatgggcgaagagcggcgagcaggactgaggtcggtgactaacccatcttctgtggatctgggtataggcgacagtggagagagggtgcaattagtgacggcatggccacggaatcaaatggtcccttaaagcgggaccagacccccatcgatcaatcctaagcctgaaggaggtcaagatggagtcgtatatcccatgggcatgttcgactgccattcctacgacagtgctacggctgcagcgcttgtgttgtgcagctgcagctagccttcgtgcagctgtaaaaaatgccagtcgaacagaccctgacggagcgtggggctcctcaccgggagaccgcgcaggcccccctttgccggttcggccgggggctcagggagagattctaagctctctgtatgtggaaggctcgcgagacaggaaacacacaagacacgggcgatgtatacaggttcgggccgctgagaagcgtaataccctactcctgtgtttttgggagatctgtgtataaaggagctacaaagtatgagccagcctctcccttgttctgggtttctaatctggaaaagtcccctccccttctcagtgggcaaggtcctccttttttatatcttaaggggataccacatgcaccatctctctctttttctgtggggacttaccctaccttttcataaatggacggagatttgtatagttgccgtccgagtcaccttctgatgagacgggccacaactacctccactttcgccgggagcaggtgcgacgtggaatcgtggctgtctgctgacgacatgaccggtgtcagaccagttacgtcggtcattcttgtcccccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgtgtcagatcgcctgtcgccacctaacccgcgatctgaccggtctgtgactggtcacagaccggataaacaagtgcactgcactgcgttacatgcggcgtgacacgctcaaccaaaccgcaataaatgtggt

SEQ ID NO: 56387 - DNA, 1707 bp, Oryza sativa
ctcccccatctcctccccaagggggcggggcggcgcgtgccagcagtaggcgcccggagggggccgcgccaacatcgcagcccgagggggagcgcaagaagaagcggccccgcaagatgggggagacagaaccatctcggggaaacctcatttcccctccaaagtggtcgtttaaccgaccccctcgcaggttcgtctctcacccatcgtgactgtattctcttaacgcgagttttcactcacccatcttgttcgtcttctggttttttcttttgtttcagcgagatcccgtcgcgtccctcccgccattccaagtccggccagtctgaggccgaggatccggcggccgcagaggccctcaggtgggaatctgaccggcgagaggccgcgggtcgcctacgggaagccgaggaggccgcccaggaggccgcccgggcccaccaggccgaggaaaccgctcgggaggaggccgcccgggcccgccaggccggggaagccgctcgggaggaggccgcccgggcccgccaggccggggaagccgctcgggaggaggtcggatttcgccaggacgaggcgatggcgacttccgaggcagctcgcgacgaggccgcgggcgcgtcgcttgggcccactccctcaggcgacactcaggcgacaacttccggggcagctggcgtcgaggccgcgggcgcgtcgcttgggcctactccctcgggcgacgctcaggaccaaccgggtccgggggacatccccgagtccggcacttccatcggcggcccgagccgcgtggcatcctctccaaggcggctcttccccacgccttctatcgccctactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcgatggaggccatggtggaggtgggccgtaaggctcaccgccggcacgtctcggagcttgaaacccgtaagaaggtgctggcggagattgccaaggaagtggaggaggagcggggggctgcccttattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcgaggccgccgtcaccatccgggaagcaacgctggtggcgcacgaggctgcctgcgccgaagaagagttcacgctccgcctccgcgaggacgcgctcaccaaacgggagcgagctctcgagggggccgaggccacggcgcaacagctggcggtcaacctgtccctccgcgaggcagcgcaggaggagcaggcgcgctgcaatctggaaggtgcccgcgccgagagggccgtactgaaccaacgggccgctgagctcgaggcgcgggcgaaggagctggacgcgagggcgcgcagcggcagggcggccacgggcgaaagcgacttagccgcccgcctcgcagctgccgaacgcaccatcgccgatctg

SEQ ID NO: 56388 - DNA, 3142 bp, Oryza sativa
ccgggaacgtggtgaccgagggttatgggtgacccgattgtgggtttttgccgattccccccccggagttcaccacgcctcgggggcggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagaaataagaatatgcatatgttgtagcccccggccaaccctgcacgcccgaggggggtgcggggttggcccgagcccgaaacctgacacccgacccccgcctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgatgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagatgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctgcggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccgtctcccctaaggggtcgggtcgcgccgacggctgggcaagcctttcttcaaaggcgcccggtgggatctgggctcgcgaggacgcgagccgtgagagttcgtcggcaatcatgttatcccgtctaggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagctggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactacagtgacccgatgcgcctggaaataatggcgcagtttcctcgaggccatcagaatagcgtaaagcatcttctgggcctgagggtatcgggttttggcgtcccggagggcctcattaacaaagtagacgggccgctgcacctttcggtggggccgatcctctttgctaggggccgcatccctggggcactcttcgtccaagcagcctcgcggggcgcacttgtcttctgtgctgatgacctctgggtcggaggataacagggacggccttcccacagtggcttcggggccgtcctgggggtcgggggctcctggcgtcgtcggaaaagcgggcaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcctggggtcgggggctcctagcaccgtctgacaagcgggcagagggccaactccggtcgtcgggggccttgggccaccgttcggctcgggagcctctcctccctgctctctcccgggccaagtcggcacagggtggggaagcgtgaaatgagagttgttctcatcgcgctccacaaccaatgccgcactaactacttgcggggtcgccgctaagtagagtaacaagggctcgtctggctccggggcgaccagaactggggagagcttagatacgccttcaactgggtgagggcattttc

SEQ ID NO: 56389 - DNA, 1012 bp, Oryza sativa
aaaaaacccacgaggggtcggggtgcctcggccctcggggccgaggggggtccggcccgaccccctcggggggactaagaggagggcgaacgcatcaccctcgggcccgacgtccctcggggccacgtgtgcgattgtgtctgcctcaaacctctagtcatgatactcctgatcccatgtcaccgacagaccccatgtccgatagtcgatttatttgtgttgcaataacatctatttctttgttgattttattgggggtggattagagttctccctatgctgattttatttggatggatttgagtccgatttgactaattgaagttccccctcttccagtggcgtgttcgagttggcagtttggaatttggagatgaccaagatacgagctcgatcaggaggtgattcggtggaatacatgcaacgaaccaagatggacgataggatatgcgcgctacagcaatgaattaggcaaacgtcggacaaaaacgtattgtgacgatcgtagaattatgaatttttaaaaaattttaagtaggttagattagagtagatttacatcttttaaagagcctttatcctggtaagagtaggactcgcatttaatgcagctacattttttcatccattttagctggattccatgtcgacacggtctatgcccaacttatgactgattctgggcctaaaacaggtgtataataccgccccgtaattttttccatttgggctgaaaatgtgcgtttggatgggctgtgatcggattacaatccgtcggaaaaggcccattactaccagggaaaaaaactgcccaggagtctcgccttgccctctcgccgtccgtgccgccgccgccgccgcctgcatctccccttcctaatctgtgacgacggccggagacaccgtacgttctggctggctgcagaggagagatcagaggagagggatatggtccaaggcgacaacagcaacaacatcaattgccactggggacatatcctctcgtctctcg

SEQ ID NO: 56390 - DNA, 1274 bp, Oryza sativa
tactaaattactttggtcttgtacttgcagaaaaaatgcatttaggacgatgctgtttgaaaccccttcgggatttgtaatgttccgtgtttcagatgttttgtttagatatcctgaggtatgtataacttttcattcaccctagtgtgatgcataattcatttttcttctgttacatttaggccctacaccttatctgattttcctttccttttgtaggacatatggtcgagttttactgatccacgtaccgcacaccaggtacattttaactcctaaatttcctttcatgctttttgtttgtttatatctatttatcgatttattgttttttgcacctttactatctatgtacatcctaaccattactgttttatttttttttgcacctttactgtaaaagtacatcctaagccaactaattattgctttattattttttgcatcttaactgtacatgtaaatcctaagcctttaaatgtgtttcatacaattctatttgtatgtcatttgttctcttggttttattaagatctaagcctttaaatgcatctatttgtaggctgttcgtaccattggttttattgaggttggtaacaaatctcttgtatgggataaggatattggtcctggcgaggatttagaacaatttatcctaaaattcccaattacaaaatcattggttgttccaaacgcacagcttaaattcgttattgagaaaaaacttggaagtttacatctaccctaatgtattttaatgttgatgtttatttaatttttttgttagtgtggaattattaatgtttccctgttatatatttcttttttcagaacattggctgttggtttaatgggcgtattgttcctgagttgatttggggactaaattatgccctggatgaatttgtgcctcaagagaagggcaacctatcaaatgaatgccattttccactgagcaagcaattgcatgagcagttaaaagcatatggatttagtatctcaccacaattagtatgttttctcctttgctaatattgttattattctctgctgaccatccttttattgttttcttccttggtctgttgtgttaccttatttatttatttattgttttgtgttaccttatccttttattgtttaatcccttaaaatatttgctactgtactatctgttgggttaccttacccattattgtttaatcccttgcatatttcttgctattgttgtgttgccttattattttatccttttcattttagattaacagaga

SEQ ID NO: 56391 - DNA, 793 bp, Oryza sativa
aagaacccgcaattttcttggcggccaaaaaaaacagccgccaagttcatatatattattggcggttctaaccagctaccaagcatatacatgtttttttggcggctatgcacaaccaccgtcatgtttttgaccgacatgaaaattacggattcttatagagcaacaatatatatgtggcaaaaatgtgcaatggtagcagcagcttacataggtgttgagctgcctgacgaagctggagaagttgttgtgcttgaagtagttggggaggaggtcgcgggcgaactccggcggccgccacacgacgaaggtggtgtcgtcctcgccccacgacacgatgtggtcggtgcaggggtcgtccaccagctggtacgtcttcgtcaggaacggcgccggcaccggcttccccgccgccgcgccgccgccgccgtgcggccccatctccatcgacaccaccatctccccgcacctctccaccaagaaagccatagctagaagaggaggaagaagaaggggagaggagaaaggctgcagtgtctcactgtctcgcactcacacagagagtgagacagagagagacgcacacgcacacaccacgaaccccgcgcttcaaatattctcgtgtgggctcacgtactctctctcagctcagctgcctggacctctctctcatgagctctagggggagtgtagtagagaagagagtggtggtggtgtgtgtctgttgcatctctctctctctctctctcatgattatagatgcatgtgcatggaaatctgtgcaaggagcagt

SEQ ID NO: 56392 - DNA, 1031 bp, Oryza sativa
agggttcttctggcactgggataccttgtagctttcaactgaaccattgattggtgactttaattgagcttatctctgacactgaccatccgctgccaggacggaagagaggtggaagagaggggttgctaaagataaggtcttaaaccgattgcctactgatctgttgtgagtagacttttattgttcaagttgcttaagcaaacaacctagtatggtcgcatccccaccaatgatgcaaaccatacccctacacacaagcaaacaacacacgacctagcagctaacgaaactactcttccaggaaggattgggtttaggtaaactccgggaaaactccacttgatcttcgcagaacgacgactctgaactgatcttctcgctccttgcacgaagcttgaggcttgacttgacttccgaacagacacgaagctgacggtttatcctccacggtttaacaactataagaattggagggacagggaggagaattttgaaaaaccgtttcgcaaagaaaagccgaagggcgaggggagacatttttcaaatagggttttcagaaagcttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcgaacgtgcaaggggatacaaggaggggtttgtggctatttgcataaaggggtt

SEQ ID NO: 56393 - DNA, 4402 bp, Oryza sativa
cggtgaatctggtcgaccgcccataaccgcgggcacggctattcaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgactagcaaaaccatgcacccacagcccaccattcagttgcattttagttggataattacgaccatgaagcatggccaggtgtctcgagcacgcagctcactctgatactaaaaaggtctaatactgcaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgacttgccttgcttcttcactttgatcttccgaactcttttcctcgcgaccgcggacttccgaaacgacggaaactacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatggattttagaagttttgagccattttaatgaatttctagaattaaactcgatttattgcgcaattattatttatttttacaaaggaaaaggccgtgctgacgtcatcaaaggggaggccggcgccgacacgcgggccccgcacgtcagcggtacaaaggggcggcgcatggtggaccaagtccacacgtggcctcgggtgcgcgtccaccacgtggacggcccagatcggcccgagccgatcggacggccacgaggcggcgcggctggggcacgggcgcggccgagactgacccggccggccatggcacggcggctacgcgcacgcggccagacgaccaccggcgacggcagcgcgtcgcggtggcgggcatggggagcggcggatggggaaaaaggagagggggcggtggggattctcaccgaggacggcgacggcgagacgaccacggggagatggccggcggcggaaaagatggcggcgaccggcacgggaggcgacgggaacggcgttccgacgacgcccgaccacggtggagccgcggccgagggccggcaagacctaaggaaaatattggagcggttagggagagaaataggcgaccggagcggtgaggagcggtggtttgagacgacaacggcggtagcggagctcgggtcgacggcggaaaggtggttgcggcgatgaaatggggaaacggagcagaggccgaggtagagcttggcacagcgttgccgccgacgcaaacgacgaggtgcggcgacgactaacgcggcagcagcggccggctgaagacggcggcggtgggggagagaggtggtgcacgaggcggcggtgttccagaggcggagaggggaaatggggtagaggccgggctgcggcacggcgccgcgaagccgacagtggtggcggattggcgcggcggtgggtggagcggcggaatcggccggccggagctcgccggaaagcggtggtgcacgggagcacggtggggaggtgtctagggagcgcggggtgctcggggagaggggaaaacggatgaagggaggcacgtgagtcgtttatataggtcccggagggggagaacgtggccgggagaggcggatttgaagggggaagaggcgccggcgacgtgggcgagtggggtggttcggcgccggttatggagggggaaagtgggggaggagagcggggtcgtgggcggcgaggtcccacggacgagcgcgcgcgcgtggggtggaggaggtgggcggaaactgcggcgtcgtggggcggctcgggcggccatggtggttgcagccggccagccagaggaaggaggaggagctgacaggtggggccgcgggtcccacctgtcggccaaagaggagagggaggccggctggggaggcaaagtagacttcggagaggagagggccgagcggcgagctgggccgagggagagagagcccgagagggggagggggaggaatttgggccgagcccgaaagcaaggaaggggaaaattattttcttttctttttattttaattgattaatgaactttgtattattaaaattatttattgagctccgaaaattcacgggaaattttcggagagtatattagggcacaaagaatattacaaaatattcccggccaatgatttttaagggaaaattttaattctcccattatttcacttgattaaattgctttaacttttatttaatttctagaaaatgcattatttaatgatttttaatcccgaacgaaaatcggggcgttacacgttgcttgatgggtttggcgtcttccttaacatgtaaagagtgctcaatcacctctctaggaataccaggcatatccgatggtttccatgcaaagatatctttattattttgaagaaaggtgatgagcgcgctttcctatttacaatctaactcagcgcctattacagcagtcttattaggatcagagggatctaagggaatcttttttgtcttagcatcactttcttcggtcttcgtcagcttggttgcaggcacttctccttcgcttgccgtggtcacagccagtcggatctcttctcgagcgagtgtgatctcgcgggtttgggccatctcgcaactttctttgtcacatgtgacggcctgcttgacgtcgctccatagtgatatgactcctcgaggaccaggcatcttcatcatcatgtaggtgtagtgtgggacagccatgaatttggctagagccggtcgtccgagtatagcatggtacgctgtctcgaaatcagcgacttcgaaacaaacgttttctgtgcgaaaattctcccgagtgccgaaggtaactggaagagtgatctggccgagtggtgtagctgataatcctgggatgacaccgtggaagggtgcattactcggctttaattccgtgcgaggaatctgcatatcgtccaaggtcttagcgaaaaggatgttgagtgcgctaccaccatcgatgagagttcttcggagcttgacattgcgaaccactgggtctagtaccagggggtaccgccccgggtggaccactcggtcgggatgatctgagcggtcgaacttgattgctacctctgaccaccgaagatattggggcgtgttaggttgaaccgcattgatctcccgttctgttagcttctgctttctcttagattcataagccagaggtctgccgaagatgtgattgagttctttgcgatggtcttgaaaaccagtcggggcatcgtcctcatcgtctttcttctttgatgtgccttgatctccgtctgaaggcttacgtgcggcttgcatattgctccgcaaattgcttgtagacgaagcagtctttggccacgtggttggagttgggatgatgcggacattgcgagttcattatcttgtcgaaggtgttgacgcgggaacgttgtcgggaagatggagaggttgttgccacaagttcttcgggcttacgcttgcgatccttgtggttgttacttccactccctcctgtagtcggcgtgtccttctttggcttccaagtggtgcccgactgcttggatgcggtaatagcatcttcggctttggcatactcgttggctttttcgaacatttgcttaaccgtcctgggaggtttacgtccgaacttgccgactaggtcatcgtggcgaatgcctttggtaaaggcagcgatgatgacatcgtcggtgatgtcggagatcttattgcgttgctcggagaagcgtcggatgtagtctcgaagggattctccaggtttttgaacgatgttgtagagatcaaactgtgtgccggggcgttcaaaggtgccctggaagttggcgatgaagtgatcacgaagttccgcccatgatccaa

SEQ ID NO: 56394 - DNA, 1603 bp, Oryza sativa
gtgattgctgcaaccgcgttctgctggggggtgcgaaaaaccgttgttccatcgatgtcctgttgcccaatgaggtctctcgctcgtcgcccggattccaaggcgcgctgtcgtcgatcttcagcctcctttgcaactcgctcgcgatcttgttgctcacgctgtagtcgttctcgctcttgtcgttgtcgttcttcctccagtcggcgacgttcagtctcttggcatgtgcgctcttggtccgcttctcgggcttggcgctgttcctccgtttcgttgtcagccatgaatacgccgaagaagaggggcatgtagttatcctcatagctatcgtcgaagttgtcgaggtcgccgtggtcatagtggtagccaaaatcgtcgtagtggaggatctcggttggtcgagaactgacgccgggggagctgaggtagccatccaactcttccgtcgagactgtcccgagaggttggagtataacgccaacctccctggatctagatcggatcggggccgaagccggagctcgcctagatcttcgagtgggagatgtcttgactgtgaagacagcggccaaatcatcaggaagtttcatcagtattgagggataggacccgtcgtcttgatctggtcgcggaagagtagattggatctcatccgagtggtttgaagccgactcgggagagatgatcttagagtaggtcttggccgagttcggaataccgaatggcacttggacctggtctctccccgactggtttgaatccgagtcaaggagagagatcttgccgaagtcattggtgatgaagttgaggctgccgaaccggaacgcctgcccgggaggaaaggcgaagtcgtcgatgccagaaacgaaacccatcgcacttagtcggcgagaacttgacgctacccctacctggcgcgccaactgtcgaaacaagatttcggcaataataaaagggggtggctatcaagctaggaaagtggatgggtttggagacaaggaattttatacaggttcaggccttcttattcaagaagtaataccgtactcctgtccggggatgattccgccgagtgtgttattgattgtataaactggaaaaaagaatcatcccgagaggaacccggacccctccttatataggggaagggatccgtattacagaatacagtccatatcctaacggaatatggaattacagataaaatacaattgtaaccgactaggatcccgggtattttcttgacatacaagtttagaatctaacccgagtcctcataaagatattctatctatatttggtaccgtatatccagctggaatataaccgccatgtagatatggggtaatcataatctccacaatgttgatataaagtttgtctccatctgatttcgtatgaaaaagttatgtgtatatacgtgttttttctaaaatttgctcaatgtctgcggatatctgaaaaaaattccggatagtttctgaccgttttccgattttgacggatagtacccttactgtattcattttcgtttccgagaaaaaatatccgaattcgtttccgaatccgagaatttccggatagttccgaccgaaactat

SEQ ID NO: 56395 - DNA, 2023 bp, Oryza sativa
tgcatgtatgcaatttaaattttctggtctactgatgccgtagcgagcgataaactactactataagtctataacaaattcgaggataatggaggctagcttctgcactctaaacatgcatgttgtagtttgatctgtagaatttggtatagggtgcatcttgtaatcttggactgatctgatcactttttattgggacaaaatatactatatagaaaagttttacctagctgcgtatgaatcagctgtagcgcccgtaggtgtagcataattttacaccatactctctccgttacataaaaagcaaacagaatgtgatattctagtacaacaaatctgaacaagatatatcatattctattctatgttttctataggacagagcgagaactctgtgtacccttttttctgttgtaggcaggtccagcaatgtatcagtacggcatgtctcaacaagaaaagtgaagtcagggatgacataaacaggggaactgtttagctatagtcactagtgacatgaaatactctgaaatcttatagcgccattgtttcgcttattcatatgtttactggaatcacttactggcaaataaaaaatcatctgtgggaaaagcttttatacacatatacttagtgactcaaaagcaattgctataaaataaagtacgatgaaaaaaacaaattcaaaattaagttctaaaattcaaattctggcttataagcatcagcataattaagccaaacaatgagtaaaacttttgtttgcaataacgtgatgttaataagaatttatagaagtattcaaattctctgaaatcttagcaccttttcaaacaaacacaacagctccttcctagccttgaagtgcggataccacagtagtggtataaacatatccttgatgtgcggacatccttggtacacggccgagatatacttttttttctccaaaaaaacaaaatctttacttaacacgggcggtcgatcggtctgtgctcgatcaactacagaaataccaacatgtaattgttatctggaattaagcttcagatttaacaacttggagttcttgacgtgcaaaacagtttgctcttttcatctccatctccccatcttttaaaaaaaaaattgagaactccatctccccatgttacctacgtttttgggccgggcagaatttatgagaagttgcatcagtgctgagatagacttcagagagctcccccaaaattaatctgctgatacactgagacccatttgactctcatggcgacagctagttatcctaattaatcaatcccggaattattgtccggaatgtgcttaacatccaccccagcagagtaaacaaatcaatggcggctaaaacaaaagcttatccttccaatctgctcgcagggtgttcgagcttgaaatcaagcccatactccctcatgcagagtcatgcagtgagacaatataatacacatgctcacatgcgacgccggattaataatttttcgatcgttaattattttctccttaattcctagctccaaagtcagcgagcctcgcatgctagctgagctgttcttgcatgtgttcttcccgcgctgtccgcgcagacaaaaaccctgcaaatttcttccggattccgaccactagtctgtcactagctagctctctgtccatctgatcgattcggatttgtgctataaatggacgtgcaatggagagcttagccattcagacaacggtagtggagtgtgtgagtagctgaggaggtcgaccatggcggcggctagggttgcgatgtgggtggcgtgcgtgttggcaatggcggcggcgtgccaggggcggcttagggttgggtactacaagcggaagtgcgcgccggcggagtacgtcgtcagggccgtcgtcggcaacgccgtccgccagaaccccggcgtcggcgccggcatcgtccgcatgttcttccacgactgcttcgtccaggtacacagatcgatccgtacgtccatggcgatccagggctgcagga

SEQ ID NO: 56396 - DNA, 3337 bp, Oryza sativa
  unsure (1)..(3337): unsure at all n locations
gtggcgcaggacgcggtgacgccggacaggatggacaggcagtactaccggaacgtgctcgacaggaaggtgctgttcgactccgacgccgcgctgctggcgtcgcggccgacggcggcgatggtggcgcggaacgcggcggcgcgcgggaggtgggagaggaggttcgcgagggcgatggtgaagatgggcgggatcgaggtcaagaccgccgccaatggcgagatcaggaggatgtgcagggttgtcaacgagtaactgttaatttcagaggaggatgcatctagctacgtacgtgccattttgatttgttttcttcagaattcagaagcatgaattgtcacatttcaatattatttcgttgcttgattcgagatgatctggggcaaatgttgtatttgcacctgacggaattaattgtacgctccattagagatatgatcgaataaagtttttcagtttttagccagcctctccattctttctccagttgtgacaacaagtgtacttgtctggtcactagctagtgtataatctggcgaattagcaagggaaaaaaaaaatctgacaagcacaagctgtaaatttgactagtcgagcaacgagggcttgaacccgaaatgggcccaggacagtggagaagaccagcccataacttggcccattgcgctacggttgatgcggcccatttcgctccgggagggcctaggaatgaatctgcttccttctcggaatttcggcccagtcgcacgctctccccgtaaagcccgtacttcttctctctttttggcactctcgtctaatttttacatgaaaatggtcacacgaattaacagaactgctgcagagtctgccgataagtagatgttgnttattcatatacattattccttttgcccacgagtngtncaatacagatgagtatattaattatcaaaacgttcgccctttgcttctgcttaaggaaaatatatcacaatatttccagaataaataaaacacctccttcctgaaatatatttctcacattttcttaatagagaatactcactttagtttaattttatatgtagctaatcatttagatttagctgttatacaatgtaataggtaaaaactataatgagaatagtggggtgacagatctagagatttttaaaggagtatagatatgagtatgactgcacgtccagataaagataattgaacctttggaaattcatggtgtttattcgtgtgatcatgggttacatcctgcttcgatgcaggatagacccctgtagcaagtttttcagctggcgcctgaggattttgcctgaaggagaccttggaatggagtcaacgaacaccactttcctgatcttcttgtatggcgccacctatatacatcatgaattcatccatgctcgatttatcagaactattcaaacggttaatgcagcgcagcaaggcaatctaatctgcattttagctctgtcactaattgaataatgatctccctatacgtatatatgtaccttgttctgtacaaaggaaatgacttcatcttcctgaagatggccgctgccttgtttcttgaccacatatgccatcgggatctcgccggcctccttgtcgggatacctgcaatgctacacttaattagccatacatatatatgcagagttggagagtgtgagctgtaaattatttgtttcacgttttaactctttatacacattttgtcgaaaactttcttctcctgtattagtactagaccacatgttttaagctatatttaataagactattttcttaaagtatttaatttatctctaaatccgctcaatagtctaaatcaaacagaacagtgtactgacggcgcgacggctgcgtcgtggatgtcagggtgggtggccaagacgtcctccagctcggccggagccacctggtaggcgttgcacttgatcagctccttcaccctgtctaccacgtacaccagcccacgcgagtccacgtagcacaggtcaccggtccgcagccaccgctcgccgccgccggagacggagacagagccggcggcggcgaccagggccagggcggtcgcctcctcgttgttcaggtagcctcgcatggtggaggggcctcggacccagagctcgccggtgcggcggggcgggaggagctcgccggagtccgggtccacgatcttggcctccacatccggcatgagccgcccaatcgagacgccaccgccgccgccgccgccgccggtgcttctctccttcacctccgtcgtcgtcgctgcaacagcgacgaacgtcatatccgtcgatgacggtggcatttccaccttgtcgatgccgttgtcgttgtgctgcagatcgcacatggtgacaatgcccgtcgtctccgttagcccgtagcactgcacatatgcatgtacaatatatgaaaatatttatgtcatgcttaaataacatttgatgatgaatcaagtcacaataaaataaatgataattatataatttttttaaataagacgaattgtcaaacgttgaataaaaagtcaacggtgtcatacattaaaatatagaattagtatattattatgtaatatctttggataaaaaattatacaataaccaaactctatataatttctatgtttttaaaagtaagtatcttagaattattattagccaaacttttaaatagtgtacaaacgttatgggcatgtttggtagtgccaaatcttgggcaagatttggtactaccaaaattttggtagggtagagttgaaaatgtttatttggattgaagccaaaattttctcataagagataagtttataggcaaagccaaatttatggcattggtagagttttagtagaggtgtttggtttgctacctaccaaaattttggtagggcaaattttagtagggtagcaaattttggtagggtagcaatctaaattggccctataaaacattataggagggagtatttataaccggatggaatgcatgtgtcgtcattgttgatttaacgtacaccagagatatatcaaggacatgaaaaactgtgaagacaatgcgctaattactctattttcccctgaagagcacatgggatgtgtacaccagtgccgcccaattaataatctattaattttgagtggtatttagttaacatgatgtcacgttcgtcatctgaaaatacgtctaacattgggtaaggaatgaacagtacggtgacatcaagcagtaatggtaaggactgaacagtacggtgacattgggtgaatatcagccatccatttcgagatggacggctctagacctaggtactacagcg

SEQ ID NO: 56397 - DNA, 726 bp, Oryza sativa
agcgaaaagaacaattgaagacaagtgatggaaaaaatatttcagcagtctaatattgtctttctattttaacctgaagtagaaatgtaagccttgaatctctgtagggaacatgccggtttttcccattcgcaacatccaccagtgtcattataacaagcctgaaatggtacagcaactcatgcttcttacactacaatattttcattatacaaaagcattcattcctagcactcaaatatatgtacatcctggtatagtaaagaacattacagtacaggctagtagacataataaacttccatgaagccaattgcacttcactttgaataaggaaaccaatagaacacatattcatggtttttttttcacttagccataaatgtagcaggcttcataaaatggaaaacataacaaaagttatccactttaacatggacaaagtgagctatttggtggtctcattttaaacaccatcttcatgggtgttctagtatgagactctagtcagacttgctaaatgatagtgttttgaaaactgacatgggtgttctagtatgagaatctagttagacttgctaaatgatagcattttgaaaactgattggtatgcaaacacggttaatttccttcaatatgtataaaaaaggattgctccaaaacgtccagcaaatggaatgttgtgtcttgcgttttcgagaaaaaaaatggagtgctgtttgagag

SEQ ID NO: 56398 - DNA, 1519 bp, Oryza sativa
aaccataattatttttgtcactaagattcaaaccctgacgaatgaagctgtacgtgcccgattccacgccgcatgaatggtgcttcacataaactgataaattcaagttgcgttttgtttgtttccagagaaaagaaataatcaaatgccactgtcagccacgtattgttttgttcttaattagcaaagcgtgtaaaacacatcccccgctaactaaatgccatcgaaatttctgttcatgtgtttgactgccgtatagtccatgagctttaatctagttattcgatttatcagataggcaagtggtttaaaagacatagttattcaatggtgagtcgaccgaaactaaactcgatttatcatgacataatagacacggttgccacttgccacagaaagaataagagcgctgctacacgtacttaaaagtgaaatacttgcaaaatccttacaaacaataatctgaactgtttgatttaactagacgagagttacagaaaatctatatatactcacagtttgataagagtttagtagaaagaatttcatatttatagcctttttccagaagaaatgatcaaatcaagaagtgaaaccggccggagaaagtctacaccggcaggcccggctcatgcagcccacgttaggaagcctggctgcactgggtggcccaacggtggggtgggccacctcgggccagccgcagcagaatgcatgggccggcccataaatgggccactccaaagcagaccggcgctcagaggtccatcctgatgaatgaacattcatgcaggtgaccggcccaaaataattacagaaacccaaaaattacagaaaaactacgggttgttcatgttataccatttcagaacataccatttttttaaagttgataaatatacgtatccattaagttttttactaataaatacgtaagaaatcctgtcaaaacttggcaatattgctaaattgttgccaaaactttataaggtttattttagctacaatctaaacagaccttatgtatttgctaaaaacttaaaaaaaagtgcagaaaattaggaatttgctcaaaaatatggtaacagtttggaccattagataagcttaatgatttattctagcgagagattcttgctggatgtatgcatgtaaatatattgtaattacaccgtaattatgctatagttatatttgaaatatttttatcttaaagaactgatatgttatatagctacttccgaaaactagcacggaaatgcttttttgaaaaaagaaacatatgttctcctttctgtgtgaataaagcacgagcagttccagttgtatatatatgcgtccaaatatactgtcccgtggtttattcatccaaacgacaaatccttttttctaaaaaaaaattccaacgcattactttcttcccttttctctagcgaaaaaaagaaagcaccgaccaaagtggctcaaaaatggacgcgtccaaagatcgcgctgccacatgacaacggacttcgatgaa

SEQ ID NO: 56399 - DNA, 2238 bp, Oryza sativa
  unsure (1)..(2238): unsure at all n locations
gtacggcaaaaagctggccaccacggtgtacgagaaggtcgccggcgtcgggacggccgtggccggcaaggtgcggcaggtgacgcagtcggccggcaccgccacaccaggcgtcgccggcggcgccgccggctcacagtcgcaggacgacgtngacgcctccaccaccctcgcctccggcgagccggcgaccggggggcagcagcagcaggacaagggggtaacagtcaccggctacatcgccgacaagctccgcccgggcgacgaggaccgcgcgctcagcgaggccatctccggcgcggtgcagcggcgcaaggacgacgtggcgcagcgcgttccggccgtggcgccggcggcgccgggcgacacgatcgccaaggtgcgggaggcgcccgcgcaggtgctcgccaaggcgcgcgacgccgtcacgtcgctcaccggcggcacccatgtctccgacaccgtgcagcccaccaccaccacaggtacataaacacaaacatctcaaatttcacttgccattttcgcagccggatcatgagctgatgatcgagttcgttttttttttctctttttcgtgtgatttttttttgcagaggcggatggcgcggaggtggaatcggcgccggtgattcgcggggaggagatcggcgagacccaacgtcagccgaacgtaagcatgacatgaagcgttgtagaaatggatcctctcgtgtgtgtctgtatgttgccacgtatacacgtgtaagtgtaagaaaagtgtcagtgtgcttggaataataagccgttatgtacggcttttgtgtcgatgtgcagtttttgttttttgatgtcttctgtgtgtatgtaagcaagcccgttttgaaaatggccaagttcagttgaaacttgtaatggtttgtggacttgtgatacacactgtttgtttcaactaattgctagtacaaaagtgttcaccgttttcttcctgatcactgatgaaagttcttcagaaaacacactgggaaatttccaatctttgcagctagctatttttcacctgctgagtggcgcccagaagttcattgacgttaatgtccccttttgcttctcttccgagcgattcagaccggtcatctccatgcattgtgtgtgaaagaaactgtgaacagctaatcaaaatcaaggtgcacgccgaaattgccaaatgtaacagatgactacttactccctccgtttcatgagataaatcattctagcactttccacattcatcaagttattatagcccttcttatatttatcacccctccgtttcaccgtgtaaattattttagcacttttcatatttatattgatgaatgtagaaaatgatagaatgacttacattgtgaaacgcaggaagtagcttacaagtgccatgaatatttcgaggtgcgagtgcgacaacgatatcgtgttagatcaccggacgattgagtaattgactaccaacatctccggttcttcctgctgatgcatggcctgaatatgaagcaggaatgatttggatttggacgtttggtccaaagtggcaggacgaagctagagccgtgtgcctgtatgggagtcgagacacttgggtggttgactgtctgaccccatgattttggaaacaaccttctttactgcgtctctttacaataaataatcctacaagtgaattttaacatccgatacataattccagatcgatattgaagtcctataattagtttcataaaaccatattgttaactatcttgcgagacccaatttttcctcttcttttttgggactttgagttactactatagcaaatagcacagataataaatgaaatgcttaccttgttactgtggccaaaataataataaaatgattatcttaagtggctaaggcttacaatgaattgaaagaattcataaatttaatttaactttagagcttatggtggatgaaaaaaagaattagtcgatgacgtggttttatgaaactttagaatcataataatactatgtttattgttacgtgtcaacttttatttatgtaaagagttatagtactaggctaatttatttcctcaccattttcaacttctacctttcgtttttccacgcgcatatgctttttgaactgctaaactgtgtcttttttttctttgcaaagttttaggtattccaatataggtactttaaggaggttcgctagtactcagaaacccaggaggccaggcagtga

SEQ ID NO: 56400 - DNA, 2777 bp, Oryza sativa
gtgctccattcacaaacttgatagatggtctcagccgtgctggcaacctacaagcttgcaagtatttcttctatgagatggtcaagaaagggtgtcaaccagatgttgtttgctacacagttatgatcacaggttatgtggcagctggggaattcgatgaagcccagaagttcttcgatgatatgttgctgagagggcagcttccgaatgtgtacacatacaattccatgatatgcggactttgcatagtaggagaatttgataaagcatgctctctgctgaaggacatggagtcgcgaggatgcactccaaactttacagtgtatagtactctagtgagtaggttgcgaaatgctgggaaggattctgaagctaacaatatcattcagtacatgacaaataagggtcattatcttcatttattgtcaaggttcaggagatatagaagatgctgatatgtgaggccccatagtcagttacattgtaattttgttgtattgtttccaacttggaaagatggatcataagggagtactttgtgaggtaaccattcgcactctaactgttactctagcacatagggttccttatctatttattcagtacagaaatgcaacactgtatacttaaactgttttacgcactaatggaatgggataggatggggtggcctggcgtgtcctaaatcctaaccgactcatgatggaggagttcaaccctgatttactagtcctaaatagtaaacccaacattagttctgttgcaatgtagtacacaatatttgatttacttccacttctggtctcctgaaccagattacatccaatcttttgttttcaatatactttttacagtgccaagaacttatgctcaacaaaatatggggcatatcattttgctaaattacaacagaacttaggcttttgattcggttggatgcaaagcacaccgtatttctctcaattctcatttctgtcaaccctagcataggtttagcttagtggattatatgtcatagatcagataagatccatataaacattgtgcattatcttgcagcactaagagatgaaaagcctatgcaatcttgtcccttaatgatgctctttaggtcattagcatctctcgtcacagattgcttttatcattatgcatttatgtaatgtatgattaaaaattctcagtgtcttaaaaagatagcaacaaattaacacaccgttaagactgcctccagtcacaaataagtgacatttttggcagcgacaaagtctccaaacacagccacaacttctaatatctattgtgatatattatacacacggtaaaatgctatataaaatagaaatatttaagcaaaatatacacacaccattttcgcatgtccagtttaagtatttatagagatagcgattgttaagctcttaatgtttggttgcatctaccctggctgaatcaccactgtcttttactggaggggatattaaatattgttaagtcagtttcaaccttggtatctctgactctggtcatccattattttttgttggaaaaaaatatttgaattaatcaatacgataggtacaggcctgcaaagattcatcaaattagcaatgttctctaagttcttttagttgccaaattgactttggcatcataaacataaagcattaaagttgatgatattgtcatatgtgaagacaaattgctgagttacatcgtgttgatgttatagagcaattgacaggttgtaattttttttttgtaactgtaagcaatattacttacgtgtaccaatatgttctttacagtattatggtacagagtaatttcacataaaacatcgatcaaaagtccaaggtattggctgtttcacttgcagatgggagagacactatgcaatggtgttatatatttcataattttatcatttcttctcttctttcttttcctctttcttctcctccttcttctcttccttcttctcttctttcttctcctctttcttttcttccttcttctcttcttttgcaggtccaacagacacaatgtcaatcttcccaatcttctttaacttctttgcaattgccactgtgtccatttcaccgatgatggtcatcttattgtccttcaaatctgcagctatggaatcgatacctgtacatgaaatgaggtgtgtaatgcattagattttcttgttgacacagtaatagtttatcttacaaaatacttctttgaagatccaatcttgcatcattacatgttcagctgataatacatgatgtggagcatccagttcttttgtctaacctttagaaactaatgtacagttgttcaccgcaaacagcacatattaataatcccatacataggggggaaatcattccgtatgcctaactatatcatcgatcgtcatcttcattgtgttatgtgatgtaacaaacaatttccaccttacatgatatctcttatcaaacctctgcctaaaaccatgctaatgcttccaaatgtgatttgcagatgttttttgaatcagagatcaaaacatatttttcaagtttcagcagccaaagaagaaaggggatggtacagaatgttaccgtagatgtctgcaacggcttcaatggctttctgcttaatcttgtcgtcggtcatggttggaaccctcagcaccaccttctgctgagaattatcatccgacgacacgaaggcgtgaaccgccgaaggaatcagggaattgaaccataaacaagagttgcacttgcttacctgagccatct

SEQ ID NO: 56401 - DNA, 1622 bp, Oryza sativa
gaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagccattccccagatctaccggcgcccgccagctggaggcctgcgctgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcggtgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttcccgcgcccacgcttccactaatcccattcgcccgcttgcggcgcatgaggtggatatgcggttgtggcagtcgagatagatcatatcgtgcgcgcgttaattacgcttgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccgcgagggacgtcgggcccgagggtgatgcgttcgccctcctcttagtccccccgaggggg

SEQ ID NO: 56402 - DNA, 726 bp, Oryza sativa
tcctgcagcccaccagttactgattagtactaatcttccttgctagtgctatgcacaccaagttactaattagtactaatcatccttgctgcaagagaatttcgcatgcttcttgtggtcgagttgtgctgttgtagtttcggtaaacgtcattcagatcaatcatttgtgatttgtatatttatatctatgaatagcagctgtatatgttgctagattctgacaaccattctcaagaggtggtttcctatgtattctcacaatcttatgatggttacgttggatgctgattgtgtagtactgtgagagtatgcaactggcatgttcttctattagaggttttgttcgtggaacggacatttatgtagaagtgtagcatttgatacaattttgcatttccgctgccttactttggcttaaaatatatctttaaggttctatatgattgaaatgtatacgccatgatagaatcttcatcgatttaattgtacaacaacaagttctaaatacacgaaggcttaactgtaaaatacatatggttgatttgttgtttatgagcagtaccatttgtaagtgctttacagggcttaatggtgttaagcctgagtaaacagaaaagtttatgtctgcattcatgtgaccatgttagtgaattacctagccagatgttttaggttttgtttactatagatgaaattatcccttgctcataactaaccaatatag

SEQ ID NO: 56403 - DNA, 1864 bp, Oryza sativa
agtttcagcaacttcatctcttgctgcacatacccaatgtcagaagtgcttccagcctggtcattggacatactagtgcaagaatgacggggtctacgtatcccggccctcaaggatgcagcagcataagagcaccaagctgaagaagcaagctatgccagttccctatcattttgaaaatcctgatctggaaaaagaaagggaggaaggaagctgatgaaagaaactttgaaggaaaaatcctgaaaaaagaagcaagagaaagagtaagagaaaacatcgttctcagagtgattcatacagaacggcaacggacactgagtcttaagaactagagaacacaatgaggatgccaaatatgatggtctacttctgttcacatatcatttcctttcattatgatcgcacttgcatttgtcatgcgtcctccatcaaacaaatgtacagttagtttgctgaacgttagctagtactgttgtttttcctgttctaagaagtgaccgaagctatagatcttactattcaatggtctttgtgagaaccagtagaatcctgtaataatattcatcaattaacttgaagtttagtatgcttatcttgctgaaagtatcatgtaataatttgagattggctcatcctcttggctttgtttcattctttcctgcagttcttgctgctattctggtcctcctggagatacatgaggtaccatttatttgctcagagaaatgacatcattggggagttaatggtagcctcgcattcccaggacgaaagatggtcggcgtgacagttggtttgtgtcctctgacaacctttcaggtaacacaacctctatcagtatggccagcaatgatatagccttggagttcgagagattatctttacagcaacattgtctgaaactgattgagaccaacttcaaatgaacagaaacctaatggacctggacctggacctgggcctgacttgcttggagtttgtacaatcagcatcagtgtgcatgcatccctgattgctttatcatctctggaaacctgaaatgatcaactacttacctaccttataatcttgttgttcagtgttcttcattctgcaacatgtttggaaactggaacgacaccagatcagagaagagcagagaggatccgagagctcaatgattgggagctcaaggaggagcatgggataggactggagcaatcaacgatcaagagatgactacactttgagctgcctctaccttgactggcctgggagctaaactagctggagccgatcgatcttgccggccggcatcccggctagcctgcctgtgggtgtggctgtggctgtacctgccggccttgccatcttgtccctcccagctccggcgacacgcctgaacctccattgacgacgacgaatcgtacgttgctgcatgcctgtgatgattggtttctctccttcatttctgaaggctccacttcagtttgaggccggccgggctcaagctaatttcgccgtacaccgtcaactcttcgttgcaacggctcgatcgtcggtcggaggcatcgacgatgggatgcatggccagatgtcctgcgcggcgcacatgaccggttgcaggcgccctgtccaccggtcggcttgacgagacggttgcagtgccggccaggctatcctgttgtttgttttgtttaccactagcttcacgttcaggcttcagagccggtcgtctaatcttgcttgctgatgatggttcaggccaagacgaggagaggacgtccgagctagaggaatctaccagttctgcttggatcttatgtccttggcttcttccatctccctggatcgacgactgactgcactgtgccaggtatgt

SEQ ID NO: 56404 - DNA, 874 bp, Oryza sativa
gcaaaccactgtaaattctagcactataatcaatatatgtaaaaatgatgaagaaatgattaatgcattgtctgcctcagttggagagaccatagatttaagaaattctgcaatcctatgaaaaaaaaaattctgcaatgcctattttgactagaggttttcttttgacggatgacaggaatggacaaatgatcaagttgaaaatgaaatggagactgtgttggattctgtgaacaagctaagatctcttcggccacatacagatatacatgaaaggtatgcttatgttcaccagatgtatattcttttggtgtgcttcaagactgtcacttcctttttatagttttattcttattttgattcataagaatttgttcattttgaagctaataccttctgccctattttcatctggacagacggcctgcttttatgctctgccgtggggtagacattgctgccattattcagtgctaccaggcgcagatttcaactcttgcttctgtttcatctcttaaggtttgctcggtcttatacctctctggctctctcaactcggccactcacctcaagtcactgtttatgaatgccttgttcttgatggataatggcataatttctatttctatttcaattcaattcactcgagttttgtctacagatgtgcttatatttttgctaatatattttatgtctaaaatgcctaaaaagccaaaaaaaaaggagggaaaaaactgattcaaagggaacttttgcagatactgacagaggatgatccaactccacccaactgtgccacaaatattgtcaacaaagatctatccgtatacctccagctacgaggagctctaaacactgaagctgagcgtgagaa

SEQ ID NO: 56405 - DNA, 944 bp, Oryza sativa
tcgagcgtgctaacggcatgatactgcaagggatcaaagcacaagtttttgaccgactacgtccatatgctggcaagtgggtagatcagctgcagtccgtactttggtctttacgcactactcctagtcgggctaccgtccagtcgccgttctttttggtttatggcgcagaagcaatgttgccgagtgaagtggaatttgaatcattacgatttcggaacttcaacgaggagggctatgaagagggccgagtagacgacatcaatcgactagaagaagcccgagaagcagttttaattcggtcgactcgatatttgcaagggttgcgccgttatcataatcggaatgttcgatcgcgagcctttttagtcggcgacctggttctgaggaaaattcaaacaacacaggatcggcataaattatctcccttatgggaaggaccgttcataattgctgaagtcactcggccaggttcttatcgactcaagcgcgaagacggtactctcatcaacaattcttggaatattgaacaccttcgtcgattttatgcttaggtatttcgcttgtatctttcctatttgactgctaacttcaagtttttccttgaagttttcagtcagggggctattatgataataatggagtgtgatttttatcaattcaatttgcttacttgatttatcattgccctgtttggtctttcgacttagccaatgagaactaaaggtttttaatagcttttgcgggttttaggctcaataaggcttgacaaaggcttttaagaaatcagaagccaagtatggaacaccaagcatagcataaattcatcagtattgtacaaattgagcctccaccgtcattgatcatcaaaatcattgttatatcaatcagtatcagttttttcatcctcagacttatcagacccagtcggccccaggtcgaca

SEQ ID NO: 56406 - DNA, 1677 bp, Oryza sativa
tgatgttaccatacaattttctgccatctatgccagcaagaaaactgagggatgcagcaaacaaggtatatttccataagtttgcctccttgctcaatttaattgaaattggttgctccaatcggctgaaaatgatatcttgttttgcaccagattgcttagcaccaagttaataatattgttcatttctgtttatatcgaattgctcatggaaatttgccgagtagaactatataacataaaattcaaaatcctaagaatgtggctttagtgtgcctaatgttagttccccacttaaaaggactaacattgatgtcccactgtaaataaatctcgtagctgtcatttttgtcagcattgcgtgcgacataagatgtgtagcactgtagcagcgggcatctgcttgttgaaagttaaaattcaccggcaaatggtgaattattgcctcatgctgccatgggattatgttttattactccactccttcattgagaatttcatgtttgtcatggttgttctggaataccgtgggccatggtaccactctatttaccctatgtgcctatgtaattgttcatatgctagctttgcatctaaaaaagagctttgggacctattgaggttattggattactttccgaaaagattttttggtaggacaaaattgcaaagcttttgtctttctaggtttggtcaggcagaacatcataatatatcctgtatataaatcatttgtactgtactactgtttgcttatgttaagtgacatccacgtattactacagcatagcatgttactctgctttctcccatctaaatcagagtgctttctttagattaaagagatacttggggactacgatgctattcatgtgagacggggtgatctactgaagaataggaaagatcgatttggtgttgagcgaagccttcatcctcatctggacagagatacccatcctgagaacatcaacagaagaattgcgaagtggattccgcgaggccgtactcttttcattgcttcaaatgaaaggacaccatgcttctgttcacctctatcagacaggtcatcaacacattgtgtcagctgctcttcttgactcaccagcgttaggatctcaggcacgatttacatttgcatttggtttctgcaatcaatttagatgtgactttagcgattcgtgttctcatggatttaccacggcacatggtttgtcttcttctgttatcaattacttcctccgtttcacaatgtaagtcattctagcatttcccacattcatattgatgttaataaacctagatagatatatatgtttagattcattaacatcaatatgaatgtggaaaatgctagaataacttacattgtgaaacggagggaatacttcaaaaacatcccattcttaagaaactcgactagttgctgcagtactaatgcactttgtcattctggaatatttattttgtttggtatattcattttttttatttatcacaccatggcttaccaatagaaaaaaacaaataatatgtacatgaccagcagtgcaatgtcataccattgaatgcttataatttcatgacacaagctggctaagatttctattcgttttctttggcgtggatacagatacaagttagcatactcatcaaacttcagcagcatattggagc

SEQ ID NO: 56407 - DNA, 2143 bp, Oryza sativa
tttacctaaaaagtatgttacatagatatttttgaaagttacatataagttacatgcgagttacagtgtaattacatcacgattatactataattacatctgtcaaatttttaaaagaaaatttatcgataaatgtataggtgatcccttactaactaattaatcacgtgttttaattaataaaaaaggattttacctcgacgaagcagtcatgaaagaagaggcggacgagccctgcgccgatgccgcggttggtgtacacagcattcttgacggtgtccttcacaatttgctcagcttttgggcaagaggaactgtaataaccaactctaagccctagggacggcgggcttgggcttgccggagccgggctcggaggagttgggcttggtggaagataggttgtcggcgggctcgggctcaccggtgctaggctcggaggagtcgagctaggtggaggataagtaggcggcgtgctcgggctcaggcttggcgggcttgggtatgtaatgggtgtgggtgggctagcattgccggtatagccttggcatgtcacagagcccaccagagccagcaatgtgagcaacacagcaagcttagccatctctgattctctgcactgaactctgaagtagctacagtgttctgaaactctgaagactctgaactttttgatgaaatgcagctgcttctgcatctccatttatagtcagtccccagccgaagcagagaagaaacaatttggctggcacgtcgcggtgacaaatgcgttcgaagtcaagcagggaacatgggaatcgaacagctagctaggctagttgacatggaggtttctttgattaatttttgccggtaagctgcagctgcactgaacaagtcgacggtctggttggtttaatttcagaggtttttcgtcttgcagcgtatgttccatggatgggttgtttattgtttctgaatcaaatttatcacccagatttatgttcttgcggccgttgaattggcagtttggcattggttttgatgggactcgtccacgccagcgcctacttcccggggtggtggaacgccaagttcgcataggcgatggtgaagatgggcagcgtcaccgtcaagaccgccgccggcgagataaggaagcagtgtcggttcaccaaccaggggcctgtttggggagcttaaaattctgagaagcagctagttggtagccagcttctaagaatcaaagctgggttttccagcttctgtcttgtagttcattagctggattctacaactacagcttcttagaatctaaaccaaaagctagactgtttcgggagcttctaattctgagagaagctgcagcagttagaagctcctctaaacatgtcctagtactaatcacgacgctttacatgcatgcctcaagccgagccagtgaacttaatttagaacaataattatctagattatgtgtcacctgcgataatatttaggatcttatgcaacttcgattataaaacgtgagatttcctaaaattcactctttttatatggtctccattgatcccacaacaaatttaatcggttataaaattacacggccaacctccgctagttttactaatacgactaactaaactttacttagacatgttcttatgtcatatataagggcatgttcacggctggagcctggtatatactagtaggcaatacacgtcacttaagattataaactatactcaatttctcaaatattataagagtatagtttatagtttttctattttctcatgttccctaccctatagtaaaaatttcttctataaatactaagagtctatgtttagcctgtgttaagcttaaatgtttgagaaaattctctctgtacccctaaaaattcatccaatcccttctatacccctaagatttgctcattcccttccataccccaaaatttcaatttagatcccttctataccccttccgttagttgaccattagttgaccgttaaattcatatcataaagtccattttaccctttggtatcaagaaaatataaatttatgaagtatattaatagagtgtataaatttattgtatacgattattatatttatgagtttattttgtgagatattatttaacaaaagtaat

SEQ ID NO: 56408 - DNA, 760 bp, Oryza sativa
tcctgcagcccagacatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcatcagctgtaggaagcctacagtacgcgcaagtgtgcacacgacctgacttggcattcgttaccgggttacttggcagatttcagagtaatccaggcctagagcactggaaattggtaaagaaagtcttgcgttatttgcaaggaacaaaaggcctcatgctatcttacagaagatcagaatcactccaaatagtggggtactcagattctgactttgcaaaagataatacaaagtcaacatcgggatacgtgtttaccctggcaggaggagctattttatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcct

SEQ ID NO: 56409 - DNA, 2106 bp, Oryza sativa
tatgcggcaagaatattaaaatcatggttggagaaaagatatttgataaatacatggtatggtagagtagttgctgaaagtacaacatctaacaaggacatgttaacaaaatagcactattgaaaacgagttgtcgtcattggtaggaaaaatgagttgtacaggacaaaaataacgtgaggtttcttcttatgtggaataggaagttgcactgattgtcctgtgaaggggttgccaccaaggtgtattttccatcatatatatactacctccgtcacataataactatatttctagaatttaaatttgacccaaaaagttgtcataatagagtattaattgtcctatcaatcacttctcatccaaatttctctctgttctaccctcagccaccctcccacttttatctatacactattcaatgaggggcatcatagtctttttttctcaaacctttatatatatatatatatatatagtaaatttgtttggtgctccatggtgcccgggcaccatgattgaaatttactatatacccaattcaaatgagtatgaaactttttcaaatatttaggtattaacgttaactactttagtaactagttcaaagcaagtttgaactgaattcaaacttgcttttgttagattttgattccaggtatatagcatccaaacatataattagttaggtatgtaataatggattgtgaaataaagttaaatttgagttgttttgttgctaggtataggtatgaatcgaatacttataagtaggtatatactcacaatttgaaaattttgaaaaatttgggcgaatttgtgtatttcataccatggtgcccgggcaccatggtgccccatatgagtgtcctatatatatatatatatatatatatatatatatatatatatatatatatatatatatatgccaaacaacctataattataattattttgagacggaggcagtatatcacaatatggcttgacgagtatgtgactagagtgaaaaaattcacattgggatcaagagaacataatatattgaacctataagtttatttagggtaaggatatatataaaaaagcaaatacactgactatatgtgttgattaatgttgggtttaaatgtgtcaatgagatatttttgtctttaatattttaatagttgtactacccaaattataaggagcattcacattccatgaaatatgacctgtatttttggcataatattagtgcaataaatctagccgcgtgccaatggccaatgcatgggcgtcgggcaaccccaatagtagtaaaactatctttaacgcaaatctatatacaaccaatttacataataaaaccggtatatattaccgtttaaagtggactcaaaagataacccaaaaaacatcagtcctatcatttcaccaacagctaattataagacgtaacccttgttagttagaaaataatttgagggtaaaattttatgtgttcctaatgaattaaaaattaatgctgaaaataaaacttgataaaaaaattcaaaattaactctaaaattaaaattttggttgctactaataagctgaagagcaaacggtagagcgatacaataagtagaagcggaccagacattaattaggcatcccgggtcatagcccgggaaatgggatctcttgccctttatagcctgtttgttttttccaccatggatggactctcaaagtccaaactgcaataggccacaggttgtggcccaattctgggtccacctctaactataagagtgtaacgaaagaactcataaaactaattgttatataaatgcatctttattgtatgaaaatgaagatgtgatacattgtcaacagactgtcagaaaagacaaactggtttgagttacatttatttgcacattcattcttgcatatcactatcagtactcgtcgtaaaacaaaccggtatcgagatagaaattccaaaaaaaaaaaaaaactaaacatcacgttaaatatatataaaacgtgcatcacgtgtgcaatatatatatatatatatatatgtatacatatatatatatatatatatgtatacatatatatatatat

SEQ ID NO: 56410 - DNA, 748 bp, Oryza sativa
ccaaaatcctgaacccgcacttcccgaatattcctgtcttgctccggtttaccaggacacatggaactcattgcctatgggagatgaagctgctcaggcagtggaattgatggaacgcatgctaaaactgaaggaacaaggtttgcagggagaacaaatcactcggcactttatcaaaagtcgattagctccaatcaaagagagatcccgcacggcttttgagtttgacggcaagcatgagccaaatcgggaagatccagattctcttgactttaaggtcatgaaagaaagaatgtacaagatcttctcaaacgctattgttgtcagctattcacacctgctacccgttgtgccattcaatgcattcaatcctcctccaccggtacgtattcatacacttcaacctttctcaaaatatggtcttgctttcttgttgaatcagttaacaatgaaggatattacacccaggaatttgctttgatgaagtcggatcccccaattgctcaacgccgatcgccccgccaccaaactgggcaagggagcagaggaccaagaattcggtctgaaactcaaccaagtgcttctgatccaatcggccagccagattctcgaaagaggaagctggttctaagtgacgacgaagccgatgatgccgccaggaggcctggagaccgagagacaaccaagaaactaccaaaacaggctactccaaggaagaaaacatccagtcgccctgtgccaaagatca

SEQ ID NO: 56411 - DNA, 1973 bp, Oryza sativa
tctacccctacaatcttcaataaaacatgcttgtagtgtttgtaagtagtatttgtaactaaacaaacacatggggagaatacaaacttcaactgtatagtttccttggacaaagatgaccgggggactcccattggaatggcacaacacttgaaattgcagaagcaaaataaagttaatcttcagctcgctaaataactatcatttgctgctctaaacaataaagttaatcagcatgcaattcactaagatgttgaatgctaaacttggtagtttacacacgaggaaagattcacaaaagtcatgcatatctgatacatacgcaaaatcaaaccttgacagtcaatgcagcacatataaaccccctcaagtatcataactgattcagggtggaaccaaggatcaagagaaatcaatacattcttttttgcagggacattgtgatacattcaatgattcttacctctttcataaatagtcacagggatatccttctgggaaaagttgattgcaggatttaatagaagataaaggctgttccattagcatccatcaactacataaaaatagtacaagggaaaggttatgcagggagtaaaattagatcaaacaaacatccattttgacaaatattctctcaaccatatattctcagccaaaatcaatttccaccattccatccatccaacaaaacaagctagagctctacataaagtttaagaacagtgtacatcccaacataacaattattgctggctatttcatcagccgtaatcattccgcatacttgttaaactcagactctccaagaacttaaactaatgctaaaactatatcccaatgccatgttacctcatcaaaaatttcagttttcattctcacaggagtgaacattgtatcctcaaatgttaaactttgaatacaaccttattagaagcaaaatgtgtttacattgattaggttatggcaagtggttaccgaccatcaataataagagtaaactacataccggtccctaaacttgtgtcattgtgccatctgggtccccgaactcaaaaaatacagattcaagtcccaaaacttgctaaagtatgtcattttggtccaacatagccaccaccattccggcatcctacatggcgctaacgtggcatgccacacggacgctgatgtggcctcatcaatacctatacattgactgacaaataggacccacttaaaaactctcttttcctcctttttctctttctcctttcacttttttttcctttctcttctctatttctctctcttttttttgttgtacaagcggcgggggcatgcgaagtagcggcgctccggcgagcttccgactgggcacggctggctgcctaggagcatcagggcgtcaacttggagctggagcctggaggtgttctcggcttgggcggggacgcctagcggcggcgcatcgtgctgacacaatggcggccgaacaggtaggcggcaccgcggcacacgggtaccttgccggtgagctccaacagcaggacggcacggggaggagaggggaaggagggagtttggcatggagaagatgagagagacctcaatttcggataaggatcgacgatggcgacgaattccgaagtcaaagccagcggcaataaccctaagcttcggccagaacggctccgccgacggcaagcgcaacggcaaaccaacctcgccaccctcgcggcgacgacaacgccactgccgccgttcttgagcaggccgtgtaccatgcgcaacaccagtaccgacggcggtggcaggcggcgacgtggcctcttcggggtctggttgcttcgggatcaccatcttgtcgaacaggtgatgggagatggaggtgaaggcgcacttgttttttttttgaacgactcgcacgagacggtgtgaagttctattgatagagcagggaaaaaaaatacaagattacgaccctggagggt

SEQ ID NO: 56412 - DNA, 1464 bp, Oryza sativa
caccgccgccgccaactccaccccacaaaaccctaatccgatcgagagggggcgcagccagtgacgggaaacgccaccgccgcgccacgtctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctctctttcatctagaatgtcgttcatcaaacccaaatagaaccacccgactagatctaacctatgtgatcctagtgcaaagttcaacacggcgcccatgaggctgagcgtgccgcggcgcgccgtggagttgaacacgacggagaaggcgagccacgcgttcagcgtcgacgccgccttgccgtcgtagaggtagagcccctgcgccctcaccgccgtctcctccagcgacggcggcagcgcgctcgtcccctccgtcatcgggtcgttgaacaccaccgtcgtgccgaagatggtggtgttcttcgccgccctcagcagcgccgccggcgaggcgaccaccgccgacgtcgagttggccgtgctgttgctgaagtcgtagaggatgtcgtggaagtagagcctcatctccttgcacggctcgtcgtagctcctgacgaacctcctgccgccgccgccgccatggacgacggtcgccgagctgaggaggaggccggcgacgaggaagatggcggcgacgatcagagacgccttggaccaagtagcttgcattgttactcttgcttgaggtaattaattaatgtaccacttggcttaattgattgattaagcttgctttcttgcagctgttagcctgtgatcgatgtggcgagctcgatcgagatttgcgtacctatttatagtgatgagaaaggttttgcatgcatgcatggatatattatatatatttcttgctggtccgattctctggtcctgaactcctgatactgatgtttcatttaattaagaaattaaatggaatataaacttggcttctacatcaagccggatgcacatagccatgtcctactgctgatgtatacggtactagggaaaattgctagaagagatagcacgtctctttcaaaaaaaaaacattataaatctcaagaaagcaaaagagatttgtttagtagtactccctccaatgccagaagagtaattgttaatattttcgacaaggttaaagttaaactactagtaactaaaaaaattagtttaaataaactagaataacacatatagaataatctaaaggtactataatagaaataaatatttatttattgtatacattataatagaaaatcatagcaaagatatgttttgaaaaccgtgtcattataaagaaaaagtcaaaaattatagaaccggagagagtatttattatatattgagatacg

SEQ ID NO: 56413 - DNA, 1303 bp, Oryza sativa
gaatatattttgataatttatttattttgtgttgaaaatgctattgtattttcctataaacttaatcaaatttaaacaagtttgactagtaaaaaagtcaaagcgacttataatatggatcagaggaagtaactcataaactcaattggacccatactttgtactgctagagaatactacccccaaaatcaactagattgcgccaaaacaatacagcaacgaaatgagcaagccaccccccgccacaaccaacccattctcttccattgcctcgacaccaaatcgcccctccaactgaccgctccaagccccccacgaaacccctcagaccaacccacctcgtcgactacctacagcaaatgcgactcctcccccacaacgactactcgccggatcccggaggcatcctcccaggaaggaagcgacgatacaggaaggggggggagtgggaggaggaagatcgattaccagttggatcggagcctcggagccggaggagatcgccggtgaaggagagcttcgcgcgcgctaggtttggcggtgggggagagcgcgtggggggaggcgagaggagaggccgtggacttcggccgcataacatgggaaatgatgggccatagactaggcctgtttgattggaccaaatttcggcccattgacgcatacccgatgtttccaactttgtgatatttacgcatactctgtttattttggaaaaaaaaaagtcatataccctccctatgtttccaactttgtgatatttgccctctttttgttggaaaaagaagtccatacactcctaacacctttagataagagtccgtctaagaacatccccagcagatatgccatccgaacatccatccagaaaatagcggttgagaggagaaaaacgacctcctgcagaaactccatcccaccctccaacattagcgcatatctatccgggagagaaaaatgccagatttggcgttcctctctcctcacgccatcccgcaactgctagcatccagacccagttcccgtcccccatctggatcaatgccccatccaccgccgtcgtcgcaaagtcgtggagtcgtggaaagaggatggagaaggagaagcataccagatctggaaggagagcaccgccagcgacagccgtttgcgcccgctgccgtcgccttgcgcccacccgcggaccgtcgcctgccgcctccgcccctcgcccgtctgcccctgtcctatctgcgcctgccgcatgcctcctccccgcccatccgtgcccaccgccgacgcctcctcccatccgaaccccccg

SEQ ID NO: 56414 - DNA, 1114 bp, Oryza sativa
tttttagctatagttacatcttttttcaccatatgtgcaccccctcagtgcaaacttaagcacctacatcagcttaatttggtctaaaacagagtaaagcaagcatgtgacacccctctccatttcgctctaactcctccctgcctactccacctctcctagcacctctcttcttgctccacccctctcccactccctcctgctccacccgtcactctcctctgccggctattttttgcacccgatgcggcagctgggatgtggtggctgaggtagaggcttgcaaggaggcaaatctgatgaaggcgatggtgtcgtcggatggatgcagcgctcagctgatgtgatgcaggagaaggtggaggcgacgggtggatgctacaccgttggctgatctgatgcagatttctctttttctctactcttggtacttgctagttcatgttggtgaattcaaagcatttgtttttttcttgcccatctttactatgagaaaaattgataatgcttcccttcgtcatccatatttttcatccatggtccgcataatgccacaagatgcttctccataaccgatcttctccagtttaagcatatctcatattagtcctatatttcggaaggaaaaagtacgaattaccccctgaactatcgcggtcgtccgaattacccccaaccacaaaaccgggtattcttcacccccaactatgcaaactggacaaattaccctcctcgatctaatctgtggtgattttggtccacgtggtgttcgcgtggtagtccagtcagcactctaattattaaaaaattgtgggacccacctgtcatctcctcatcctctcttcctctctctcactcttcctctctctctcaaaccggtcggcgacggcgtgcgggggaggacgcggcggcggcgggcggcgccggacaggcccacttcgccgcccaacccacctggatcgccaccggcttgtccaccgccccctgcgaccccgccaggcaggcctacaccttcggcctccgcaccatggtctgcctccccctcgccaccggtgtcctcgagctcggttccaccgacgtcatcttccagaccggggatagcatccccaggatc

SEQ ID NO: 56415 - DNA, 2455 bp, Oryza sativa
cgcaatagttcgggggggggggtaattcgtactttttccatttcggaataggttttaactttgtaccatgtgacatgaccgcttagaagtccacccaaaaccaatagttttaaaatgtaaaaatactgggtcgttgcccatgctagattgaaaccagggggatccacatgaaattgctacgacacttccaatgatagtgatttaactagtgggccaaaataaaaataccagtccaaatctgaggcaagatgaaatgttcgtgattgctaccattaacaacgacccaaacaaaggccctaaatgactagtacatcatgaatattattggtagcgactctagacaactaaatatatagttggctaccattgacaacaccccaaacgagatgcgtgatccttaaatttaatttaaagtgttttggtacgggaaacaaaccaaataaactttaggtgctgtttggttggagattgcaaagtaaacggtaaggacatcagatagcactgtgatagtaatcagattacggcaaacttagattttgtttggttctcacacgtgggtcgaggggagcggcggaggcgacgcttgattctttctcgtgttgcctctccgtatcgttaacgcttatcgctcctgatcgagcggtatcgcctctgaactgggcccgtaatgggttccaaggtatccaattacggagcatctcaaacaaacaacgggaaccggatctgtttgcgctggaatcgggtgcgggctgaattttaccgaaccaaacagcaccttagtgccataacattacccacctccactacttttaaaaatttgacaacacttccattagctatccaaaaatttcctcaagcgttcgcacaatgcccaagtcttttgggaatatgcaaggagtgcatctttggaaggaataaaagttatttacatggaaattaagaaaacaatgaaggggacaaggtacatgaaaataaaaagactaggagctaatctcgcaactgatggtgcgaccaaatgtctccgtccgacaaacgcagctccggcactgccaatcttgcaagtcgctaaagttcagcttctgccgccattgcactggccacatgtaggatctttgctgctgattgaagactctattgtttcgctctttccagatggtccaagcaaccagagccacaatggtgtcaaatccccgtctatgttccttgcattgcttcatcgtgctgtcacatagccaaagatggaaagacgaatctgaaagtggcaagcatcctgcatgtccaatcgcattgagggccatccaccaaagctggcaagattctggacatacgatcagcaggtgatcaatgctctcctcgcattgatcacaaaggacacacttggcaggatgtggaagtcctcgctttcgaagtctatctgctgtctagtatctgttaagggcaacaagccagatgaagtaccgatattttggtgaagctaaagatttctagattgggctggactggaagcgaatgcgacccaggaattgtgcttgataggccgaccgagaggagtattcacctgacgtctcccatctccagtgcagcgaatcctcctggtccgagagctgtatagacttcatcactggccagaggctaagatactcgagaatagcctgcattcccagggcaccagttatgtcttgaatccatcttttgttgagaagtgcttctgcaactgtcctgtgattgcgaaatctcgcaggaaccgcatcatagatggaaggcgccaactaacaaatcgatgacccatttatccagatatcctcccagaacagtaccaagtttcctcttccaaccgaacaatgcccgagtcttgatgcttctccacaacctctcttcacctacatgagtgtgtccgtcatctgtgcgacctgacatcccacatcggtcccatattttggtatcgaccggtaacaacacggtgcccgtgtgagacgatcggttaggccaccaaaacccccacagttcttggcttcttgcacatgtaatacatccatccaagcccccaaaatttacagggagtaaaaaaaaaacaaaaaaaaaacaacaaggtaacgacctatactagatccaaaccagggtccacatgaaaaacacttcatcgttaccactgatagcgattcaactggtagcccaaatgaaaaatactggttgaaatctagaggccatatgaaacattcatgatcgctactaccaaacaagggcccaaatgaaaaatacatgatcgatattaattaattgttggtaacgaccacccaaacaaatagtactacctccgtttcaggttataatactttttagcattgtccacattcatatatatgttaatgaatctaaatatatatatatgaatatacacaatactagaaagtattataacctgaaacgaggaagttgcctgcattcgtagcaacgg

SEQ ID NO: 56416 - DNA, 842 bp, Oryza sativa
ggggtattgatgaacagatattcaacttgtggctttgccatggctctcttcctcctccaactctacctcctatgattctatttctctaattccaatctcatgcttctgccttccctatattactcttcccaatccctgattctactctcttgattgtattcctgagcacttgtattcttgagtggatttgcaacatatcggtggcacttgtgtgagaaatttggtgtgattgtgttggttcgtgatagcgacctagaagtgcacttgctgagttttcatatatgagcaatcagaagttagatctattttttcctctcgctctctcttttttttttcaagtgaaacacgacgatacgatgtaaattgaacaaccttagcacatatggcttacaatgtttactccaaacacaaatataaccagagtgccccggtcgtgttaaacttcaacacattcttcaaagaaaaacagaacaaggcttgcattgaaatttcccctgaactcacgagtggtcgctactggtacatggcagaaagctcgggcggattaccggcgcattgtgctcaccgaggtaggggtgaaaacggtatggaaatatccaagaattccggctaccgtttccggtttgcaccgaccgtttcagtcggtatcggaaattgtcggtgtcggaaatgaaaacggtaatctcttccggaaatgttagcggaaatgatatgggcttttttccgaccgttttgtcggtaaccgttttttatcggtaatttccgtcaaatttccgacaaaattccgaagaaggaagccgtgttctcgaagactcaaatctatatctaaaaaaagtcggaca

SEQ ID NO: 56417 - DNA, 978 bp, Oryza sativa
cccactggaaattgtagtcttcttcagcaacttgaagaagggcatccccctctcgccgagtcgtgagacgaaccggctgacgccgccatgcaaccagtcagcttttggacgtctttttgggagcttggcggtttcatgttgaggatggcattgattttctccgggttggcctgtatgcctctttgagataccatgaatccgagcaacttccctgacggtactccgaagatacacttttccaggtttagtttcatcttgaaagcacgaatgcttgcaaaagtttcttctaaatccgtgatcaggtcacccttctgcttggtcttgacgactacatcatcaacataagcttcaacgttgcggccgatctgagttgaaaaacatctttgaatcatgcgttgataggttgctcatgcgttcttcaatccaaagggcatggtgatgtagcagtaagccccaaaaggcgtaatgaatgatgtcttcaagcagtcggattcttttagtcggatctgatgatatcccgagtagcaatccaaaaaactgagtagctcgcagccggccgttgagtcaactacctggtcaatgcgaggtaacccgaaaggatctttgggacaagacttgttgaggtcggtgtaattgacacacatgcgccattgccccgtctttttccgaatcaggactgggttagccagccagtcgggatgaaggacttctttaatgaagcccgctgctaacaacttggttaattcctccttgatcgcatccttcctgtcctatgcaaaacggcggagtcgttgtgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagttcctcgcaccgaaacgaaaacagcagcagcggaaaa

SEQ ID NO: 56418 - DNA, 3799 bp, Oryza sativa
tgcagaattagaccaagtcaatgttgcagtacgtatgaccgagaattaatgcaaattaaaactagttctttcatatatcttctcacaaccgagagagaataattaattaagggcggttcctttcaaactcaaaaagtaactaacataatgtcaggtatcagaagatcgaatccatcgattaccgagtgtttcacaagctagtggcgatttatcgtttccatcaattaatgtgtaaatattatgtcaatgatatagatcaaataatttatagccaaagatcttttatttcactataggtggcatagtttcattagaattgctagctaataaatctatatggtttaacgctagtcaataataaatgagagtttggatttatcgtatcaccttaatttctcattttgatttatttttatcttcaccttcatctttttattaacaaatttatgaccgtgtgtgtcttataacataagctagagatgtaatcaatttctattattaaaaatagatcaaataatatatataatgcgatgagcatacagaagagaatcacacttttctctctcaaaaaataagataatacgtaaacatggcaaatacaaccatacatcgtacaagacgcatcagagatgagaagctaattagttatttatttattttcaaagaacgagacagtattgatattaattagttcccacgcatcaaagtggaatctctgttgagtcttccatgcatttgtcacaaaagggatcaatgaaggttttgattcgatcgacacaaaaaaaaatgttttaaaaaaagttcaggaatgactagattttatgcaatttgcatattataaaacatcaaaggtcaactgtatagatgaatttatgcagtgacgaacataaactataataattataattaagacatgttttagatttcaattttttttttcaaacttatacttttccgtcacactgaactttcctacatataaactttcaacttttccgtcacatcatttaaatttcttcaaactttcaattttagcgtgtactaaacacagcctaagtaaaataaatcacacaaattaagtttactttatttttgcagagaattaagtgtagtcattagccgttgattaattagggaagcaactgtagcaaatagccaggtaggatacgaacctggccgaggttgaccgccgggaagcagctgcggaagcgcgccatgtgctcgcgctgcaacggcgcgccggacgacaccacctgccgcagccggagacgacgccgcgacggctcgccgtcgccggccgccgccgcgaccatcttcacgaccatcggcggcacgaccagaagcctcgtcaccccgtactcctccaccgccgccatcgtcttctccaccgagaacctgccggggaccaccaccgccgtggcgcccagcgccgccgtccccatcacgaacgacgagaagccgaacatgtggaacatgggcagcacgcagccgtacgcctcgtcgtggtcgtcgtactgctgcggtttctcgccgccgcggcgccgccaccccacgcgcgctccagcgacgcggccatggcgatcgcgttgccgtgcgtgctcaccacgcccttgctctcccccgtcgtccccgacgagtagaacagcagcgccgcgtcgtcgcggccaatgttcgccgccggcagatccaatgtctcgtcgtcgtcgacctctgcggcgacgtcggcgaggagctgctcgacgaggacaagtttgacgtcgggcgcgatggagcggagcttgggggcgagttcgccggtgacgagcgcgaggaaaggcttcgcgtcgtcggcttgccgagcgagctcgtcgggcgtgaggagcgggttggcggcggagagcacggcgcctagggagagcacggcgagcgagagcgcggggaagtggagcgagttcggcgacaggaggagcgcgacgcggccgcggcggaggccggcggcggcgagcgcgcgcgcgacgcggagcgagagcgcgcggaggccggcgaaggagagcgcggcgccggtggaggcgtcgacgaaggccgggcgggctcggcggccggggaggagcatgtgcgggaggatgtactccgggaaggagagcgcggcggcggcggcgaactgcggagggtggccgctccggtagacgcccgtggcggcgcagtagccggcggcgaggtgcaactccgtctccatcggtgtggaatagtcaatgcgttcagagagaaagctcgggtatttaaaatgagcgaataaatgagatggaaacatggttaacgattgaaacaaatcgatgaccaaattttgcccatcgaaattcgcaaagtcgatttttaaaacgtaaacaatttgatttggcccatttcagaaaaaaaaaaggagtttgatttcagataggaaaaagtacaccgaaggtcccacaacttgtcatcgagttacaaaatcgtctcccaaccacaaaatcgtctcttaaccaagcaaaaccggtcacaataggtcattagtggttttgacacaaaaccgtctcttaaccaagcaaaaccggtcacaataggtcattagtggttttgacccggttttagcttacgtggcggctgagtcagcgtaggccccacatgtcagactgccacatcatgagtgtttctctttccccctcctctgtcttcctcctccactctctctctctcactcctctcggggcaggccggccggcggtgaggaggaggtcgccggggcgaggagctccgacggccggccggcgatgcggcagcggcgcggcggcgcagctgctatggccgctacctctccgcctccaacgaacccttcctgctcgggataacgggccgcaaggtgctgcaggcgcagccccccggcggccgcgccaccgactcgtcgctggagtgggagcccgtcaaggacgacgctctcgtctacgtccgcgtcgagctcactgcctggaacgtcgcgccgctgcggtgcgcggcggagtacctggagatgacggaggagcacgccgaggacaacctgaccgcgcgcgtggaggcctacctggagcaggcagtgctccggcactcctgcgaggccaccaaggcgctcaagtcccgcgaggagctgctgccgcacgccgaggagctcggcattgtcagtcgctgcgtggaggccatcagcatatttacaagcgggtgatgaaagtcgacaaatacgaagcaacacagacacagagagacagaggcctctgcaagtctgaagctatacacaaactgataaattcgtacgcataaaaacacatccttactggcaaacgctgttggtttctgaagcacgagaacgacaggagaaacggaagagaggatgactgccatttctcggtaccactgccgtaagagtgaatttaaatgaagaacaaaacatggatcacttaacaagtccctttgccaccaccgcgcgctcgtcggccgcgtcgcgctcctggttcgacgacctcgccgtcctcgggctggacatgtacagaagggtaatggctgccatggcggcgcgcgccgatgtgaggacggaggctagggagagttgtctcgtgtcgtacgccaggggcaccatcaccgccctatcgaggtcgatgcggcggcttgcgtcggcgccggcgtcgtcagaggtggagcagagggacctcctggaggcggtggtcaccagcgtccccaccgacaagtgctcggggcgcgtcgtcaccgccaagttcctgttcgcgcagctgtggacggcgcacatcctgctcgcgttgga

SEQ ID NO: 56419 - DNA, 2060 bp, Oryza sativa
aattttaacaaaatctcaaatctacatttcaaacgacatcggatggagatcaacttgccaatctgtatcattatcatcgtattactgagagcaagaacagtagtgtcaaagaactctgttccggtaagctaagaactaaacatgacttgcacagttgcacttggcaaaaatgtggtttaggatatgtcaaacatttttttttggtaatatacatggactaattaaaatgaacttccactcaatagtttgtttgcaagcaacaagactgtctggtagggagttttctgcacgacaacacaacccaatggaaacgttggttagagttgtggatggtatgcagtttcttggcctcttgggcattggaaagtaaattttattgtaccaaatctctgtataaataatgagaaactctgaatattaaacatttcattcatgtggttactgaatcgacaccgccacaccggcttcatcaagcggttgagattattagctgttgccaaggggatgatcagtttcagtttcagttaagtcggtgcggtacaaacagctaagcacgtataatgattgaaatgtatcttagcccaattcatctggagtagatactttagaggatgcatgttcttgacttcttggtgaggaaacctcatttcggctgaagaaaacctagttggcacttggcattgtcagagctgacttttgttcttctcttctgcattttgcctggagttcatggctaatcagcaatgacacggtttgtaatcacaagttaatgtcttccccggtcgctgttgttcacaaggtgagagacctttcctgaaaccagcagagggagctttgccgctgtctgaagcaaaaatgttaagcaagaaatttaatactgttcaatttgattaaactcaccgctctgcataaatcacggagtacatgcattatattaggcaatcaccattttgtaaacaaatcatgcatcctgccggtggccatgttgaatgacgcgttgctctccctactctacggatgtgattattgccagcgaatctccaactctgaaactctcaagttcagtttatcagagggttcgcccactgaaactctgaatttccggagacacacatgcagacttatccaagcaacattcgctacaaacacctcaaattgaactcccatatataatttcatcagtccaataatatgttaacgcgttgttaattaaaccccggacagattgcataatcactggaaaagcaaaagtcgcaagtcaacctctgaattattggctcccatgttaccgttcatgctggcttagcttaagctaatcctacattaccacgcatccaaccaacgaactaaccatacaaaatcttctaaccaccgtacgttctcctcgcactataaatacacaagcttcccaagcaactgaagcaaaaaagcacacacaacttcagttcagtactcgtagctgcttctgcatttttgctcgatcgattcatcagccatggcgactaagctgcttgctgctgtgatcactgtgctagctttgctgggccatgtcatgggccaaggagggtacggcccaagcccaagcccaagcccgagcccgagttcgagcggcggcgggctcgccgtcggctactacgacagcgtctgccccaacgccgaggagatcgtgaggggcgtcgtcaagaacgcggtggcgcaggacgccggcgtcggagcggggctcatccgcttgctcttccacgactgcttcgtccaggggtgtgatggctccgtcctcctcgacgcgacggcggcgaacacgcagcccgagaagctggcgccgccgaacctgacgctgcggggattcgaggtgatcgacgaggccaaggcggcgctggaggcggcgtgcccgggcgacgtctcctgcgccgacgtcgtcgccttcgccgcgcgcgacgccaccgtgctcctcagcggcagcggggtcgacttcgccatgcccgcggggcggctcgacgggcgcgtgtcgctcgccagcgaggcgctcggcatcctcccgccgccgacctccaacctcagcg

SEQ ID NO: 56420 - DNA, 1550 bp, Oryza sativa
cgcaaaacatcactctatagaagtgcacatagaatacagaaatcagcaagctctccttaaagcataactctagcaggccatcgataatgatgtggcattggcaccaagggatggtgctatcgatacactaccaggccagactggcaagttgcttgctttggcattccagaatgcaactcatggctagttccttcagctgttcttccacaacttccatgggaagggagccatcaacaacctacgtgacacaaccaatgcaacaagttaatcagatttatttattactaattggttgactatagaactaattattatgaccatactttaacgaaacaaccaaattcttgagatactattgcattctactggtttctacacaatcttacaagtcatggtatagatcatgaatacagaaaaatgaaaatgaatgacaggcagatcactgcacttgcacatccaacttaaattaagtactatgctggttgattaccttccatgttgaatcacgaagtgaatggtaatgctcaccaactttcttttggaattcaattttttcatatctctcacccccatagcctcctctttcagctgctttctgaaatggcaaatacatatttatgtcatgcaacatcacatcataagggcttgtttgattaatccccatgagaaagggagtggaggggattaattccacacctcaatagctgtggaattattacctccaaatcctgttcaatccctttgggtgagcgataacaaggcaagtggggttagcaaagaatctgcggaacagttttcatgttttccacaaccgacaacatgatgaagaattgaggttgacttgattttttagagtttcaatgcatactagacagacacgaaccttaggggtaaaagtaaaactcgatggccaatgggttctctatttatatgcttatgtgattagattagggacctaatggggctatcatcactacaatatgcaaatgagtcaaaggcatgaaactgaggaaatcctgcctttcaatactaacaaaaggaatctatattctagaacatagccataggaagaatgagaacaaatagcatacctctggttgtacatccaaatatactacaagatctggggctataagtccattttcaggagcctacaaaaggaaaaaggagggattactgctataaacaatttatggctagaaaagaaaaattcataatatggccacatggtaccctactcaccttgcaccactcaatgtcaagtcccttggcagctgaaaatgccactccagaataagaataacgatcaacaatgagagtagttccaccaagtagctttctttccatcaaagctctgaaaatggcagaccaaagcaacacctccacagttacaacttagaaccacaaagaccttgcatcactgcacatagtgtatcactgaagaaaattttccacctataacataagctgttcgacatatcgtttatcttacaagttgaaaagaacaaaccttttctcccagcgattcgcactgaagagcaaatggattg

SEQ ID NO: 56421 - DNA, 1147 bp, Oryza sativa
aatgttggagctgtgggcaagttttctctagcaacagcgaactatgcggccatttgcatgcattagagattccccaactagagggaaaggttccatggggtgatgatgtatacttaaaaccattcttggaggatgattctcttttgcacagtttgtccgtctttgatgatgatgacgaggacgactgtggaatgccaatggaaaagggagggtgttcagcaggcaatgggagtttagctgaaacatgtgagagcaatctgaaatctattatcaatgatggttctgatgtcattgatagatttgagagaacatgtactattgagagtacagatggggagtgcagtgggtctcttgctcaggagccaagtgacaagcagttaaaaattgcacgtgctagtgctgctgctaggggaattaaaagtgtggatgagagctacttcgggtcgtatagttcatttggcatccatagagagatgcttggtgacaaagtaggttaaaccctgacactgtttttctaaacatatactatctctttgttttccaaaatgcccaacggctaataaatttctgactgaccttttcaggtaagaacagaagcttacagagatgcccttttaggcaatcctagcctcatgaatggtgcaactgtgctcgatgttggttgtggcacgggaattctaaggtatgcatgtgtaaaattcttttgggttactttgttttagcatgagcttgatgctctcaatcttgaatccactaaaagtctatatgctacgtaccgcaagtaagaaaatgagcaacagccataaacttgtagtacataataaaaaattgagaatgcttggttagatctaatgcactcaagtaatagcctactgggaggaattctgacttccttctgcctcagaaggtgaatttgattcctaccatgtagattgttgttgcaatcctgggttgattcatgagtatattttatgatacaagttgcttgtgtaatgattatattgttgagatgcaaaacacaacaagtaatgaatgttgaatgagctgttgatgtatgctttctgtctgtatagtctttttgcagctaaggctggtgcttctagagttattgctgttgacgggagtgcaaagatggtttctgtcgcta

SEQ ID NO: 56422 - DNA, 2040 bp, Oryza sativa
ttcctgcagccccgtatcaacacctgaagaaattacgccacatttaagcattcttagcttcagaaatctttgctatcgtgcgtgcaaaattgacaatctaccaacactggatttcgttattctgatggttgctaatccaatagcgcatagaatggttgtgattttccgaattattactgcaaacaatcgaccaacctgcacattgcgatccttccagaacgcagggtcctcatcgagctcgaagtgcggcacctccgcgggcacctcggcggcggcgaggtccctgagatcgaacaccctcctcgacgacgtcccaatcgaggaagtccgatccctaaccccagaccccgcggcgcaggcggcggcccggggcgtgccggccagcgacttgggcgtgaccggcgctgaccgggggttcctacccgggtccgcgatggccgcgagcggcgacctcggcggcagcatgaacggcagcgcggcggggccacccaccactgaggaggaggacggcgccgccgcggcggccaggtcgtcgttctcgttggtctccgcctccacgcggcgggcagcggccctcgaggtggaggctcgccggccgccggcgccgtggccagccatggctgcgcggaaactgagtgaggtggccaggtgggggagccggggggtggtagagtagaggagactagtaatgggcgatctcgctagaattcaaatttgaactgcgcatgcgtgtgggtggccatgagaggaagtggatctgatgactgatgagtctctgactgtgtgaaagcttttcgggctttcggccacccccgctcctgtgattaagaacggtaattagggaagtcgttttctttttgatgtagattaattaatgatggcgatgtccacttgtactatttgggttgcttaaatattcattaacgctgagttataaactggagtggttagacttctaagtgccaactattaagggcctgtttggtacagctccaactcctaaatataactccaggagttgagtctggagtggagttgcggagatgcctaaacccagctccacaactctagtacattttgtgagagagctccacccaactccactctcaattttggtggagctgaaactgtttggctgagctccagctccaggaggggtggagctggagctggagctgtgccaaacaggccctaactctaattcatctttagccaatctaatagctcattcatacaataattatatactacactattaatacttggtcccacctgtcatacacacgttacgtcttggagtccgtgctgcagctggctataaatctgtagcccgctgcccttctgtctcctcatttatgttcttaaaatatgtttgcagcaggtttatagcctgctattgtacctgctctaactcaactttctcgttttccacaggcacgtttttcaaactactaaataatatttttcttttaaaaaaatctaaagttactttaaaatatcatcttaattcatttttcaaaaaaaatcagctaatacttaattaattatacgctaatgaatcgctttgttttgcgtccgtgagagatgagttcctaacacccagcaaagaactcaacctaatagtattaacttatttatatattgatcatgttataaaattatgaggaccctttgaatcataggaacagaaaaacaaagaaataagaaaaatgtaggattctgacagaaatacaagtacaaaatggagaatcgcaaaacgcgagaaaaacacaggaaaagactgtttcagtggatcgtgggaaagaagtagaaatcagataagagagacatacagaaaattttccaaaaggttgaggctcttgctattctcctccaaattctatatagaattgtctattccatagtaatttcaaatgagaggatatgattcaatcctttgtttgaaaaaaactttatgggaaattttccgatatgattgaaatcttccaaagttactatgttttttctaggaatcaagggacttaggaatcaagggaccct

SEQ ID NO: 56423 - DNA, 1698 bp, Oryza sativa
atctcttttggcttacacgaatatggagtagacagaaagggaaacaaccgagcaattccttcactaatcaacccagcatggtttgtgtgggcttgtccttgctctgaccaaaatcagcatcttccgaccagcccagctgtgttcacacctaatcaaccctttaatacaaatatataatgccactctcacaaaacagcaagcgaaatcacccaagtaattaagcaggagttcatcatcattatataatgtttttcaaggcaaaaacataggacagcagagcagagcagagcagctaagtaaaacaaacagcgcacgttcgttaaaagtttcttggtaaacaagctcagaaagaaaaatgcagggactcgactctgcgcattgaccccaaactcgatcgaatctgccagctcactcatgagcttaagagcgttcacacgcagtcgaacacgaacattcccacatttccgcgccaggtgcactccatcatccatgagctgcatgcatgcaattatgcaaattaagcgtggtactcctagattgtttagtagtagaacatcatttgccttgatcagctagccaacacataaaaaacaccatctttaagcccggtcagtgacaggtaggcagggtagtcactttttgccgtgcgaagcaagcactagagttaattaacccctggattaggataacgacaatgaacttttctttccaagatcatccagatggcttcctgatagaaatcgcagatgacactgtgcccaaacgtgatcgatccgtgcacgcacatgcaccacagattccgttcgtcacgcgcccgttcacaccgatggtgtcgagtggagtgacccagcaaccactcaaaaagtcgagtaccatccgaggaattttaactcgttttctaaactctttaaattttgatttaaaaaagacttttaaaattattttgaaatatttattcctttttatcacgttattcgtttgacgtggcaaaacaatactgtcggtctggccaacaaattcgaatttgaatataatttgggatgatatatttttaaattaaaaataaaagttgttaaaaaaaattgccgagtagataaagctcgggcttgggccccacctgacagcgaccggtccaaccgctaacctacaaatacccgcctcgcttcggacaaacacctcactcacctcacaggctcacacacaggcacacacacacttcccgatggagcccaccggcacgatcgtcttcgccaccgtcggcgtcaccaacttcggcttcgacgtcttctccgccgccgtgccactgccgccgatggaggaggacgccgagcgccgccacacggacggcgtatccgtgaacttcaacgcgcagttcgtcgacgatggcggggaggaggtggcgttcgtgtcggagcgaggcggcgcggcggggctgttccggtgccggccggggcccgagcagcgggccgagccgctgccgacggtggaggggagcctgttccatgaccgcccgacggtgaggggcgggaggttgtacttcgtctccgcccacgagcagccgccggcgccgttcaggagctgggcggcggtgtacgcgacggagattgggagcaaggagacggtgcgggtgagtcctccgggcgtcgtggacatgagccccgccgtgtcggactccggggagctcgttgccgtcgcgtc

SEQ ID NO: 56424 - DNA, 4068 bp, Oryza sativa
ctgcagccccttctccccgtccggcgaccgcgtcgggtaccaccgcttccgcggcgccggcgcgcggggggactcggtggggccctacctgcagccggtgcagagcccggtgagctcgctccggatgctgcgcgtgtacggcacgttcccgtcgttctcgccggacgcggcgcacctcgccatgaacggcgacttcttcaagacgccgggcgtcaccatcctccgatccgacggcgccaagcggtgggtgctcacgcgggagcccaacctgttctacacgtcgtggagccccgccgagagcggggtcatcttcacctccatgggccccatcttcgagaccaccaaagcgacggtgaggatcgcgcggctggagttcgacgccggcgagctcaccaccggccgcgacgaggtcgcggccacgctcaaggtgctcacccggccggaggccggcaacgacgcgttcccggcggtgtcgccgtgcgggaagtgggtggtgttccggtcaggccgctccggccacaagaacctctacatcgtcgacgcggcgcacggcgaggacgttggcgccggcgaggggactatccggcggctgaccgacggcgagtggatcgacacgatgccgagctggtcgccgaacgggagcctgatcgcgttctcctccaaccgccacgacccgacgaacgccgccgtgttcagcatctacctggtccggccagacggctccgggctccgccgcgtccacgtcgccgggccggcggggagcgcggcggcggacaggagcggatcaaccacgtgtgcttcagcccggactcgcggtggctgctgttcacggccaacttcggcggcgtgatggcggagcccatctcggcgccgaaccagttccagccgtacggcgacctgtacgtgtgccggctcgacggctcggggttggtcaggctcacctgcaacgcctacgagaacggcacgccggcgtggggcccggcgagctcgccggcggcggggctggagtcgctgtcgctgggcccgggcgccggggacgagtcgctgggcgagtttgatgagccgctctggctcacttgcgacgtctgagctgagggcgacagatgatgatcgatgagctgcacttttaattagaataaaatctgtggtgaatttgatcggttgataataacgggacgagcctgattgtgtgggctagtacgaaccttgttgggaataggttttttatgcatgaaaagggaataaatgaataatgattctgggtacagggtacgtttttgttccgttgcttgataaagctgattgtgattatgtggacattatccatcttcagttgtactactgtcgactgtcgtgtgaagtcacttttgcattatcaaaagtccaaaaacaaaactggacttctaggcttcttccctaatacagagtacagtacaactgccggtccaaagctttacttattccctgtttagttccccgtaaacttttttaaaaaacatcacatcaaatctttaacatatgtatagagtattaaatataaattaaaaaaaatcaattgcacagtttgcaggtaaatcacgagacaaatcttttgagcctaattagttcatgattagcaataagtactacagtaacccaaatgtgttaataacagtttaattatgctcaaaagattcgtctcgcggtttgcaagcgagttacaaaattagttattttatttatgtctaaaaactcctttcaatatctggtcaaacgttcgatataatattaaaaaatttccatttggccgactaaacagacccttactgggcttaactggaatcgttcgtcgaccaaaggggacaggacgaactgactggggtgggacggaaagcagagcagcacgccacggccatttctgagcggaataagttcatctgacattcctcaattatacgccgagtctgtctgagatccctaaccacaatactagaaatgtgtatcccataactatataaaaccatccaaaaaaaagtcccgatacagtatagatgcttggttttgctgacctggcatcctagtaagaaaaaataaaattaaaatgcggggcacacatgtaactgagaagaaaaaattacgcggtcaacaatcctacccagtaatcttcttgtcttttcctttttctcttctctttcatttttatcttcaccgcagagggggagcggtagcaagccagcgccgcggcgacaagcgaatgacgcagcgggtgaaaagagaaaaatcccgccaccgcctctccgcggccgcactcgcccgctcccctccctctgctccgcccgcgcccggagctgctgctcgccagccgccgccggcctccggtcacgcacgccgctgcccgctgccgctccccctcaacagcaaagataaaaacgaaagataagaaaattgctgattagaattgtttttggaggaaaggcgttaaacgcccggttttcattaaaaagcgaaatagttcatacatgaaaacggaagaacaaaaacaaggctggaatgaaaccagcacacataagttaggcactttagctgctggcacatcttaggaacaagccaggaaactagacaagaagaagataaagctacgaacaaactgataggcatagagatcttcagttcttcagcttcaggtgtttgctcctacagtccttcgggtactggcaagcagtgagtcccttgtagcattcaaagaactcttctcctttgctgacgccatttttttctccgctgtaaaagaaataagatagctttatgaggcaagtgagaggcatccgaaatcatcttgtcattgaacacccaatcatttctcatgagccaaatagcccaagcgcccgcagcgaagcaagcaagccaaatagaatgcgacccttctttgtacaagtttagtttatgtaccagttcgcctctagaattgagaatactatcccaacctagagcatctctataacagcaccacataaacctaggaatggcacatctaaacatcatgtggtccacgtcctcgacttccccacaaaatttacaatttggactaccttcccatttcattttcttcagctggctggcagcttgaattcttcccttcaacattaaccagaagaagattttgacttttaagggaatggaggacctccacaggtcctgcaaaaccctatctttaacccctccaaaacatagggcctggtaaagggatttggtagtataagagcctgtcgatgtttgatgtcgcgattccggtatttgcatagtatggggatcgttggtactatgatatacgtgaggctgaggtaaaagagacggagacagggatttttatacaggttcgggcccctgaattgtcaggtaataacccaacatcctgttggccgaagccggtattactcttattcaccataatcacactagtacaatatttgggataacctatcaaactgttgtcgatatggcggtgtgaaggtctgactcgtagtcgataacagtgtagccttcctcctcgaatccgcatccggcgagatcagagacagcgctatatctctcctgctgacagtatccgtaggcaccgtaagggactagccatgcctatctctgaagtcgatatctggcgtcttgtcttggcgtatgtcaacttgtatgttgtggcttctgttgttccatgtatgttgtggtgggtgtcttccatggtgggtgtgtcctctctcctcttagggggtcttgtatttatacccataggtgtccccttgtccaagtagaactagggaaaccaatatgaatacaatctaagtagtccttgtcgtttccatgtaaaactctggttatcttttcttatccggaactcctcctatatctgtaggttgcttccgtataggacatggtatgtagtgggtcctaccgagatttagtcaactactattaggtatgtgatatccataaccctgacagagccagacttatcagcttccaaaacatttgatctttatcacctgaaagatgaatctcccctacaaattatgtagttcttcccattcctccatctcc

SEQ ID NO: 56425 - DNA, 5075 bp, Oryza sativa
tgcgacgacgtgcagtctcacaaggactggatcaaggacatcgaggcctacaaggtcattttaattaccttcctggcctagttaaatttgtgtgaaaacgtagtaactaattaactagatcgatcgtaataatatatatttttttggttatagcctgggaaccgcgtgacgtacccgatcatggccgatccgagccgcgaggccatcaagcagctgaacatggtcgacccggacgagaaggattccaacggcggccacctcccgtcccgcgcgctgcacatcgtcggccccgacaagaaggtgaagctgagcttcctgtacccggcgtgcgtggggcggaacatggatgaggtggtgcgtgcggtcgacgcgctgcagacggcggcgaagcacgcggtggcgacgccggtgaactggaagcccggcgagcgcgtcgtcatccctcccggcgtctccgacgacgaggcgaaggagaagttcccccaggggttcgacaccgccgacctgccgtccggcaagggctacctccgcttcaccaaggtcggctagatcatatcgatatcgacctcgctcttcgtacatcatgtgcgccacgcgtgcgtgatagcgtgtgctggcgtgatgactatgcgagatgcatccctgtgtgtgttggtgtggataatgccgctacgtttggaacagtagtgcatttactctgtgctactgtctgaactttggctgtttggcagactgtttatgtacccgtatgttcgcccctgtactaatagagtgggtgttgtggttggcaagtactctcctcggacaacattttaactttgactactaataacaaacaaattaaaaagatcaatcagatgttactagacatcttaattttattaattttatagatattgatattgtttgttcaaagtaacatcgtaaagttctaaaatgtttatatttgggacggaattaaaacatcttaattttataaatattgatcaaaatagcatcaaagttctaaaatgaagccatcatttagtatatttcgttaatgaaatttagtatatattgttaataaaatttttatatacgtcttcttagtaattaaagagctttacaaaacaaacttccataaaaaacccctaaaacaaacttcgataaaaatttttatatacgtcttcttagtaattaaagagctttacaaaacaaacttccataaaaaacctctaaaacaaacttcgataaaaaaacccctcgaagataaaaaaagaccctcaaaattaatttgaggttaaaaattaggctaaaaataaacttgataaaaaaaccacccctcgaagataaaaaaagaccctcaaaattaatttgaggttaaaaattaggctaaaaataaacttgataaaaaaaaccttaaaattacttttaaaatgatttatattcatgatttatattctagtacggagaggattctagtacggagagggtgggtgcatacatgcacattccaatgtaaccaaagaatgagaacaaatgattaaaataataataaaacagcgtacacgaaaaagagaaaaaaaaggacgaagagattttagtgagacgtacgcgcaaaattctcagtcgaatccggccgtaaactctccataggaaaagggtcgacaataggtaatcacccaaaccaagtggttaacgaactaatcaggttggcattgcaacgtcatcgatgatgaaatcaaacgccgccttttagtattttatagtaggagggtcagcctcttctttggaaaaaaaactgtgatactacgaggaagcaatcgtccgttggcatcgctcgcgtggttagttgtcaggtcgctccgcttcattctgctgtgcattttggcgagtgcctagacagatccgtgatgaacagtatatgaaattttccacactttggcctggtttagttcctaaatttttcttcaaactttcaactttttcatcacatcaaaactttcctacacacaaacttccaacatttccgtcacattgtttcaatttcaatcaaacttttaattttagcgtgaaataaacacaccctttgattacggtttagtcagaacatttgcgaattgcaatgcgcgcgggtgaaacacctttatcagacgcgatcgggaattcaggatcgggaacagctgcgtgccgtgcagaataatacttcgtattacagaaagtttagaatccgtattacgcgagagcagagtcgatgcagtgtgttttgagtaggggtgtgaacgcagctgaacagcaagcagagttggcagattcgaattcttgtcccgtaaatttttccttgccttatcctacacccaggcctagatgcttgctttttataatcctctagtggcaacacagcctcacctataaatgctgtgactgatgataagtccagtgcattccatcacagacagttcgcagaatcgcagcagcttagcttaattacttttttcaccaactcaactttcagttaatttccggttaatcctcgattcctcatcatgcctggactcaccctcggcgacgtcgtccccgacctggagctcgacaccacccacggcaagatccgcctccacgacttcgtcggcgacgcctacgtcatcatcttctcccaccccggtatatatagtgtactactgcattactgtcgtactgcgtgtgtccgtgcagcagacgagcttgagaagttgagatgttgatcaaatccgtgcgtgcatttcagctgacttcacgccggtctgcacgacggagctgtcggagatggcgggctacgccggcgagttcgacaagaggggcgtcaagctcctcggcttctcctgcgacgacgtcgagtcgcacaaggactggatcaaggacatcgaggcctacaaggtatgtacacgatcgagttcatcgcattcatcaatccttgactgattgatacatttgcagagtcgtatctgattataatttcttggttcaatttgtgatcgatggttgctttagcctggccgccgcgtcggcttcccgatcgtcgccgacccggacagggaggcgatcaggcagctcaacatgatcgacgccgacgagaaggacaccgccggcggcgagctccccaaccgggcgctccacatcgtcgggccggacaagaaggtgaagctgagcttcctgttcccggcgtgcacggggcggaacatggcggaggtgctgcgcgcgacggacgcgctgctgacggcggcgaggcaccgggtggcgacgccggtgaactggaagcccggcgagcgcgtcgtcatcccccccggcgtctccgacgaggaggccaaggcgaggttcccggccgggttcgagaccgcccagctgccctccaacaagtgctacctccgcttcacccaggtggactgagagactgatggtgagggagggagggagagatctgggccgtcggtttcgtgtgtaataaaccaacgcacgacgtagatgcttccacgtgtgtgtttcccgtgctgcttcgattgatcgatcgatcattcggtaagtactctagttatgtgtaatctgctgtttgggtgtagtggtgcatttgctgttctgttgcctgaaagtgacgaacggattatgtttgtcatttgtatgtaaaatgtaaccgtatgttttttatttatcccttccgaaattactgtggaatatagtgaagtaatgctgttaataaacagcccgtttaaatatgttttgtccgtgatgggttgggcgtttgagatgaaacccatcaagagtggtccggtacagttcatttaactaatgggccaaaattctcggccttacaaagattgtaccttacaaagtccgtgatgtactgaaggaataagttcactactttagattcttcagcgtcaaaaaaaaaaaaactactttagattccttagttcgtagccggtctgaaattacgcgtctctcaactttttaaaacaaatgcaaataaagtttcaaggtggtttagatgacggtttcggctaacatgacgcttacgtggttggcttgacttgatcctcgtcctatgtggcggtgacgtggcattagaagaaaaattaaaatgtagggctcacatgtcaccaaataaagataaagaaatagtggaacccacctatcaataggtcccacactcctctccatctccagcgaacaacgacgcttcaacacctcctcccccttctctcttctgtccctcctggccttctctcctcctccccgagctctcttgccagccggctgccgccgttgatgtccatagtcggtggtggatccagaaaattagttcgttggtatcgtaacatgtttagcagtgttatagtgtgttaactatatttagattataagttataatatatagataaacagtctaagtatatttttttttctgaaagtcgcctgacaccagtccatacgcatgtcactgaaattgggcttggagctcagttacagggctcgcagttcatcggcaaccagattagcaatcttcaggatttcactgacagagaacatcaatactattttttttattatattatgtatgggctagtatatatgcattgaaatttgacagtgaggcaaccaatggaatgcttcctttcaagaaaagaaaagggattgcaacctacagggaatctcagtcatgagagcgagtcgatcttaatgcatgcggcatgccaaaacaaagcggatttttgccgaccattatattcagctccacaaagataaatggaaattaatcctattatatcataacaactaattcattgctgatcttaaccatgccctccgaggaatttggcgtgtgctttgggctaatttggcgaggtaatacggtagtatagcacggttatagccaagctgacatgcatggcgtccttccagtcgccggctggcatcaccggcttgtgccgaatcattagcattgctgtgtctttcgtgcatgtggtgttggatcatcttattatggcatgccaatggcagtgatcgcactgttctctactgggcttacgccatgagcctcgatcgtgctcctacaatataat

SEQ ID NO: 56426 - DNA, 2629 bp, Oryza sativa
acattgttcctacaaatcaaaggggccctaaagatttcaatattgaaatgatgttggtaagttatcaatggacctccacgaccccttgaacgacccctagcagtaattgtatctgacatatctgcagtggcgtagctagctatgtggcactgtggtccatggaccatctaaaaatttgatcgagattaaaactgtagtatatgtgtgagttaatataataaaaattatatagtaggccacccatttaattgatctattacatatagatagaccacttttactctaaattctagctacgccactgcatatctggtacaataatattattatactcagaggttggtttagtttaggaaatattcccttttccgccatctcctataaattaataagcatgcacaactcgagccccacatctcctataaattagtaagcatgcgcaactcgagctccacatcacagctaataaaagctgcagctaacacgtactgttttgcatgcgcgcgcttagcttaattctcacgagctgatcgatcacaggttattcaattagttaagttcagctacttaattagctagctccattacactgcaagctaggcccagatcgatggcagcttggtccatggcgtctctgatgatcgtcgccgccatcttcctgctcagcctcacctcggcgagcgtcgtgcatggccggagcagcaggaggagcttcttctccagctacgacgagccgtgcatggagatgaggctgtacctccacgacatcatctacgactacagtaacagcacctccaactccacgtcggcggcggccaccaagccgacgccgctgagcaccgccgtgtccaaccccggctacttcttcggcgagatggtggtgttcaacgaccccatgacggaggggagggcgctgccgccgtcgccggcgatggaggaggagacggcagtgcgcgcgcagggggtctacctctacgacaagaaggaggcgcccaacgcgtggttcgccttctccgtggtgttcaactccacggggcgccgcggcacgctcaacctgatgggcgccgacctcatgtcggagaagacgagggacctctccgtcgtgggtggcaccggcgacttcttcatgtcccgcggcgtcgccacgctcagcaccgacgaggcctcggcggacttgtcatacttccgggtgaaggtggacatcaagctctacgaatgctacgtctgatcccatgcatacgtacgcttgctctttcatggccgtggatcggatcatcgcgtgtcctaaatatgcgcttgtatttgtgtgattgtgtgtgttgaatttccttcttgacattcatcatctttgcgtgacgagtcatatgcacggagaaatgtgcaaaatgtgttttttttttcgtgttttggatttgcatctcatgtattgtttgagtgacgagtcagcgatcggcttggcgtggtggtttgttttgtctttctttttcctggttataatcttcatagttataatcttataattttttttctacatcaatataaaatcttgtattatctggtgtagtttgttaaaaatacttgcctttttcaatcaattgtcatagatgtgaccggacgtcgaatgacagttattcgcttggatgtcttcgcgagtgacggttgaaagtcggttatgccatgggctagatcatctaaccactggaagtgacctggctgccaatcaagagtgggcccagtacagtgcatttaactaatgggctaaatgacgtccttcatgggtatcttttatgtgttcttttggcgttagggtagcatcgcggtgaagtcgaagctgctgtgtcgtttgggtggcaagctcggcaacgataacatgcgtgggctatttgtaggggtgggtgttcggtcagaccgaaaaattcggtctcggtcttcggtttttcggtcagttcggtctttgcaaactcaggaccgaatttcatccaaaaaaactcaggaccggcaaattcggtctcggtcttttcgatctcggtctcggtctgaccgaaattttttaggagaaagtttggaacgaaaaaatttgacagaggcgtcgccggcgcggtggagggcggaggcgtcggctgcggcgcggtggaggacggtgtcggccgcgttgcggtggaggacggcggcgtcggccgcggggtggtggaggacggcggcggcggccgcagccgcggcgcggtggaaggcggaggcggcggtggcgacgcggtggaggctggaggaggaggcggcgcggttggggcggagccggcggtgggggctggaggaggaggcggcgtggtggggttagaggaggaggcggcgctgtgcggcagtagtggtagggttttttttatgggcttattggacttcctaggcctattgggccaaaatttctgtcatttcggttaattcggttaactgagcccaataaccgaaatgaccgaaataaattcggtcttttgagggctgagactgaaaaggttaccgaatttctcggtctcggtattttcggtctcggtctcggtcttttcggttcggtctaaatatgcccacccctagctatttgtgtcaccacggcgatgccttgtgtcgggctccattg

SEQ ID NO: 56427 - DNA, 1875 bp, Oryza sativa
agcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgaatctctcctcctcttgcacacaattagcaatgagcttctcaaagttccatttctctggacttatgttgtagttgacaataaaattgtcaaactactttggcaatgaggccataaccagatggaccagaaagtcatctgttatgcccaaatccattggcttcaacttggaagccatgttgctcattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaagttcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacatacttaatgttcctaaaattaaattctcccgttggttcgaaatttaattttagaaacactgattttcatcaattacatctatttgcagcggaaaactatataaaaatcatatgaacagtagcaaaatctctgtaattctctctctgtgaaaattctcccgttggttcaaatttaaacagaggtaaaacatgcaaaaaactattcaaaattctattgaaatttgcatgaaaattgacaaaataaaatggaaaattgctactgttctcttttattcattttcggcccccgagggacctaatttgaacttttgccggcggccaacggcccttttggcatgggcgggcgccccctttccccaagccgcaacctgggcctgggccaggaaaaccgccccccgcgcgcgccttcttgggccgatttcggcccggccggcgtcgaccgtccgatcagctagggtttcgatcggacggccgggcgccgagatcggaggatcaaaacccccctctcccggccggccgccgaaaaaccctagcttctcttctcttctctctctcacgcgaccgcgtggacggcgtcgccatcgccggcgaccttcgcgccgccgcgccatggccggcgctcctttcttttctcttcttctccgctcccccaccgtctctaacccccaccgtgtgagaga

SEQ ID NO: 56428 - DNA, 7791 bp, Oryza sativa
ctgcagcccatacatctagtaaaaggtcttggagtagaaaacgataatcatatttgcatatggatctcttagaggaacagccatgaaaattgattttcacatacggttgtaggaccgtctacaaaattgacgatataaatgttggagacgttgaactaaaataataagcgatatctctttcttgatcaagaaactcaatttgaggggtttttttatataccggtaaatattcgctaccgtattcgttccgtctcgtattcgctccgtatctgtattcgataatattcgatttcatttccgtatccgagttttcgatttcgattccgattccgaaaaaaatatgaaaacgaatatgataaagctagtttccgtccgtttccgatccattttcatccctatgtacggccggaagcgcggcgaggtcgaggctggcgtggcagtcgtccaagcccccttacggcgagcagcgagagcgcgctgagcaccacgagtagagtgttcaaaaattagtggagtgaataaagtctatggaattatatatttaaatatgaagggggtaattttctcggtccaccaaatatgttataactcatgcggattcacggaagaaaatatgttatcaccatcatgttgtgttcaacattgttatcgagcgatgatacgtaacgtgcatgaggttgcttggttcagttaatcttttttcccttaaagaagcgtgtttaaattctgccgcacacacaacagcatcaacgcaagatgtcaggccttcatgcttaaccaggtgcgtgacaaactaacaatcaataataatctcattaaaaagggaaatatttatcgataatagtctcataaaaaacttgctgaaattccaatattggtacaagcagaattacaacaaagggtgcaacaaaagaatggcaaaattaaactaactaattaaacctttaatcggtggaaaatgtatgacaaacaaaaatcacgagcttattctgaccaacaacatccccgtcgtcggagatgtggattaactgtgatcattagccggtgatcaatggcggctagttgacgaggcggcagttcttcctgatctcgccattggcgctggtcttgattccaatgccgcccatcttcaccatcgccgccgcgaacttgctctcccaccggccgggaatgaccacgttgaggaacacgctgaaccccgtctccgacgaccggagcgccgcgtccgacgtgaagagcacgtcgcggctgagcacgttccggtagtactggttgtccagcttgtcgggggttttgaggtcctgcaccaccgtggggtcgccggtgcggttgcacgcccgcgtcaggttggccttgagcgcggcgtccatgtcggaggtggtggaggcgaggcggtcggagaaggaggagcagtgggagacgccgatggagtgcgcgccggagagcgtgaccatgtcgtcggtgtcaagccccttggcggcgaacatctgcttgagccggtcgacgccggcgaacggcggcggaaggttggggagcgtctcgctggcgagggagacgcgcccgtcgtagcgccccgccggcatgtcgaagtagaccttgttgccggagaggaggtacgcggcgtcgcgcccggcgaaggcgacgacgtcggcgcaggagacgacgccggggcactccccctcgagcgccgccttggccgcgtcgatcacctcgaagccgcgcaggctcaggttcgggatgccggccttctccggcgccgcggcgctcgccggcgtagggtcgaggaggacggaggcgtcgcagccctggacgaagcagtcgtggaagaagaggcggatgagcccggcgccgacgccgcggtcgccgcggccgccgcggatggcgttcttgacggcgtccctcacgatctcctccgcgcggtcgcacgtgcccttgtagtgcccgaccgtgagacctccggcgatcgagcccggactggtatagccatcgccattgctgctgccgagcaacgcgagcaagacgaagacgacgagcttattagcagccatggatgccatagctagcttaattacaagctttatcacaactactccgtgttaattcaagtgttagtgtgatggaagctgctgttctgtgagtctatttatagcatggagatcgatgaatcgatcagaatatgtgcatgcatgcattggagggaatgtttgtgtgtataattaattaagaaattctaatcatttttagcagcttgattatcaaccggcagaacatgggagcacgatttgcagttatagatcatcgatcgaacaggatcgagctatacagaagttgacattgccggggtcaacggctaatatagctccgacaatggatatgttcgaacgggcgtctagattaggggtatttagttgggttgttctgacggcgttttgcgaggaaaaataactcgtttctgaagatctccggtcgatattgtctgcttcttgcacgtttggtttgacatcatgaaggtacgtataatcgtggctttcagctgttgggaggctggagacaaaaatgatactgcgtcccttcttattttggcggctgcatgctatgtaatcatgcgtgtactatactagtactccctatttatctaaaaatattttcctggctattttgtttcctctctagaatatttgcccgacaagaagatgataccagtgctgcatcgatcgatcggcgcgtttagtaatggcgtgtaatgtacaaatctggtgtttttttaaaaaaaattacacaccataaacacatacacactcacaacgcacaacacacactcaccccctataaacgcacgcacgtaaattctacccctataagcatatttgaagactgttgtctccgtgatgggttgggccaggcctttaatgaaagcccgtcaagagcagatctgagcccacataactaattatatgccacaaattcctaacccaaaaaaaatgagctgcacggaggtcggattcccgctccgacccagccaagccgcacgttccggtttacgccgttctccggtcaaagggatgtgaatttgatttgacattcagagtttcagagtttaatttgggattctggtagatcctcccttctctgatcgagtcacctacaacgtcatcgatcgagcagctcatgttaacgctatagctatgacttgtgcagaatgcaagcacacactagctagctaacactaattaagctagctttgggtattcgatcgatcattcgatctgctcgccacgttcaccggacggttgaccctgcacacaccacaccaccaccaccacaacgtgcgcgccaaaaacattcccaagcagcagtacgtactgtgtacggcgtgtcggcgtgcgtccccggccgccgtccggtgactataaatagccatgcaacccagcatctcctcttcatccctctcttgccactcttgagctcactgctcagtatagctagctactacgggagtggattttcaccctcgagaagacatcctcttgtttgcatgtcaacccatatagtgatgaaaaattttgaaaacaattgagaagatatattaacatgtgatatatcactccacaaacatacaagttcaaattcaacttctacatctcgtaacgaaaaaacaattaactacaactagttatcatatattaacagtcaaatttgtttttttcgttgtgaggtgtagaagttgaatttgaatttgcatgtttgcagagtgatatatcatatgttaatacatcttcttaatttttttcataatcatttgggtgacatgcaaacaatgaggggaggctaagctcgacgtcgtcctcaccttgctcgtgctgctcgcctccgtcgcgtgccaaaccggcggctatcccctcgagggatgaaaatagtttcccgctaccatggctaagctcgtcgtcgtcctcaccttgctcgcgctgctcgcctccgttgcgtgccaaaccggcggctatggctacggtggtggcagcccgactccaccgtcgacatggtcgcgctctccggcacgcactccatcggccgctcccagtgctcctccttcgccgaccgcgtcccgccgcccagtggcaccaccacctccggctccgacatggacgccgacctcgtcgcgtccctgcggcggcagtgcacgacgccgagcgacacggtggcgcaagacgccgtgacgcccgacgcgctggacaaccagtactacaagcaggggcggatccagcatgggggcggcggggtctcgagcccccactactgacgtgaagactatgagagcccccacgaagaccccactaaaattttttatcatatgtagataggagggggactgtaactctatctagtttactcaaatcccattgctatttatttctagattcgtcactggtctacaagaacgtgatgagccagcatgtgctgttcagatcggacgcggcgctgatgacggcggcggacaccatggggctcgtcctcgccagcgcctacttccccgggtggtggaacgccaagttcgcggaggcgaatttctcaatacctgtgaactacagacatgaactactaacggcgttttgcaagggttgataactcgtttctgaagatctccggtcaatattgtctgcttctagcatgtttgacactaagaaattaatggcttcaggaagctcgagaaacaaatgatttttttaacgtgcatctatagtgtcaatttcttttcgatatagcaggatcaaaaagattggacaagtaagagaagaactgtacaaaggaaaaaatagttaagatatgtgagctcagaatcattttgctcctgatagagcctaatttttggcctctttccttatctttgacacaaggactatctttgagagctttatgcttttggcggcttctatttcagctgttgcgaccgctatcatcgggtacgtcatctaccatcgaaaaaataattagcagtaaatacaaacacccgtgtcgtgtcaaatctaaaatttaaatctaggtgggctggttttaccataagtaatataatcagttcagctacgctcatttcatgttaaattttgcaaacacacaaccaacaataatctcattaaaaagggaagtacttatcaataataatctcattaaaacttgctgaaattccaatattagatacatgcagaattacaacaaaagaatggcaaaattaaactaactaattaaacctttaatcggtggaaaatatatgacaaacaaaaatcacgagcttattctgtgacgtgaactgtgatcattagccgatgatcaatggcggctagttgacgaggcggcagttcttcctgatctcgccattggcgctggtcttgattccaataccgcccatcttcaccatcgccgccgcgaacttgctctcccaccggccggggatgaccacgttcaggaacacgctgaaccccgtctccgacgaccggagcgccgcgtccgacgtgaagagcacgtcgcggctgagcacgttccggtagtactggttgtccagcttgtcgggggttttgaggtcctgcaccaccgtggggtcgccggtgcggttgcacgcccgcgtcaggttggccttgagcgcggcgtccatgtcggaggtggtggaggcgaggcggtcggagaaggaggagcagtgggagacgccgatggagtgcgcgccggagagggtgaccatgtcgtcggcgtcgagccccttgtcggcgaagttcttcttgagctggtcgagcccggcgaacggcgacggcaggttggtgagggtctcgtcggcgagggagacgcgcccgtcgtagcggccggccggcatggcgaagtcgatgttggcgttgctgaggaagtaggcggcgtcgcggccggcgaaggcgacgacgtcggcgcaggagacgacgccggggcacgcgctctcgagcgccgccttcgccgcgtcgatcacctcgaagccgcggaggctggggaagttgggcacgccgagcttctccggccgcgagttcgccgtcgtcgggtcgagcagaacggaggcgtcgcagccctgatcaatcgaaaggagacaatacacagccacattaatcacgtggattactaactaattattaatcacgtgttttaattgtcgaaactagatttcggcaataataaaagggggtggctatcaagctcggaaagtgtatgggtttggagacaaaggatttatacaggttcaggccttcttataaaagaagtaataccctactcctgtccggggatgaatccgccgagtgtattattgattgtatgattcgggaaaaatcagcatatatccctagaggcgcccggaccccctttatatactggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccagttcgaataccatcgccgtgtagatatgggatacccataatctccacagtagcccccgagtcctttgcagtcgaccatcatagtcttctcaaagataataatccgagtacttcaaactcttcaagccaaaatctgccgagtggactgtaaagggcgaaaaaaataaagaatatggtgcatcgaatagatgcacctaattaggtgtagcccccaactatgtgattagttaataaactaaacatatagttgaaagacaaaataataacacaattgtgcattatatgacaaaagcatacgcggcgcctaaataggcatactagccgactgctttttagccaccataaaagaaatccgagtggtttacactctaaaaggttcacgaatgaacacacttgacaggcatccgaataaaaaaattctaaagattacccatcaagtattataaagattatggtaataaataagtcaaatagcctaggccatgactatttaccatgaaaataggcatataacacgccaaggaaatgactataataaaaacaagtcattcctagttaacccaaacagcttttgtagcctaaaaaagcttgcaaaaacagcatgacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaagtattgggctgaagtactgtgcaggcctaggcccattagcacctccgatacccttaactgaaaaatcctatatccaagcgacgcttcgtcttccccgccggaactctcgccattttccccactccttgctacagtgaaaagctgcgccggcgaactagggttcacaactccggccaaatccacctccgaaaaacgcatcaaaatccttcccgtgatccaccgcctcaattcctcacctctcccaagccatccctcgaatcaaaccagcacatttgagaaaaatcgatggcggaagagagagaaagctttgaaggccaatgggcggcgtccgatgtgacagaggagaatctgaaggagatggtggcgcacggtgttctcccagccaaagagatcatcgggtggcggccagcgtacggtgaggcatttccatctccagatacgcatgaaattgtagtcttctcgcattt

SEQ ID NO: 56429 - DNA, 1926 bp, Oryza sativa
actagcgccaatcaaggaaagatctcgcacggcattcgagtttgacggcaagtatgatcctaaccgtgaagaatcagactctctggatttcagaatcatgaaggagaggatgtataaaatcttctcaaatgcaatcgtcgtcagctactcacaccagctgccagtcgtgccatacaatgcattcaatccgcctccgcaggtatgtattggaaatcctcaaaccatgatcagaacataattttgtcttcatgctgagttgactaactatggaagcatcttgttcaggaatatacactgatgaagtcagatccaccagtcactcagcgccggtctcctcgtcaacataccgctcagggaggtggagggccaacgatcagaccggatccgcaacctcagacctccaaatcaactggtcagacgggtcctcgcaagaggaaactggtgcttgatgacgatgaaggcgacgatgataaatctggggataagggctcgcctaataaacccccaaaacgcaccatgcccaggaaaaaactggccggccgcgcaatgccaaaaattagaacatcttccaggtataagacctctcggtatgatttcactttggtaagctctctcatgagaatgatgctaaattctgaaagaatactttgcaggaaaccatctgatatagatccatctggaaaagaccccgatccagccatggcagagcaaaatatatccaaagaccccgagccaactgccgaaagccagccgactgccaaaagccagccgaccggcgcccatgcttcgggtgaccaggccaatccgagtgaccagccgccgactggaaaccagtcggcaacaactgaagcagcaacaactcaagagcccccgactggaaaccagtcggacgcaggccctgatcaagaaatccctgaagtagaagcgcagacgacagcttcccaagggccagaagctggtaatgactcaatagctggatctccaggcaaagaacaaagatcacctcacgctcagctaggtacatctccaggttattgtcttctcatacaacggtgatttaaataacctcagcgtatccgtctaatgtcttggaaacacatcaggaccatcaggtgatgacggagaagaaatccctcgcataaaggcgaccgacgactctcgtcctcctatcttgatcaaatggtgggacgagaactcacaagccgccggtatagtcataaaccgtcaaaaagaagatgaagaagtgtgccagctgaagaaagcgcttggagaggccactcgtattgtaaatgtaagtcttccgagcgacagccttcagtaactttgttttctttttagcagaactgaaccatgatccatcgtgcagagaatccatcttcgcaatgaggccaagaccacaactttggaaaagctggttcctcatttgggaactctagaagcagttagggaccagctgcatgagaccaaggagcttgccaagaagacggagaaagaattaagggaccgaatcgctcagctccaagagtcaaattatgagctgagtggttcatccaaaggtaatctctagatcagtttcatcagttcaaactggcataactatatcctcaaccatctgaatttcaaaacagcgcaagccgccaggatggaacagatggcaaagcaaattgaagccctggagagagataagacagaactggctgcgcaaagggactcagccttgaaggaagtcgaaggtaacgccagccaacaatctgagcttctctccttataatgcaacagatgctcatcataaatgtgttttgtagatcgcaagatcaaatctcaagctcagtttgacgtcctggttggtaagatcaagaggcttgaaggagcaagggatgatgtcgccaatgccgctgcaccaattatccaagccatgttcctcaa

SEQ ID NO: 56430 - DNA, 2795 bp, Oryza sativa
cgatctcgtgtggtttgaattttccgtagaaccaggtcgccgattagaaaggcacgagatcgaacattgcgattatgataacgtcgcaacccttgtaagtaccgagctgactgaatcaaagctgcttcgcggacttcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcatagggtttaagccggtcaaaaactcgagctttaatcccttgaagtatcatgccgttggccctctccacctgtccattgctcattgggtgcgctacggaggcataacaaatctttattccaaaatcttcacaaaagtctttgaaaactccgccggtgaattgtgtgccattatcagtgattatccgattgggcaccccaaatctatgcacaatgttgatgaagaagtctcgagcattatctgctgtaatcgtgacaacaggcttagcttcgatccacttggaaaatttgtcgatggccacgaagaggtgcgtgtaaccgccgactgcctttttaaacgggccaaccatgtcgagcccccaaaccgcaaacggccaagacagcgggatagtttgcaactcttgagctggtaagtgaatttgtctggcgaaaaattggcaaccttcacatgtgcgcacaattttgtcggcgtcggacactgcagtaggccagaaaaaaccctgccggtaagctttgccgacaatggtgcgcgcagcagcgtggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatctttatcttgagggagctcttgagaagttaaaaatcgtatgaagggctctcgccagtcggcttcaaccatagcgacatcatgggtgcccgtaatttgagtggcatctttgtgaggtaccgtcggcgtataaatgtgttcgacaaaaacatcagagggcgccgcctcgcgcttggatccaaagttcgcaagtctatcggcagcttcattgttgtgtcgaagaacatggctgagctcaagtccatcgaacttatcctccagtttgcgtacctcttgtcgatatgccatcatgttgtcgtcaatgcaagaccactctttcataacttggttgacaaccagttgtgaatcacctcgaacgattagacgctttatccctagggaaattgcaatccgtagcccatgaaggagcgcctcatactcggcgacgttgtgggacgccgaaaaatgtatccaaagcacataacttagtctttctcagtcggggaaattaaaaccactccagctcagtgcctgaaagtctttttgacccgtcaaaatgcatggtccagtgctctattttctccacgggggtatcctcttggcactcggtccactcggcgacaaaatcggctaacgcttgagacttgattgaagtgcggggcttgaatgatatgtccaaagacatcaactccaaagcccacttagcaatccgcccatttgcttcgcggttgtgtagtacgtcgccgagtgggaatgatgtgaccaccgttaccgagtgaccttgaaagtaatgagacagcttcctggtagtaattaaaataccatataacagcttctgaacctgagggtacctcgttttggagtcgggcaggacctcgctgacgaagtagattggtcgctgaactttctggacatggccttcttcctcacgctcgacaaccaagactgtgctcacgacctgggaggtggctgatacatacagcaacaacggctccttgggatgtggtgaggctaataccggggggcttggtgaggagttgtttgaaatcttcaaggccttctgtgcttcaggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaagccaagcagcttccctgacggtactccgaaggtgcacttttcagggttcaatttcattctgaaggcgcggatgctcgcgaaggtttcttctagatccaagatcagatcatccttttgcttggtcttgacgactacgtcatccacataggcttcaacgttgcggccgatctgtgttgaaaagcatctctggatcatgcgttgataggttgctcctgcgttttttaatccaaacggcatggtgacgtagcagtatgccccaaaaggcgtgatgaatgaagtcttcaagcagtcggattccttcagtcggatctgatgataccccgagtagcaatccagaaaactgaggagctcgcagccggcggttgagtcaactacctggtcaatgcgaggcaacccggagggatctttagggcaagacttgttgaggtcagtgtaatcaacacacatgcgccattgccctgttttcttccgaactagaaccgggtttgccagccagtcgggatgaa

SEQ ID NO: 56431 - DNA, 2438 bp, Oryza sativa
tctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtcgcggcttcggtttccccactttttgaagtcttggcagcgggcacttctccttcgctcaccgtggttgcagccagtcggatttcctctcgggctagcgccatctcgcgagtttgggccatgtcgcaactctccttgtcgcatgtgacggcttgcttgatgtcgctccgtagggataggactcctcggggactaggcatcttcatcatcatgtaagtgtagtgcgggacggccatgaacttggctaacgccgggcgtccgagtatggcgtggtatgctgtctcgaaatcggcaacttcaaagctgatattctctgtgcggaagttttcccgagtgccaaaagtgaccggaagagtaatctggccgagtggagttgcggataatcctggaattactccatgaaaaggcgcattgcttggttttaactcggagcgagggatctgcatatcatccaaagtcttggcgaagaggatattgagtgcactgccgccatcaatgagggttctgcgaagcttgacattacggaccactgggtctagtaccagggggtaccgccccgggtggaccactcggtcaggatgatccgagcggtcaaacttgattgcgatttctgaccatcgaagatactggggcgtgtcaggttgaacagcattgatctcccgttcagtcaacttctgcttccgtttagattcgtaagccagggggccgccgaagatatggttaagctccttgcggtggtcttgaaatccagccggggtgtcgccgtcatcctgcttccttgacgtgctttgttcttcgtcggagttcttccgagtagacttggtgtactgctccgcgaactgtttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccgaatttgccgaccaattcttcgtggcgaatccctttggtgaatgcggcgatgatgacgtcgtcggtgatgtcggagatcttgttacgttgttcagaaaatcgctgaatgtaatctcgaagagattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatctgctaaagccaccggtaaatagttcgccatggccttgttatctcctcctgctgcgcggattgcgagaccgtagacggtaagccacgattctggattagtggtaccgtcgtacttctctattccagtcggtttgaagccggctggccaatccactcgacgcaggtcgtcggtgaaggctgcaactccgtcaaggtcgtcgtcgcggcgatccggcgagtgatggtagcctcgagctgctcggcgctgtgtgattgtgtcgcgaagatcgatggggcggcgacgaggtggtgagcgaggccgttccactcggcgctccctatgaagttcgggaggcgagtgaacagaccgctcgtcgtggcccctgctcctgcgattggatcctgctccggtgatgctgaggcttggatgacggtagtcatgagatcggaagtgggggacccggctgccagtcggcgtgtggacgctttcggagttaactgggaccgtcgccgcaatcatggtctttgtctggttcaggatgttgacgacgtggtcggatcgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgctgacgtcgatcttcagcctccttcgcgatccgttcacggtcctgctgctcgcgccgtagccgttcttgttcttgtgcttggtgctcctcctccagtcggcgacgctcttcggtctcccgggcttggcgttgctcctccgt

SEQ ID NO: 56432 - DNA, 732 bp, Oryza sativa
gccactagactcatatgtcaaaaacacatgaggcccacatgtcattgacagggtgtggcaaatcattaattgccatgtcataagagtggcaaatagttaaatttcccggaacaccccaaccccacttccctcaccattccattcaccaaagcacagcagcacacaccaaggaaggcctagaaaagagaaaggcaaagaggaccaaaagaaaagaaaagaaagaaagaaaaaacttgaaaaaaaaaagctcaaaagaaagcaagagagaaagcaaccaggcaggcagaggcagaggcagaggcagaggcagtagccctcccttttttttttctctcttctcttctcttctcccaattcacacaagattcactcaccagctgtgccctcccattcccctctgatccaagcctttcactcaaagcttccagcttttccaattgcttggccacttcaagaatcaaggaatatgttcttgttcttggggttcctctgatccgactctccatcttccagcttccaggcttctctctcgttctgtgccatttttgctctgcctgagctctgtgcttgttgcattggtcactccaagaaaaggattttgaaggctggttttattgttcttctgttcctgggatccgaattgcaggcgagctcgctgttcgtgtggaggtttctttctttcattcattcgcttgaagaattcggcaaagccatgcgagcaattcgggatga

SEQ ID NO: 56433 - DNA, 4170 bp, Oryza sativa
  unsure (1)..(4170): unsure at all n locations
cgaaggagattctgtccaagcaggccgtcaagatcgccaccaaggccgaggagcacgagcgcttcatcttcaaggtccgttcctccgatcctttttgctcatctcgcgtcgcttcttgcttaaaaatctttttttttttttgggggggggggggggtgtccatgttctctttattcaaattgtatgcgtaacctgttcattttggcgggcattgatgcaaatgctttaaacgagcgtcagagggggtgtatatttactgtttgggggcatttgggcacaatgtaatgctgtagcttccaatttgtgcatctatttttttaaggagcaatttcggcatttattgacccgtacttgaagtattgcctctgtcctaaaatataacaacttttggctatgaatctggacgcacagttatctagattcatagctaaaaatgcttatattttgggacggagggagtatttactaccaggagaccaagattgcgaacaataattggatggctctggatggatgttcttacatggtgctggctttttaatgtgcaggtcacacacttgctgggtgttcttggatttgggacattttgctacctcctgggtgccagtaagctactgcagcattgatctgttctgttggcgtgttactgcatctcaatgttttggtttgtcactaagaatgctctggttttgtttgcaggaccacaggatgtgccgtatgtgtactgcctgttctatgtcatctttgttccgctccggtggatctactaccgctataagaaatggcattactatctcctggtgagtccaattatttttcagtttttcagagtttactatcctgcaaatgtgggaagtaccggtaaacttgtttccgccaaaatttgtttattttatcttgactgctggctggacaacatgtctaacagtttagctatggttattacaacagggaaggtaattcccgctaggcatttgtagtattgaagataggatattaggaattgccctttacctgatgaatgctatgcttgtgatttttgtgcaattcaacatcatgtttcctggtttactctgcaatgcgagtgttccatttggttagtgaaaattgactctgtttttatgctcttatgatagaagcattacagtttcaagccattgattgtttggtaagtcattaataataatcccctgttttataagcatcgtcatttctctgcaggacttctgttactatgccaacacttttctccttgttatgattctcttctatccaaaggatgaaaagcttttcatggtttgcttctcatttgcagaggtatgggaagttagaagtattcatgttgatttctggtctgcacccatctcgtagcatgtgtgattttttggtttgccatgaattcttgcaggggccgcttgcttgggcattaattgtgtggcgctgcagcttggtttttagctcatttgataaacttgttagtgtcctgattcaccttttgcctggtaagcggtctcacaattcaaagtcccagtttactctctaggaaatgttagttacgtaagtgtggtatcattttagggtagtgaaccacatgatttacttgtttatggaatctcttttactatcatttgcaagtaagatacagaggatttacagcaaaaccttgtagcatattattccaatatggtagctcatgattttttaaactagcacattcatttttagttactaaacttctggtatttttcttattgctgacaatttcatgctctgttctaaataaagggtgttgtggccttgtaaaatgttgtttacaagggaaaggcagtctatccatcgtattaaatttagaggcaattaagcgtgcaaataacctagaaatttagaccgtttggcagttgagcattttctagttgttgtacggtagaaatcctcattttggattacaaaatatagcatggaacatttaattgaagcattctagcaagctgaatttagtcaaacctttcttttttgcttctgccatggacattactggcagctccattctgtatagagtaataatgactagatccttattttgtatcaaatagacatggatacatctcttatttggaattgtaaaacgatatatagttgtggaaaactggaaggccattttgcagtcaaacactataaggtcagatggttgtttgttaattattaaatgttatttacaaggttgctttcatgacaattacaagtggaatccgaaaatttttttagcaacacaaacagtaaaataatcaacatttgttctgaggaatttgacaagcgcgtgaggaacctcctgaaattgttggtaccatggtcactggttgggtaaggtctgcagagtgaagacttgggtgcgggtgtgggtgtgtgccttggggggggggggggtctcanttctcaataactctgaccgggcttgtccctgttgaactatcaagctctgtggcttgttggactaacttaagatttgttgtttgattggcaatgtggtacatggggcccctttatatgtatggatgactgacttgacccttaagaaagtaatcctaatatcatggaaaccagcagcctgattgttatctctaattttttgataaatcttatcacttccttacctaatcttccaaatgggtgccacaaggattgcaagaagtgttggtctacgaccataacagttgacaacctcaagttccagatatgaaacagacctgtctgtactaaatgtattagggttatatgtacttatattctccatccggcgcattttaaaatattttgagtttacatgactgacatactggcaaataatttttacaggcatagttatattcactatccggtggtggaatccacaaacttttgctgcgatgcatccagaaggaagagcagccagagtcacatggccttatgtggaggacaaatcatacctgtggacatggctgtttgctgttcctctagctgcttacaccctgtggcaacttatgtattttctcatagttaatgtgctgcgtcggcaaaggctgttaaaggatcctgaagtcatgacatcatacaggtacatctttgttgttcttggcagtgtacctatgtagtgtggattacattgcttgatatacagtacggtattaatgttgacttaaaagatataaactcatagagctaaaatagctggaattatgaattagagtcgtcgaaaagacgaattgcaatggcaggttgcatggatagttttgcacctggaaccctgtgattggcacactcaatacactaagacccgtaggtaatagttggcccatttccgttcaactaagtgaactaagtttcagttttgaacccctgaaaatgatatttagacccactcccattcaaataatatgggtaaattcacgggcccgtggttgtatccttaaacatttttttagacaatccttgaacaacattgtagtgacatgtgtgcactaccgttttgatctagtttacatttgttctcttagcacaccttttcctaaaagtttctgcccttgatcatttttagctgtgtcttttactgcacaatagtttccaattgttctagcttaacaggttagtttagtaactgttcacagttttaaacagtgtttggtcatgaaagaacatgaagtagcccaataatgtgtgtttcttcatgaatttcttgtagggagctctcaaagaaagcacagaaagcaaacaacatctggtggagactcagcgggcttcttggcgacaggaaccggccactcatgtacatactactccaagcgctgttcacggtggcgacaatggcgcttaccgttcccatattcctgtccttccagatgcatgtggtcttccagatactcaaggtgtgcgcgtcgacatggaacggtggaagcttcatcctggaggtgatgcctaggcaagtcgtccagaaggagaagaagaagctagagatgaagcccatggaagaggctaattcgagccagaatgctgaagaatcacaaggggacctgtcagcaaacggccagcactcatccgagcatagctaagtcactgaaaaaccaaaccatcgcaaacggtagcatttttcagttttcaacagttaatacactgtggatagcttctctgtgtgttgtg

SEQ ID NO: 56434 - DNA, 7528 bp, Oryza sativa
ctgctggaacaactattacatgactagtacgtaatttcgctgaagtacactgcgtttacgtgtttggcttgggtcttgggtcttgggtccttggggctctatatatacctcgtttctccaggccggtaaaaagttcttttctttagcttctggccttctgctgctccgatctactactacttattacgtactcgcatctcaccatgaagccgctatcgcttctgtcagcgctcgccctggcgttccacgcggtcaacacgggcgtcgccgtgtaccgcagccgcgccgacgccgcggccgtggcgctcgtgctcgcgtcctcgctcgcgctcgcgctgctcttcctctgcctgcgcctctacgagggcgcgccccccgccgaggccgcgaggcgccggtggctgcgccgcgccgtctggctgctctccgcggcgctcacggcggcgttcacgcgccgcgtcgcgggcgcaatgccgccagcgggggccgtcctcgtgtgggcgatgagcgcggcgaccgctggcggagggttctacgccctcgtcgtcgtcgacgacggccgcgatctcggcgcaaaatagctaattaataataataataataataataataaatgcatatgatgcgtatatatatgtgacgtgagttacttgctagtcaggcgatccatagaaacaaaataatactactattaaaagggatcaaagtacacaaaatgtgtacgtatgagcacttcacgctcgtgtcgatgttcagctagcccagtggatgcagtacgaaccaataccagcatgctctgctggctatggtgttatacagtgcttgttattgtgattattcgttgagctctatatgtagtgtggttgttgttgattagggatctcaatttgatatcaacaaaggattatatatttatccattgagtgatcgattgatttttctatcaatcattcttctttttttgtttcaatatatagcagtccatacaattttaatttttaaagggatgacatttgttatctcttcctaaaaatagggaaatatttttgtcatctcgcctcaagattgtcctttttgatgaggaactagaattttaaaaaaagtaagatttgcttaatactagccctggggctctgcagaaccaatttttccttgaggactgcaaaaccacagttaattaacaatgaaacccctgtgaaacctttggaaccctgccaattccattatattcgaaaaccaactattataaaaattacaagttgaatgaccgcgaattacaaaattacttaactaatagttgtttctgctcaacagcttaattcttgtcattctcaagctatgtgtagctatggatctaaactctagaatctatagatgacttcattactaaacctgtagtttgtgatattatgccttaagttttagttttaagataattttggtgctaaaatctgtagttttataatatatatagttgcatacgtattttgtgaaatttactcgaaagttctaaaatactacgtagtattttagaatttttgagtatactcactggagatgatttaaactctcacggagatgttttcttgcatgtcatttaaatagttatgaaataattaaaaagatttgataagatagattaatatattatatattgttccacaaacatataagttcaaattcaacatctacaaattgtaacaaaaagaataaattaagctcaagctagtatgcatattatcacacccattttttttatcaattcttagaagttaattttttaagaagaaaacaagttttacatatttgtgacgtgataaaacacatattaatttatcttattgtttttaaaatttttaattatttagataataggcaagaaataggtgtttaaaatccattgtcaactccactaaagaaagaaaaaaatccattgtctgctactatgtgtagtgacgccactttttaggtggagatgatgttaagcaatctgacgtgatcgcagtgcgtaagactgaattctacaggaagttcaccggcacaaactaaagttggtggaagcaacaagcaagtcaaattaacaaatgatccgataataaaccgtgggtacacttatatactaggtgaaacctgcgtgttgctatgagaatttactataataacaataaataaaaataatatgtaaaatagcttaaaaaacttaaggttatctaagttgatgtgatttaaatttaaatggtatataaaatgatgattcgaatggctttctgagagttcactgtgactccgctttgtttgtgtacacggctctgtcgagcatcgttgtccatcaactaattatatatgttggcatactattgaagagttcagttaaattgcgtttccgcttgtcatctaagggtgagtttgaggagagggggattgagaagattggtaagatacgtaaaacgaggtgagtcattagcgcatgattaattgagtattaactattttaaattttaaaaatggattaatatgattttttaaagcaactttcatatagaaaatttttgaaaaaaatacactgtttagtagtttgggaagcgtgcgcgcggaatacgatgtccttttctcacccaatcccccagaactcatcacaacgaaagcagcctaatttttgtttcatcttggaccggacaccatcactataagtacctgcacaatatacatacataagagttattactttagaagacgagtttctaaatcaaaaataatatacatacgacgctgtcgtccaactctagtgtatgaccaatgcaatgatgaaatgcctcacacatgatagatgattcaggtcgtgatgaatctttggttgcgcctgttagttgtgccacgttgtaacacggtcggacatcaatcagacaacagctttggacatcaatcttcaaatgcggcgtctctggcctccgctactagtcgagtcattccttccgatccttccccatccaattcccaatcctaacccttcaaaaactataggtgccgtagctcgtggctctacgacaatagacaccgtaagtcttattcaaaaacttttatgagatatataaaactatatgtatacctaaaaatacattttaacaataaatcaaatgataggaaaagaattaataattacttatttttttaataagacgaacaatcaaacatgtttaaaaaaatcaaacgtgtttaaaaaagtcaatggcgttacatatttagggacagagagagtatctgtgtcaatgtgtgtggtttggggggggggaggggggggtttacttgtagagaccgactgagtaaacattgatttttaggcagtcaattttataaattcaagcaacagcaaacaatctcagccgttggggacaagtgataagaaacttacgaggggaaaagattatcatttcgaatgaaaaggagagatgccagtcaattcttcttagataatgctgggaacaagtcaatagcacacggtaaactaagtctggttaattaattaaggtgacttgtgaactttggttttgtttgcttgctgagcgaaacaatgcagcattaaccctcctctccgggccaactgacgtgatatactgattaaaaagatgtaatctctactgattttacgctcttgcatcggagagattcactaatttactactggccaacagaaataacgcgagacagacacaaaagtgagatgaaatcctactgacaaatattgcttacgttgttacggcgtacgacaaggattttctacacctaggtgccatgacacctatcatttatatatgactcaaatagttatagagaaaattgaaaaaaattagtaacatcgtttgtgatgatacaagtttatgcacaaacatgcatgactcaatttgatctatgaccagagaaacaaaaataataaaatcagaccgtgaatagtacccgcacagtgcagataaaatttattatttttgtttcttcatatatcgatcgaatttagacttgcatgtttgcatagtgtcttatattatcatggactatcttatcaaattttataaaatttttatataactgtttacattacatgcatacacctaggtgccatggcacctagtggtagaaaatactttctgtacgggagctgcaccctgcaccattatcaatgacaacctaagcacaagcgaaattgtccagccatccgaggaagcatttatgcgagaaaaatgctactccttccgtcccaatatataagtatttttagaatagtgccaagtcaaacttttaaattttaactattaatagcaaaaaaatttaaaaagattaatcatgtaaatttgatgtttactatatttatcattaaacgaactattgtagtatacaacttgtcagggttatggataccacatacctaacagtagttgactaaatttcggcaggacccacgtcttatacggaaacaaccttcagatatagaaggagtttcgcataaggaaggatgaatagagttctacatggaaacgacaagggctactcagattgtatccatattggtttccctagttctacttggacaatgggatacctatgggtataaatacaaggcccctaggaggagaggggacacggaacaatagatcaagacacaagatcaacatacaagccaacatgcgccaagacaagccgccggatatcgacatcagagatatgcctggactgaccctatctggtaccttcagtggcctgctgtagggatctagcgctgtctctgatctcgtcgggcacgaattcgaggagaaagactaccttgttgtcgactacgagtcagcacttcagaccgccaagtcaacaacagatagataggctacccgaaatattgtaccggtgtgattacggtgaataagagcaacgactggcttcagccaacaagagtagggttattacctaacaattcaggggcccaaacctatataaaaatcctcgttcccatctcttttattacaatctcgcatatatcctagtaccaacgatctctatactatgcaaataccagaatcgcgacatcaaacgtcgacacaactctttttatttaagatattttacttttattagatattgttggtcaaagtagcatctcggaaaccgtgtccagatccaaaaatgcttatattttaggatggagggagtacacaacttgttttttcatgccatcaaacacgtttaaaacacctaatgctttgtgatgatatcaaatcgccaaccaccttaatctaaaaaactctaaatccagatagcttttgaagattaaaccggctagtggagccaatttagatgaaagataaacatacgtctcgtggatagaacggaaggttttcaggacaaacctacacagagaggattcgcactctcgtggtgaagacgggtagttttcgatgcaaaccagcgaagatggatgaaaactaggctagaactagataaaaagtagatgagatgctgaaaaagtaatttaattggctactgtgttggagtagattgtgtcttaattgaaccaaccatagccattataaaggggttggttttacgttctagaggatcttttttacgtcttactcgggatagaaactaattagaataaaaaaattgtctttccaagaaaaaaaaccaaagaatcaatgtaattcaacttggagtcgaggttagctcgtcttaccgaccatatgccatcggtcagaccagccccaagtcaatggtcaagagccaaatagacgactgcacaggacctacgatttttcggggcccatatgaagatgacgacccaaagtccatttcccacaactataacatgcaaggcaaatcgtcaagcccaggtggccacgcgtacaatactgcaacatcgtcgcattgatcctaattccgtgattgcgtgcgccgtggctgctacgagaatgagacgagattgtcgatcctaattccgcaccgtgttgaccggcgaggcaacaatacagcctgtgactccgagcggcaacggcgatggccctggactctaatcttcgagcagctctacagtatgcagctgcttgctgagctcctggctcctgccctccccctccccctccccctccccctcctcactcttttagtagaacatgactacatgaggtcagcattaccttcttcactcttttattattattatcatatgatatatttcaaaatatggtacattatagcacatattgcatctatataatttaattgaacaaaaacatgttttatttatattagacatgcttttataaaaaaaaattataggccctcaatgtgtatttcaccctagggccccaaattcatggagacgtccctgtcgttggtcggacaggccttacgtgttgaaaaccgagtccttccaaatatcatcatgcttttctatttcatgtctaagtgtcaaatttaaatattaataacaagtacaattgaaaatttcaccactctttaacttgatgctcttttttttttttgccctggctgataataggattataataccaagcaacatattttaaatttagaatatgattttagggatttctatgttactaattttgcaaccaagctctttttaaaaatctaattgccaataagacaagtcggtagccctaaagcactagtagatttgaactagatttgcattataatccaaagcggaaataaggcggcaacttttggtgaaatgcattcaactcattataatcattttttccgccatcgctgattcgcgcgcgcctcctcccagcctttttttttctttttttctaccgtttttttttgttttctttcccacttttttctgatttatttttttaatctttagcatgttttgagtttgaaagtttttaaattttaagttgaaaattttcaaatctgaacttaaaagtttttaaatctcgacttgaaagttttcaaaattttcaaatctagacttgaaagtttttgaatctcgagttgaaagttttcaaatctcaaattgaaagttttcaaattttttcaaatttggacttaaaagttttcgaatctgagttgaaagttttcaaaatttgactttaaaatttaaaacttaaatcgaaagtttttaaatctaacttaaaaaaattttcaatctgttagaaaaaaatctccaaaaaaaagtctccataatctttcctaattactatcattagtgttaagtgtattggctaacagagataattaagacttaagaggggagtgcggagtgcacgcgcttgctaggagcctaggagccccctttttttcccgttcctaattacacaatcatccattgcagcctgaaactccttgaaatttacaacaaattttcatctcgagaaccagtcgatactagtaacacactaagcactgtataaatacggtgattaatacgtacatgtcctagtgatcatcaaaccctgcggcgacgatcagtcggactcctgcaggccggcgaggacgacggagcccacaaaaa

SEQ ID NO: 56435 - DNA, 11994 bp, Oryza sativa
  unsure (1)..(11994): unsure at all n locations
atcatggatgaacacatctccaatttcagtcgagacggggcatggctagcttggttaccttcttctggggagccatggccgtgaccttgaagcgccgcctcctcgcgaacggcggtggcggccgggacaggcaagacgaagagcagcaggtggagattgctgcttggacggcagccatttcttcctcctccccttctctcttctcttcttcctctggcgaagcaagaattcgacgcttctttttgtttcttttttttttaggaaggaagagaggaatcggagtgtggccaatggagagcagcttatctctgggctgggcccatcgtgtgggtgatcaaagcttgagccacagaaaatgccacggtggattggatttcctagtgtaagctgtggagacatctcagccattattcgggcacctttttggaagaagtttaataatttaacacttttttcaattactttaattattttttataaggatgataaatgagaacatctgagtgaatgaaagtggaccaaaatatcaaataatcgaaacccatttacggaggattaaattatattatcaaatctctccttttttttggccgttggttgggtaattgaacggctgagatcagagagtgaaacgaacttgctcgaactctctttctcacgtgtgttcatgggcccaaatcaacagcccaggtgtgtttctggtccggagagtggaggcggcctcgaaagcaagtagatagcccaaagcccaatctaagagggcccataggcccagatcgacgaccacaagacaacccgccgtgcggcccgcctggcagtttgcttttgctccacccaccaccaccgctgcttccaagttccaaccgctccctctctcgtcgctgagctctcctccggtgggcggcgcggcgatggcgggggacccggcggcggcggcagcggcggttggggcgatgaggccgtggaactacgtggtgacggcgcacaagctgacggtcgtcgcccgctcctgcgtcggcaacttcaccgcgcccgatcacctcgacctctcgtaagcgctcgcctcgcttgttcgctcgatcgatcacgcattcaccgcacatgcctgctcctcctcctccgcgggatcgcggcgggcgctagggctttgcggctgcgtgttggtttttttttttttacccgcttaaaccctatttcccccgtcgatgtttgctgtgatgatcgattcgatgctttcgtgctaggttgatcgtactacaccgaggtggaggtgctccccttttttttttgttttttggaatggggcgtgcttgcgatttgcgtcccaatttggacacagtgggttttgtgggaaatttaagagctcccccgtgtatttgttctatttttccttctccatgtattgttgtttggaattctcagttcgtgtagcacactagtcattcacactagtcattcatcagaaatgggcttgtggattcagttgtagtggatgttagcctactcatttattttaaaaaaaattcgtggtactgtgatgatggtgaagcagtaaaacatctgtgagttaataaaacttagattgatgtgttttttctaatatgttttttttgtgtgtatttgacttctatttttctccaaaattttatgtacatccttcatttgtttgggctaaagcttgaccgtacaacaactttcaggaaatttacccgtattgagattggagtatctgcttactcatcagggtcttcaggtcagacagatttgcctcgaccagaatatgttccttctgtttgaacctatctattattatggacagcaaataactgtgccttgttgttagcatcaattgttgaaaaggtgttttttaaggttattcataatggctactgttgttcagataaatgctgatatacttttagttgacaagttagaatttgtcctggcagatcaactggttacatgatattcttacaactataactctgtaagaccttttctttccttaccagcctatgcttgatgcacctgtgtatggtagaattgcaacaattgagctcttccgtccatgtgtaagtttgtactctgtttctacagctaaaaaattgaaagattctccctgccttcagacagtattgttgtaggactgatcttaagatcttatgttttccggtcccatcgttatggcatatttgcaaacgaaaaataatttgtgaataaaacttttatatacgtgtttttagcaatttaaaagcaaaagctgaaaaataaatttcaatgaaaaaaccccaaaatcaactccaaatttgaagttaaaaattcaaattttagttgaaaagcataagcataagcgaaaagataacgctcttcattccttgaatgaacctcaagaattaagattctcttttcatttgtacggaaagatacagatattgtattcttcactgggatgggagtaagtcaaagcttcttacaaggtttgatctctccatcatcacattatttttatatagattgcaattattaaactccatttttatcttaagttccttcctcagtagatattgttaggctgtgtttggaactccaagttaccaacccctctccctcgttttccgcgcgcacgcttttcaaactgctaaacggtgcgttttttaaaaaagtttctatacgaaagttgtttaaaaaattcaaattaatctatttttttaaaaaatattagctgatacttaattaatcacgtgttaatggaccgttccgttttccgtgcggggagattgggttctcaaccctactatccgaacacaacctaaaatatgtatccgtggcaacggtatttttcctgcaatcaaacattcagatggttttaaagtatgcatgtgatagtgacctgactgccagactgacattaaagtccaatctagcccctttagcctctcaaagaattcattggaaccaatcatagacatgcattcattcacttaatctatcaatatatccttgaacgagctatgaatttaacatttttcagggaatacgtaaaaganttgcgcacaccttagcaagttattaggagtgagtagccatgaaaggttttgcttaatttaagtatctattgatctagtgggcagggaaaatgtttcactatgttagttgtagatgaatgtatgatttcaaggttctgcatctttatattaggtattggcatctatcaagttctcaccagacagcagagcaaagtcatcttgcaaatttgtgaacgcttttgtctatttgaatcaggaaaatcggtatgtaatatgcaggtcagggagagatgcttctgaccacattggacgccctacaaacaagggacaggtactgtgttcatgattagaagcatttatttttccacttcgtgttctgtacagttatcagctatgtgtttcttgttaacagacagatgaactcagcagggactataacataacctggatgactgcggttgagatgctcgacgactacgtttatattggcgcggacaattgctataacctgtttaccgtgctcaagcgccgtgttgggaggcttttagtcattgggcagtaccatctgggggacctggtgaacagattccatcaaggcccccttgtgatgcaagatccaggctcagaagtagaccagattcctgccttcatcttcggtgaaagcagaatagactcaacgcaatagattggattgatatcggtgcggagtacatataggcacgaaatctcccttatccactcagccggttcatagaaactgaaccgagagagataaggggaatcggcaaaatagggaaacagagatatacacgagatacaattctaacattcggcacggccagtggcgccatcggtgtcattgcctctcttccacattactccctccgtcccaaaaaagacaaaccttgggtttgaatctggacatgcatcatgttcctcgagaagctgcagcttgtcctcgctgattacatcaagagcgttggcaaccttacccacgcgcagtggcgggcattctgtactgacggcaggagcgtaggtgcggcccagggatttgtggacagtgatctgatcgagtctttccttagcctggagccaagcaagatgggaggaggttgcgcggatggtgtggcttcatgcggacgagctgtgtaagagcatctccaacagcctctccataccactctccaagctaaattttagctgatttgatacaaaaacacactcaaacagaatggctatcccaattgccaaaagttagcaatggccaaacatgggctcgagctagccaaacttggccagcctttggccaccctcagccactgtccatccgtgggcccaccaactttttcctctctctccccaccagccgcaccatccctgcccgtgccctccctccttttgccgcaccgcccttcctcccgatccgctcgtgcctgccgccaccacggggaaggaagctcgccatcgccgtcgcttcgttgccgccggcgagatgggagaccagcagcgggatgatcacctccggctccgggtcggcgccacgggtcaggttgcagaggttgagcgggagcatcgccgaggcggggtggttccgcccgccgccggcaagcttggggagctcgcgggcgaccttgcctgtcctgttgcggcggcagcgcctgtgctagctgagcaccagtaggaggtgaagcagctgcttggggagcaacagcagatcggaaccccatgccgggctgacgcgaaggcgaggaggagaagggagggctcatcgggtcgccggccggtggtggtggtggtgatgcgcggatgaggaggagaggccggccgatgcagcgagcggagcggagggggcggtgcctcgccacgcgcctcctctagatcccgctacgtcatggctgctgaggtcaccctcctctcctcctccggcgactatcgaggaggacgaggccgacgaggagtggatctgtcgttgccatcgccctcttgtccacaggagaggataaagaggggtgtggggaaaatggagaagtacgaggaagaagaagagctgtagaggctgacacgtgtgtcctactgttatagagtcagaatagagagggtgaatggagaagctgttggagtaaacaacgtgtttgacttgctaaattagatggagagttggccaaatagatatttggagagttggatttagaaagactgttggagatgctataaggtagtgaaggcgctgaggaaactgcactgtcatgatcgccgaatagatggcactcatggcagctagattctgatctccatgtgctgctgctgatgtacatacaagactggatggaaaatctgtgcatagctccatcgtcaatcagcactaccaggtgagatgttgaaggtgctatttggtgttttaggcttaactaaacggccacacaagaacacagattttgtaacctcctggttctactggttcaatttttccatgtttagttggatactactccctccgtcctataatataagggattttgggtggatgtgacatattctatccagatttattgtattaagatgtgtcatttctaccaaaaattccttatattatgggacggagggagtactcggtaggaggaaatagagtaattgtcagtagttgcaaatcatacgtcctttgtctgaaaccttttagacaaaggttcagttaggctgcagcatagtgcatcaagatactccgagcatatatgccattgttctggagtgagctagtttggcatcaaagagaaaatgagtgtaattacgcatgcaattcatgtaacgcaactgatcggttattctcagctgtgtgatcatgggaaaaagaaagtgtatcattgtatttcgtcgctgtgtatgctttaccaggacatcggacaaaagtaatgttctcttgcaaacgagactttcgatgaattaaggcattgtctagccgacatgggctccactgctccagatgcccactaaagcctcccgacggaacagaggacaaatgaaagaaacagacgaatggcatctaagaattactaatagatcagtaagatcacaggtgattcttacgcttctttattagcagattaagaaaaaaaacaattatacatcgatactgctttttttcccctaaactttaatgccggaggcacaattattaacagcctcttctaagaggtaccgtataattgtccatagtgacgggcatgagtcactccaagaaagtagtattaataaaataaactaaatacgtagtatttattaaaaattttattttagttgatttttctcaattagaataagacattgctcttttcgcttattcaccagattatttgctctacccttcaaaaaaatatatttttcaaagaaatttcttacagtttattgtttaaatcacttgttttaagatactatttgttaagattatttcttaaattatttaattagctctataataaaatagatgatatgtgacaaataatttacttaatgactaaacgagtaaatttcagaaaaaaaaaccctgtattttatagtcaaaactttatttaaaaaactaggcattaaattggtggcacattaccataatactcttaaagttttataaaaccaaccattctactgttgagtgcaattttttgtaaattttaaaacatagagtatgattattattatttaattgagttcttcacttaaggttctgatcgagcaagactaccttctgaaatttactatcgtttaaatgaaaccagcgtgagttagcgagtagaaatacccacatagtgacccaccccaaattcctaattgctgtcatttctctctcatataattctccttgagcttgtctctggcatccaaggtctagggccccttcttttaagaagagaaaagaggcaagcctgagctggctcttcttaatgagttgctcgcagtcacatgctccatgggtggcgccgtgcaggcaggcagcagggagaagaaggtgattgtgtcctcaggcggcccaagaaggatccaccaccgaatacaccgccatcattctcggccgaacatgccatcatttctggatccaaccgctacgagttggccgccagatttacgctccctgccacgtactccgttgtcccgaaaaatatgttcacgttgattgacttagatgtatcacatcttattttagattgagttattttgaaacgaatagagtaaaactacctaatacgatgtacacggtacatgcatacacggctcattatctgtgaagccacacgggaatcagtcgctccagtgcctttgtccaagatggagctattagatcaaagaaagaaaaaagaaggatggagctagagtagatttttcctttttcttttacgtaagacagaacaaatgcacctatgaagcttacacgcacacaaacactcttaaccgcatacacctcattgtcaacttctcaacagggacgttatctttcaccaaaaaaaaacagttagatgcttaaccacgaacatcttactagtaatgaatacatcgtctatcactaaaaaaataattaactcatatataagtacatcgtctgctattaaaaatataactagtaataaatatgagtatttatgtcaatcgtaggacttaaacatgagtgaacaagttccattaaaaaaaacttaactagctgagctattcttaattcaaattaaactaattaataatgtgttataaaaaatatttaaattggaattgaaaatttagagaaaattttattgtttgaaagtaatttttgtgataaatgcactggtgccatttgcaacaattctttacaaagtttctctctctctctctctctctttttcatagcaactacttccttcgtttcatattataagactttctccacattcatatagatgttaatgaatcaaggcacacatatatgtctagtttcattaacatatgtctagatttatatatatatatatattaatgaatctagactagggatgaaaacggagcggatacggacggataatgctcataccgtattcattttcatattttttaccggatacggaaacaaatacggatagctcgaatacggaaacaaatacggattatctcgaatacgaataagaatcgaatatgaccggacacgaatacggaaacaaatttttctcggaacacgaaaaccaacttaacttctaatagaaacaaatatcaacatatataattagctcactttatattaaatgtagtataatttataaatatttttaaaaatttaaataatatgagtgtggactagtgttaacagataaaccactattaaaatctaaaaatgtatattgaaggtcatatagttataaaaaatggggtatgtctcatagcttctgcggatatccgaattattatccgtatccgacggaaactccgataccatattcgtattcgtatccggaagaaaatatccgtattcgtatccgtatccgaattatccgatccgaaagttatctgtattcgttttttgccggagcagatggaaactatccgctccgttttcatccctaatctagacatatatgtgtgtctagattcattaacatttatatgaatgtgagcaatgctagaaagttttataacctgaaacggagctagtagttgaaaacagatataataatttgtctagaacatcgaacataagtatgttccattaataatgctttaaaatctcaccgtcatgaaatttgaccatttattcctactactatttgtttaggtgggcacattttgcaattatttagcattaattagacatctttttattgacataataccaactcagaatgagacagtcagatctgagtgatgtcacatcgaaggatagtgttaatctgttaattagttatgagatttttaaaatcttagagaaaagctcatgacgaacaatcttaatatccgatgggttttggaacattaacggcagtttttgaagaacgaatttttagcgaagagttttgtagggtttgaaatggagaacgttctatttttaatagatgattgtgatactgtgaaattcttttgaattattcaatacataaggattttagatgaaatttaacatggacctaacctctttttttttccgtgaacacgcaaaagcattgtacgtcaatatattaaaagaaaaaattttgttacacgacacaatcagctagattagcttatgccaagaaaagagaaaaaaaacacaacaaaaaaaaagaagagactactacgatgactaaacacaactccaatcagctggggttaggggggggggcacagagccacactaaccttgtagaaattttcttttggtttatttttctccttaaattatcgtcctatttggtggtctattcaaatcatttatgtgttttgtttcgtttcgtttcataaccctatgctttgcaaatgtcatatgtataagaatcaccttttttccgtttatgtgttttaccatacctactactcacgttaaaagaagccatttaatagcttcggccagcactgtgtcaataccctaaagaactagtcaataccctaaagaactagcgagtcaacgggcttatttggattgttaccctatcaattttttggtagtgccaagttttggcactaccaaatatttggtaagttaagattatttttatcatatttagtttgctaccaacatagagtcaaaatgtgaaattgtagtaaagaatgttctagataatgccaaatctagattaggtattaccaatgaatgggcttcaatccaaatcaaacgcaagtactattcaattaccaaaatattggtagggcatgtttttggtagcaatccaaattggcccaacacttatctttttttacttcgtatcatgtttaggtgtatctgtcgtcagtgtgtttgggaaacggttagtgccacccacaagtaggggtgggcattcggtctaaccgaaaatttctgtctcggtctttggtctttcggtcttttcggtctttgaaaagcgaagaccgaattttagtaaaaaaatgtcaggaccgacaaattcggtctcgatcttttcggtctcggtcctgaccgaaattcaacaatattttcatatatgcaaagaaacaatggaaattttcaacataaaaatcacaaaaaaaattcataagcacttatgagtaaagactcttaataggttgcatgcctagaagaagtaggatgtgaaaattagagtttaatctattaaacatagtggattgtatgttgcatttagacatttttttggtaattcggtcttttcggtctattcggttacccgaggagactaaccgaattgaccgaacaaaattcggtctttcactacctaggaccgaattgatgaccgaatttctcggtctcggtctcggtcttttcggttcggtctttcggttcggtctttttctgcccacccctacccacaagctaacccaaacttgtgctacaaccttttctagaagttactagtacactttgttgttaagtcgttgcaaattaaccaattagtattgactagctagttaagaggatggatggttctactaggtgcacgctactctgtcgtatgcaacactctttgattttttttacatacgtataagtacgctaattattaaaaatatcatcacatccataaacaaagaaagcttaccaacccaattataaaaagtaggttgaacagaaaaatagatttggcatgttgagaaagaatccaatgaactttgttggaacatgccaatatgtgcaagccacagaagataagtacaacgtgtcgtacaattgtgagatcctatttatgttttttaattaagaatgtactttatattctaagtgcattattgtttttaaactacatattttctatccacacaaatcaataatacataagagcatataacaaatgaataaatgaggtggctctaacatccattttgctgacgcggagatatgaaagggaggagaggggctgcaatacctctttttaaagaagagatttggccattgttctctaacaaaattgtgaagcttatattagttttctttgctcgtataaaagaccattattataggtaagtgttattttgactgttattttaaatatgatgcgagatttccaataacgagaatacatggaccaataatatccctcctctcaaagttcttatgaatcaacaacaccatcatttgctttttagcttatcagcatatttaaaatttgaatattaaatttagagctgattttaaagttttttttgttgtagttaatcttccaacattagttctcaaatcaacaagataccatatatttttttaattttttatggtttatcaatttatgccaagtgcccctaaaacccagtattcgaaggtgcctatagttgtaagccgtacatgtgtttataaacatgagtgtctgcgcgtatgtgagtgattttgtttgtgctgtgtttttttctaaaaaaaaaatagcaaaacacctatgctttggtataggtaaaataaattatattataatgtcatagaaaaaatatattttttaccaaatatgttagtatacttgtttgcttatttaaatataggaaaaagtacaaattacctcccccgaattatcgcggtcgaccgaattaccccctaaaccataaaaccggacattcttcacccccaactatgcaaaccggacgaattacccccctcgacccaattcgcggtggttttggtctacgtggcgtacgcgtggcagtccagtcagcattttattttttttaaatagtgggacccacatgtcatacccctctatctctcttcctaatgtctctctttctctctctctcatgggcggaggcacccacggcggcgcgcggcgtgagacgaggagggggaaccagacgacagcgtgaggccgcggcg

SEQ ID NO: 56436 - DNA, 7873 bp, Oryza sativa
aagccgtcatggtggccgaggggaacatcaagttgggcggcgctcgccgtcgtggcgccggccgccgtggcctcacgctgtcgtccggttcccctcctcgtctcacgccgcgcgccgccgtgcgtgcctccgcccatgagagagagaaagagagacattaggaagagagatagaggggtattacatgtgggtcccaccatttaaaaaaataaaatgctgtcaggactgccacacgtacgccacgtagaccaaaatcgccgtggattgggtcaagggcgtaattcgtccggtttgcatagttgggggtaaagaatatccggttttatggttcagggggtaattcggtcgaccgcgatagttcgaggggggtaattcgtactttttctttaaatatatggtaatcacttgtttgaaataaatgccttactgttccatagtacaaaaaatatcataggctgatttgtaaaaactaaaataatgtgtgtcactgtgcttgtgtttttttgaaggagtacagaaaaagaaaagcacttgggggtgggggggggggacaaccagcgtgcacgtaacaaaaaccaagcacaagctggcgagggaagggaaggaagggggagggcgaaagtaggaagggaagaggacaagtggagaggagtttcggtggcagtggaaagtggcagttctgaccacattccctacaccaccaccatcctcaacctcaatccccatccattccattccatcctgcacgagttctccactggagtggagatccgtactatacttttttttattattaccacctgcccgcaaaaccaaatccccgcaccttcctctttccccttctttctcctcccaaaaccgctctctttcttctcccaattgcccacctaccggaagagaggaagagagagagagagagatgggttcttgcggattgaggagggtcagatgatgccattaccaatttaacatcttctgcatcttttttttgcctttcttggcatattcttctcttctggatgtgtagatccttctttccccagtcctgcttagctttcaagcagaccaacaggtccgagattggtgacctgggagcggtttcttgaggtgtggtgccgttctgggtaaggtaaggcaacgaggcgccccacctcgcgcttctcttgaagaatctgtggctcttttctttttttgggttcatgtccgcttcttgtttgttgtattgcctcgctcgctgtagctgatatcttgatacctctcgtttttttagatcgactctgttgccctgcaagaattcgatgcaggagtaagggcggcggcagtatgtaatttggtgggcggttgttggagaagaggagcaattttgcccatcggtttcttgggtgcaaattgagggcaaatttcggtgaatttcgtcggaaattgaggaagcccgtttggcaatcggtcctgtccatgtcccatgcctagaagctggggcattttgggtgtgaattgtgacgaattccagccaatttgggttgggccaggaaagtaccctttgggggtttcagtttgtggtgtgatctgcaatctttccaagattggtggggagttctttgtgtgtgctggtggcaaatgggttgcacacactccaaggtggaggatgaggaggccgtcaggaggtgcaaggataggaggaagctgatgaagcagctaatgcggcgccgagttgagcttgcggctgcacaaaccgcctacctgcagtcactccgaaacacaggagccacacttcgacaattcgccgaggtggagtctgcattgtcacagcagccccctgcaggtattgcagtgcatcaatcaccaccaccacctccacctccacctccaccgccaccacgggtgccagtacctcctgcatactcagtgacatcctcagtgccaccgtactcgatgacatcctcattgccaccctcaccacgccctccaccaccgctaccgtttagtccaatagtgataaggaggaaaaagagagacggtgaacttgatgaggatgattctacagacgacgacgacgacactgacagctgctcgactcctctaccacctcccccgccaccaggggttgagtgggagtacttggaaccttttgcaatgcgtcccttaaattttccatcttcattggctgataggattgataaagaagcggcctcacaggtgaccatggatgatgataactgggtggagactaacacagaatttgatggatatgacgatgaaagtgtgtctggtaatgttgaaggcattgtgagcagtgtccagttgaatcaagccaagagtagggctctaggtgatgacaattcatcaatggttagctgggtgacaaaggactcagacacttcagcgatggcctggaggagtaagaagtcgctggcaggaattgccaaggagattgatgaatacttcttgaaagcagcggcgagtgggagtgacatcgtcatacttttggactcttctggtgggcagccagatccctcagagttagaggcaaacagaggtattatatacagtatcttgtctctgtttagtgtttgccatcattttaatatttcttaatgctactattttataattccaactcctggaaacacatatatagatataaagctacatccatgggaaatgaaatgattggttgtactaaacttttcaagatcatgaacattctattctttactctattacagtaaagttaagtacgaaaggacaagaaaagtgtttattcgcaagcaatcacttccagagaataacatttgttgtcctaggtgcaggaaaaaattccaaatccgccaaggttttttccacaatttcttggagctggtcattcaaatctgcgcaagctaatagacaatcctcaatgcattcaagtgatgcctctggatatggttaccatggcaaaacactagagaaactttatgaagaggagcaaaaactctacaagttagtcaaggtgaattacagaagccctagtttttgcatttctttacaatacgttacacaatgcaatcatgtagccatgcaggagataatagcttatatggtagatttcaggtttcttaattatccgggagttgtttcttgagcagagaagtttgtaatccattaacaggataccttagtacctgatgaagaaatgcctacatattaccacattttactaaccaaaactcaaaaagtctatatgttgttgattattatcatcctatgttgcaggatgaagaatttgcaaggctccagtacagaaagaacacctcgttgctacaaagactagaatcaggtgaccatgataaattgcatgcagagaaagtgcgagataatatagaggaattgcaagctcggataatctctttggaggaagctgttggtttgacatgtttgtccatatcaaagctcagagatgaggagttatatcctcagattattgaattatctgcagggtgagcttcaaactttagttacctaagttctaggctgttatattacatttatgtgcatggtatctgatttcagttcataatatgaattagcgttatagagtaatgcatttcaaatttcattccccgatgtagctgatagtttcattcagagctcccaattataatttttaagctaattggtgttgtcttacattctgaagcccatgacaattggcctatggaaataattagtactactaagtgccctagttatgatgtgcaacatcattgtggtagcacgtatctcttcaattatttttgtggcttagttattttcagattgttcactgggttattaaaacagattatctgttccacgcttctaaaatacattttctcaaaaaactttcttctactgcattgctatttgtgaagtttatctatcaaaacatttagtttatccctataatcaagtagataatccgctcaataatatgtttcaaactgagccagtgctatggctacaatgatatcttgctaatactgaaaatattccttgttatgatgctattttgttctatgatatatcttttcacgttctaggcttgtgcatatgtggagaaacatgtatgagtgccatcaggttcagaaccacattgcccagcaagccaatcttctaggcaatttaccagggaatgaaccaacaactgacactcattgtcaggcaacatctcagctggaagttgaagtttctgcatggcatagttcattctgcaatctcatcaccttacagcgtgactacgtaaccatccttaaccagtggattaaactcactgattgcctgcctgataacgatggctttatgaaaagttcgtcaggaattcgtagtctctgtgcagaactccagcgagctcttacaggattacctgagaaggtagagtaaaaccaacttgttttattagtttaacattgtgtgttatccagtgaaatcaagcttgtaggaacttttgcttaagaatatgccacttttctaaataaagatgttcccagtatattgtactcatgtgccagaatttgagctctatcataatcattcacttcgattgccttcttcgtggttttttttcttataaatgttctgtttataaacaggtagctgcagaagcaataaagacttttctgtcagttatacacactatagttgtacagcagactgaggagcgtcaactgaagaaaaagtccgaccaaatcgagagcaagttccatacccagttagagaaacacagcaacaatgcaacccaaaattcgggccagcctacacttgcaaagctggacacgttcaaaaagcaggttgaagaggagaaggctaggtatctgaactccgtgaggactagtcgagccatgacactgaacaatcttcagacgagccttccaaatgtgttccatgctctgatggggttttccggagtatgcgtgcaggcgttcgaaggtatcagtagatgcagtgagattgtcgccagccactcgggagcagtttcacctgccatttcttcgtgactgcatccggcatggttcgttgtgattgttcattgtaagtaggcaaagaaactggttctacgtgaatacacttctcttccaaaacttaaaaagggaaagaatttagcgacgattttaagtcagtacaggcatagtagtcttttgaatagatcaacatagtctcgatttgggaagaggtggatgtctatgaggttactgggaaatgattcatgtgtaactagatacttgaacagttgaacagtagtctgttgctgcatgttctcaacttctcaattctcattatatgatgctattttctatttctcaacaatacagttccaatatcagagtactgaatgtcaagtctcacatgacagatgcttttattcattgcttggttgttatttttttgacgtatgggaataatgctctgtaatctaatctgtgcgtattcctctgcattttgttacagcttctgatttgttggacaagacgtttgaaacgtctgaattgttatatactgttactccctctgattaaagatgccataattttaatttttaccgtcatcgttgagtctgaattgccagagttttaattttgaccatacatatactccctccgtacttgtaaaggaagtcattttggacagcaacacggtctccaaaacataactttaacttcttatttttataaaaatatttattgaaaaatgatatatgtatacttttatgaaagtatttttcaagacaaatctattcatataacttttacattttcagacttaacaacttgagagttattcatgatttatattcccaaggtttgatttaaacattgtcctaaacgacttcctttacgagtacggagggagtataagagaaaaaaatgtctacgtacatgctagatagactcgtgacaatatgacatggatgatgatggatattgctaaaaaaactcaaaagacaaatgttttaagaaataacgatgactttttctttttggaacaaaagagcttttggaatacgagcatgttggctataggggtccgatcatttctcatgaaatatacttatgttgagagatacgaaagtgttcaaatcgagttgcagcataggcaccaccgcccggcttctatgcagttgtcttgaaaacaaattaaagtttacatgagcattttttcggatgggggatacagagtactatgttttgtaacatgttttaagtaatcatactttttaggtctaaatattttctaggaccctagatttatatgtacgtcatctatttgactaaggcatttgaaatacttgtacaaaatagcatgtggtacttttaaaagtaaatatacatactagtcttctgttttctgtttatgtagtcttggttaccttgaaacaaattgcaaagatcgcaaaccaaacataccatttgttgtttattttgactgtgcaaatatgacatttcaacaatcccttatatttcgtgaattgttataatcgtgttttcgccataaaagtataagtaatgttttcctctatgactaagtatttaacgaaaagttttatacctatattttcttccattcttcctataccttaagagttaatttctttcttccacgtctacttaacccaaataagagtgcattcagtttggaggaatttcacagaattttcaaggaagtgaactatttctggtaaaaggcatataatttttttccctacgtttctaagatgccctagcttggcgaggagggattttgtagcttataccgtgtgcaaatatcaaagcaggcacgatggcatttgaaaaaccaaggcactttctttttaaaactaagactaagagattcactattcattatatagagagaagaatgaatcatccttaaaggaaaaaccaaccgtagaagatgagcatggacaccatggagtagacaagaactccattaaagcaccctatgcaaacatagagcatgcgtcttacgagttaagacaacaaccaaataactttataatacattactcatcctccaataattaagtatagtcatagccaaacacaacgcggtattcacattcccaggactactactatgttatgacttcggacacatttttttagtttgttatacgcctccgacaaggacgacaagggtgtcatgagacggctcacgctggactacgacggtagccttcgcctctacagcctcgacggtggcggaatatccccaggaacgcggcttgtcggaggcggcgaggcgatctcatgttaaggcacgtcgaaggcagcggaggaggatttccggccgacgccaacacgagccgagataagttgagaagacgaggcggtgacgagaggagaagcatgtcacgttggatgcatggggcctatagccacagctagctccccgatcacctttttggtatattaagaccttaccgaggcgagcatagccgatggcaaaattgtcttttataaaaatttctctctttgttttcatcgaaaataataaaataatacagcggttgtccaccagctaattatcatatttttacagtgtccacgagaagataaacattctttggatgtctcttagacaaggccacaaactttgagtgtctgtaggaaaatttttatcttttttggtttgtttcgatgagattgaaacgaatgaaagtggttccaacttttttttttatagaagccctcgcaaatcattgacctatcaccatccactccccctcttcgccaaaaagtaaaattaactctccatccatccaaaaccaaatcaaacccaccccccctctcaaaattaaaaaaaaagcgtgctgttcttttctcctcctctcgtgcgcctcctccccctcccccaccct

SEQ ID NO: 56437 - DNA, 2652 bp, Oryza sativa
tgttgtgccagccgctcgtgttgagcttgtgattattgcggtggggggggggggggagcacgtagctctgctgctcccggcggatttggatggtgctgttgggtgtgctgtggccacgatttggttaggttttactgatttttgggggaggattggatcagccccgcgtatggcatgaaagggactggcgtattgttacaaatgaatcctgtgtgattctgtctggtgatacaagtcttagtttgcatttgcattgtgaggtgaagattccgattcgttgggcactgacagcgttgctcaaagaatctttattgtgagggtgtagcattgttgtagtacaataggctcttaccctttttgggcattgccattggacatcaatcttttgaatcactgaacttatgataaagtttttgttccattttatgattgctgcagagttcatatttgaacataatgccatgattaacctcgtttcaatgttatgtgttgatgagttctggaacttatttgtattgcctgatcctaattgagcgataatttcttttcccttttttgtattgttttcctgttgtcaaaatagccttatatctagttgatgcctcaagttattgatacatatgcaagtaaaggttctggttatattgcctaactcaacattttattgcttcaggtggatacaatcctagacaaggaaaattttacactggaagaacttcttgacgaggatgaaattattcaagagtgcaaagctctgaatacacgactcataaatttgtaatttccttaaatatttctgttattagtttgaggagacttgagtggcatgacatgattagtgtactattggctgttgcaacttaccattcattccttatgttgtacgtgtgtagcaaataagaaacatttacggtgttcttatgatttcacttattcattgtgattgatgcaaaggcaattcagttgcttcttagataagctagcagcttattgggtagttgctattttttcctggcacttattgttcgttggacctgcacaattctaattccatcatatggaagaaaaagtagctctttcatttgttgggcaatataggtggaatactatttttgggagtattgtatgtcatagtgcctttttatcccttattatatggttcaaaaatttcctctattatgtttacataactatttccatttcctcccttttctggggcacaattgttctttctcacttctacttcatgtctttttatttgcattcatatacccagagtctactggttgaatgcattacagtataatagtgtttcattgtttcttcaaatagatattagttgttacatttatttagtccgcctataataactaaaaattttgtttgtagcttgcgtgacagagcccaggtggagcaattgcttcgttatgttgtggaagaagtaccagatgatgctgaaaaaaagcgctctttcaagtatgacatttttgttaacatatgccatcatttatgtaaagagaagaattttccacctcaattttctgtccatctgttgtaggtttccattcattgcttgtgagatatttacatgtgaaattgatgtcattttgaggaccctagtcgaggatgaacaggttggcatttcttcatatccttttgaagtgtttgttcagaacattagtggttgtagctaatcacaattgtctagctaatgttatttatccttctgtatgttgcagttaatggaattgcttttctcatttgtgaaatccgatcatccacatagcacattgttatctggttacttcagcaaggtacttcatttgatcaggcattatatgtaactttaccatgggtaaactcatagtatgaaggcactgtagaagttaattttttaggtgattattgtggttacgatgttaaactccaacctgcttttttttttttgctgggttgaaatcagcttgattaattgtttgttctaggtggtaatatgtttgatgctgcggaagactgctcctcttatggcttatgttcaggtattccttgtctttctcatataattgaactaatttattgattctatttaagctgactaggtctgacattcaaatattcgatgcatctgtcctgtcttctgttcactttagttgtgttgttcttccaattatatgctgtttggttaactggaacaagctaatcatccacactgaaccattttctttgagatatctgcttaagataaactgttatgcacttacacttgtatgttgtttgccctgtgagattttatattttttgggttgatcattcagtggattcatgacacctaatctgtacttttatagggacatccagaaatagttgtccaactcgttgacctgattggcatcacatcaataatggaggtaagcaggctatcaataattactatttgctctgcgcttgcatttggctaatgctgcccttgggatccttcaggtgttaatacgattgattggtgctgatgagaccatatactcaaactatggcgatacattgcagtggttagaaaatacagatgtccttgaaatgattgctgataagtttagctcatcggtgagttcctaaagcttgtttgctaagaaatgtatgtaataaacatggaaatgt

SEQ ID NO: 56438 - DNA, 837 bp, Oryza sativa
ttacgcccaccccttggaaaacatcgtttgaaggtactggatgatgcaatgctcatttacaaattacaactgaccatttatccatttctgcattcaatgattatttcttgttctgtacaaagtcatttgcttaatggatggatctatgcatttaataaacatatttaaattgcctagatttgtttaggtttagtcattttgttttgtagatttcagtctcggaccagatggagtacagaaaagaagggacccaggacctgtgccagtctggtccacctaattggattgggtctggtaaacctaattggattggtgctgcaattggcccagcagattgggcgtcccagtatgatagaatgtgtgactcgaaccgtttaaggccatttaaccaattaattcacagaaatgatgttgccgccagggattgaactcacggtctacagctacggcatttacacctaaactagttgagcctagctcatttcttggtttgcaggagtgtatatttcaatatatagaacatatcaatagtttttcattataaaataaaaggaaacgtggttcgtccgatgacctgataatctgatcatttacctggtgcccgtggctgggtcattcactaggctgccctcataagactgagttttggtatgttcatcaattcatttcgggtgagataggaatatccaagaaaacagagattcatgcatgctcgagtccttatgacatcaagtgttcttttgtcattaacctttatctgcagtgtataactcttcattctttttaattttggcattgaaattctgttttggtgattgtcgttattttttttgggtg

SEQ ID NO: 56439 - DNA, 811 bp, Oryza sativa
tccagaaggagaagacctttggcttagatcccagttgagctgactgtgggagtggagcataagcttcgctagattttatttttcgctgcagttttcttcatggtgaggactaagtgcctcttatgtaagtatttattgttttagttattctgatgaatctgtatattaaattgtcagtttgtgtacctcggctgattcctgaacaagggtcttaatgtacaaattagttcggaaattacttgtgaatttctgggcgtgacaaacttccttagtgataatacacgtaggcattccaggagagtacacatgtaatatatagccgctcagttgattcttaacactctgtataacatatctgttgtttttttaggacaaagtaaaaaaagaatttgaaacttatttaattactaaaattgtaacgacctgcctctcccaggccaaggccacttacatctggcagctttcataggtcatagagagggggcacatgtcttttctgcaccctctcccaggccaaggccacttacatctggcagctttcataggtcatagagagggggcacatgtcttttctgcacactttgtcctcacttgtgtgcacccgggaaatccgaatttcccggtcagtcacccatcccaaattgctccaggccaagcacgcttaacctgaagttatttagagaacggcttccggaaaagaagttgcaacttggtgatatgagtattctattaatcctattaagccctaggccgggatgttacaccctcacccccttaagagaggatcgacgccccgtcgataaaccccagg

SEQ ID NO: 56440 - DNA, 3810 bp, Oryza sativa
atttaacaaaaaggaaaaaaaaatccaaatatgcataataattcatcatagagtaaaatgcatactgtagttgatttgaaaggttcttgctgaagcagaactttgtagaaatcttctcctaaatgatcagcagcagttagtccatcctttgccacacccttttctgctgttaacccaccagcaacagcagcccctactgcagcggcagtcaagccagcaacagctgcaggaccagttgcacccaatgctgccactcccactgcaccgacagcacccattccaactcctgctgcggttgctgacccagctgatagagcaacggcggcaatctcagcattttctagaacccagaggatgatagccgagtaatcaatgatgccaaggtacctccctttccaatcagccggagctccacattccggatttagcactggcgctgccctaatgttgtgtttggagagaattctcacagcgtcaagaacggaagtgtctcctggaatttcaatcactgcaatgcaatgtgagggatcaaaaaaatacatggcgcggacaactagttagttaattttgtcttgcagacgtgtgtacctcggccattaggaacatcaggaaaagacgagacaggaatctgagcaaaggcagcagtgagcgattcttgcaaagagaggggcagcttcttcttggactgtatagtgtcaaaatacgcatcacagcttgggaatttcacggtttcatcaggtcgatccatttctacacaaaaaacaaaaaaaacaaaactcactcaaacattaatcccagtagatggcagcaatctggacacgcatctaatctaatcatggcacagtagatactcataactaacccaatcacgacaagccactttggcatatattagcaaagttcatcacaagttcaacggaggtacactattaatctactcctgtcaactaatcaggggctaacactcccaatccaatcctaacaaactgctactcttactctggttaggtccaattcaagaaaattgcttgcggatctggaagagaagctaaggctaacgaaatccgagaagaaaaaagaaaagggggttaggcgtagtgggtagtaaagaccgcaaagagagatgaggaagaggatgagcgtgagtacggatgcttcaccgggcgaagtggcggaagcagctgggacttccgccggcgtcggttgctcgcgggaggggaaggggatcgatcggggcgctgctccgctcggcggcggcggcgcgaaccgcggcgattgctggaaaccgtgggcggcggcggcaatccaggaggaggaggaggagggagatggattcgattgctagctagtactagtactacggtgcctcgcggccatgggggcgcggtgccacgtatgcgcttgggtggggccacgtcgcgcgaggggtggcgttttcgttattatattatattatattactatctccgttttttaatagatgacgccgttaactttttattacacgtttgaccattcgtcttattcaaaaaatttacgtaattataatttattttgttgtgagttgttttatcactcaaagtattttaagcatgatttatatctatacatttacataaaattttttgaataagatgatgatcaaacgtacatttaaaaatcaaaggcgtcatctattaaaaaacagagagagtatataattttattcttttttactaggccgcctacataatatggcccacggttgaaatagtccgccacatataccaggacacatataaaagtggaatatatttattggagttcccttaactttacaccaaatctgattttcatccttaaaccaaaaactagatatcatcggtccctgaacggtcaaaactggtacaaacgaggtccctcggcggttttggctgacgtggctggtttgacttgatcttcgtctcatgtggcatttgacgtggcgcttacgtggcaattttatcccaaaaaataataaaagccaggccccacatgttagctacacacaaaaaataattaaaaatagtggggcccccacgggtcccacatgtcagcctcacctcccttcttccctctctcttctttctcatcctcactccttttcttctctctccctctcttctttcctctcccctctcttcatcttctcttcccgcgggcgagccaggcaggcagcgggcggcgacctcggcgagacggtgccctcggcgaccttggcgaggtgacgacctcgcgtgccactattgcactccacctccaagccaccgccttcctctcccctcctccccccgccctcgccgccaccgatcccgggggttcaagggtaaacgtgtgagaaatgaacgagtaaacgtgtttttatgcgggtagtgagataggccacttacatcactacataaaagtaggtcaaccgctttgcagtgtaaaatacatcagagcttcagaaaaaaaatgatgaaaggctaaagtttgcaaatttaacttaacaaatttaaccaattcaacataatttgtttaacctagttacaaataataaattgaatttacataagaagttgagccaatctgctcatctggattcgagtctaagacttaaaaaaacaaacaaacaaatggaatgtcgttattcttgtatgtcaatgtcagcaattggaatttggatcaaaactaaggactggtatgatttgtgacctaaattggtcttaccaatttttaaaatgccaaattttggtaagttttgacatgactaattttgggaaggtaaagttgtgtttggattaaaggtaaaatagtctaagttaactattgaaatgacatattttcttaggcatgccaaaatttggtttcaaaccaaatagacactaaacactattgaaattgtcaaatattggtaagccaaatttaacccacgaaccaaaccagccctaaaaatttttttgttgtttaccacctgtgcattagtggtagataatttgtatatttatggatgctagtacagggtgtttgtcactcgtcagcatggaggagccaagttgaagagctctccggcacccttcccaccggcaacgcgcgcgctctgctcacggtcacggacgtagctcgcgacggcggccgccaccgtcgcctggaacttggggtcccagatcgccttcgccacgacatctgcctgaatagggtagtttctctggctccatgacgactgcgccgccggcatcgcgcgctgaagctccgaccacgtcgaagacgacgaggaggaggcgagcatggctaccgccgccgatgaggaggacgacgacgacggagggagcgcggcggcgtagggcgtgatggggtggttgtggacgccatcgtaggtggtgacgaggacggaggtgtcgtggttgcagcgctgcacctgcttcttcacggggcaccccggcgcgccggtgcaccggtagtagccccgcggccacgggttgcccttcgccgtcttctgcccgtacttgcgccattgacaaccgtccttcacctgtgagataaaattcaaaaataaatcagctcatctataccattgtactccctccttctctaaatgtctgacgccgttgacttttttaaacatatttgaccgttcgtcttattcaaaaacttttatgaaatgtgtaaaactatatgtatacataaaaatatatttaagaataaatcaaatgataggaaaaaaataataattacttaaaatttttgaataagacgaacggtcaaacatttttaaaaaagtcaacggcgtctgacattttgggatggagggag

SEQ ID NO: 56441 - DNA, 16708 bp, Oryza sativa
  unsure (1)..(16708): unsure at all n locations
cccagattggcgccaacacgtcgccagccgattccaaccgcggtcaagtcaatccttcgccggtaagtattcgaacgtggcctcccgccactcaaatagatcttgcccgccctctctcagcctctgccacctttgcctcatccaaatctcgagctcctccatggcgatgacggtgcccgagctcatccgctcctcctagccctataaataggaccccaatcccttccttgtccatcatcgatcatcaacaaccatagccccacaaccccgaagaactgcttcaccaatccatctcatcaaccaccctcgcctgtcggtcgaacaccttgtgcgcgatcgactccacccctctccatccatcttccgccctaaataacccttagaacacctatattctaccatgttctagcgtattaggccctaaccgaagctctgcgtcgagttttacctcgccgcaccaagccaagcaccgccgcccctgcgctactctgttcttctccgccgcgaagtttttccggccgcaatccgtcgtttcaatcgatctcggtgagttcttccgtttcaaccatctacatactacctagagtccatttttgcaatcggtttgcactatcttgccaccctctgagctgccgacgtgagcacggccgccgcctatggaggcgctagtcggcaactatgctccgcgccttgccaaaggttggcaagctgccggaatccctctagacacctcgtagatgctctagaacccctcccctagccatgtctaactctcatcactctggtcgccatcacagcctaaccgtgccaccgccgctctagccgctaggccgtccacacaccaaattagttccatcgccgccgctcgccgtcgccggagatccctagctccctcccctcctcggccgcaaccactttctccctctagtgccgccgcaatcctaaaccctagcgccgccggcccgatttggggaacggccggaggtagaagaagaaaagagagagagagactgacaggtgggacccacatagtgccatttcacatttatttgattttcaaactttagaagaccatatcttttaaaatatagatccaatttcattaaaacttggaccaatattcttctaaaatcatcctctatctactagacccctttttgctatttttacattttattttatttactctatttttcttatttttggattttatttaaactcctttttgaatttgaattttatatgtctaaccctaggtcttgaggattcctctgacactctagataatatcaatcaatctcaggacatcgagcaaggcaagttaccatatacatgttgatcatttcagcctatattttacaaattatttatttatagccttctattcaatattctattttctatgcataaattaatcatagaaacccagataatttagtattgcttattttgtttacaatctggttaaaataccctatacttagattgggacaatacgtaagatttggatgatttccgggtggctagtattgtctcaatcgatataagttttaccaggtacttatgtcgaatgaacgagtacgaccgcagtttctagaatggggatagacctagttattaggttaattggcaatatggcacctctgtatagtggttcttatttttaagtcctcgcgcaggaggcaactatagccgcgaagggcaactttaaccattaccatgtacaggtaaatggcttgtgatactcgagtataaactatatggtatatttataaaccctgatcgagatgacgtggtgtcatacgatcagttccccttaaatacctcgggaacgccagaactcctcttgctgctgttaacattatgttcagagcatatgaggatataagttcatggaacaggtgccataattgttaatgacttaatgttgggctatgactaaagccgataattatcagcaagtcgtggactgcgggtaaagcgtacatctgctgcagtagaatatctttgaaactattcgaatagctgtactcgtggagttgagtaccgggactcatatggtaccctggttagaaatctaaagtttatatgttttataaattctgctataacttttccagattgtctaatactgctttttgcaaagaaccctattatatgtcaatgcataacatattttcattataacttgctgagtattgtgaatactcatccttgctcttataacccctttttcagatctgggtcaagaggaggacccatatgactattactacgaagaccccgataacttagaaaatccctgagggttttacctcactagtcagaatgtatagaaacttccgctgtgtactaattagataggtgagtacctattattgtaaaacccttagtattgtaagactttaacatatgcaatgaaaaaccagttatattgtatgtatcaatttttaatgatccagggattgatacattaatctcagtcggatccaagttattagttttgggctccgacacacatgtatgatgtgacaaacactacaagaaaattggtgctctaatgaaggtaagtcttaaatttgctgttcatataggccgtctgaaaatgaattgttttattgatctgtacgtgctgcctttctatatatacagctgcctactagtttattttgagcaattttacggtccttaagtagataccaggaggtaaaaaaaaattagtataaaatttaggtatacctcgtagtaactagatactaagaggtaccaattttacaatagaaaaagttatatcttatattatctcctcaagaaaccgtaaaattgctcgcttaccttgtgtagtcctaacaaattaatatatgtattatctatctatccatatatctgtctactagtagtgtatctattagctagttttatgtgttctacacttttatgtagtcttaaaatcaaaaatatgtattatctatctatatatgtatttgcatgttagtttatctattattagtcagtgtacatactttatatagtattaataaaattaaatatatgtatcgtctaccttactatatgtctactggtgtatctattactagtttatgtgttttacacttttttgtactcttagaaagcatatgtgttttatctatctatatatctgcctgttagtttgtctattagctactgtacacgtcctacacttttatgtacgtagtcttatttttttagatacctactatctttttttttagataatgacatacctactatctatctctatatctttcttgaatatctattagctaagtatagatacatgtattacaattttcggtagtaaaaaagatcttgccaattatatgtttgctctccttatggtgcatgctccgatcatccgtctttctctggcacgagcgctgcatgaaggcctctcataatgagaaaaattgggaggccaaacaaaatgaacaaaacccttcgaggttactctataaacacttatacgttcaaacatgcacaataatctcaccaactcaaaaggtgggaccacctctagtctaaattctttgttggtaaggaatcaaatactggataattcatttcaaatagatactcaaatggaaaatttcgataccaaagtagatgctactccctcgttggatatttagcaaaagcccaattttgtataggattagggtatcttattagtaaccaatttggacctatttatcatatttggatattcttgattggtttggtggttattacatttttttttgcgagtgacatacttgtagagataagaatatcataattttggtagagatgttgagggcgctcacaatgcgtcaccaatttttgccgttcctcatataccacatagacgaataacctcataagcttcatactccacggtgcaagtaccagtagtgggtcccactaatacatcttttcacttttcatctcccaatctctcaccttcgtttcttttctcacccagtactctctctcaagtactagtagtggagcgaccggcggggcggcccgagcggcgacgaccggcggggtggtcgagcagcggctcgagctgcgcggcaccaggcggcgaagcggtcaagaggacggcgtggcgggagcaacggaaggaatcggcgcacgagctggggaaggcgatcgaggtcggcggcgggggccgactaggtcggcaacatggacttggcgcgggagtgaggacggcgaggtcaggagcgacggcctctggtagcgggagcgaaggagggcgagctcagcggcgtggaatcggcccgggagagagggacagcgggcggtgcggatctggcgcaggagcagccggggccgcgacctgccccacgacagcgccggtcctctgcccccgtcggtggctctcccctctcccttctccggcatcgtcgggcgaaggaagccggcaagcttcttcagccccaccaccttccccatcgacccagcgagcatccagcggccctcctcccctggccgacgagctcggcgggcgtggagcgcaacgatggacaacgaggtctctctcctccctctcccatccttgacgtgacggtgcggagcacgagcgtgggtcccacctgcgacgaggaacccgtggccaaggtttcctacgtgttcttgaggaggccgcgcggatagaggacatgacaacgaatattcgcctttttggttgaggccgaacgccacgaagacgcactgtgaatggcctgagaatatgcgtttttgcagggggcatagataggagaggcgagcggtggtttagcctcccccatgtcttgaatttttcactagctaaagttactgtcactttagcaaaatttgaaanaattaacattattgatcccctcaattataaactttttaagttctagctccacggctgctttttttttttgtgtcaatcttttcgaggaacacttctacgtcatcgccaacgtcgaatttttgcttctatacatgcatagtatgcaccactgggcacgcatcaggcagtttcaattcgcctctaggcttgacttgtcacaaatgaacccaaaaaaaaaagaaagattgagcataatcttcaggtgtcagagctgacgagacgacagaaggaagttttcaaagaaagagtggaagaccaaacgattgaaatgcttagctagcagatgcagtgcttctatcttctggttctgcccttctcctgcagtaaaacatggatgctttcgtgctgctaaatgataaattattggtcaaggtagtatttggattcttgattgccacgaaattaactatgacttcgtctgacggtcaggatttcttccagggatctattctacggatatgtattctagtattctacggttgtatagaagagaagaatcttttttgcagaatagcatgtatcttggtatagaggttttactggtcaattttattgatcattttactgtttcaattcagagtccacaatttggagatttcctttcggtctttatttaccctttgaaatcagttacacagatttaagaatcttaaatcgtataatttattatattaccaagaggtcgaaagggacttaaatagattggatggtgggtctaaattataacggtcgcgtagatcagttgaatagttgatataattataatggatgtgaggtcgaaaatatatgtttgaatcaaaacattcacttgaaaaactaacataggaaaaaaatagagttgtcgataaacaggacacatagtttcaccacaaaagattattcaaggaaaaaaaataatgcttggtacacaaatcttgctagcttcttaactcacatcctttgatcactctccctatctctttctacgactatgcatatctctataccaggcaaagaatatccaaatttctgatggaagatttgcatgccctcaacataaaaaggggatcaagtcattgtacttggcttcacaagcacagcgttcatattgaaagtgcaacgttcttttctcaaccaatcagatagttcatcagtaatccgcctgcttactccacctacggttaaaaaaaagtcacacaaattagcaactaacatttagtgttcaaatattacataaacttagctaatacaaagaatttggttgtgtatcttatggcagatatcgggggtataaaatatttataatgccaaaataactagtaataaatagaacaaattggaaaattttagagcttacgtggcgaaggacacactccatagtatgagcagtcccttccttcaactgaggaatatggtgggcccatgacatcaagcactgcacaagcagtttctgcagtgaagcaatgaaggtttcctccactctctgggtatagaaccgttgtcttagatgaatcatcgtagatggtgttagttctcaccttagcaaaatgagcacctgtattttagaagactggatattagaaaaaaaaacttgtgaaaaaatgtggtgtaaatgggaacatgtgagagagaaaaaagagtgaatatgttagcgagaaaagcactcaaactaaccatctatttccctgcagatacgatttttaccattgggagttttaacccagtcatacgactttatgtgcattgagccatgaagaatcttgctaaagacagtcatccctagatggtcatggagtggaatgacagccgattgtggtagacaaaacacaccaaactacaaaaaaatgtgtaaaatgtgtcatctaagtggagtttacactaaatagacacattttccatgattcaatgtcaacaaaatgtgaagtactaaattaccgagaagttaagactatcatcaccaaagtgcacatatgttactttaggatgcccttgaggatcagctctaaaatacggcatgcttgcatcaagcccaaaatcctctagcttcaaggtatctgcatcaatggtttaatgtgttgatttgtgtgaataccacaagtgcatgtagctaaaaattatgaattggatttcttgaaaacaattatcaattggaagcaaaacgtttccattacattcccaacaaattctcatatttatgcagcatccacaagaacaaaaaatatatatgtaacttcctatatcagatcacataattagatacacttttagctagcatatttcaatatgtgcgatgaaaacattgcatagtaggcaattacaacaaccattgctatcgcaggaaaatgtccatatgaaaagagacgcagtggacaatgcaaccaccaataaaagatcatgcctgagatttatggattaaaatcttgtaagaatacgtgtatgaaataaaaaccactaaatcaaactaacctccataaaagctcagagtatagtcatgctcatgcaaagctcaaagtgacgggcatttctagatataagatggtatgcgcatgatatagatgcaaagacaagaagatgactgctaaccgagcaacttggtgaggtttgcctcggctaacgatgatggaacaaagcctggcgtggctgcaaagaacacatccctagcgatgtcatgcacttcttggatcttgttcatcgccgagtttggcagttctagttcttcaagagaggaagtaggcggtttcttctgacggcgggtggtcttcttggatgatgagaaggatgactccaaaacacccttgctccctgcccgtttcatcgcgtaacagacctagaaaaaaattaaatcctacaattccaatatagaaatgaccttttcaatcaccaaaactataaacaaaatcaccaaaagaatcaacaagaacatgaatacgattaattaaaacctaccccaaaaggaacccaatgattgagattgtataagcggcgaggaaatgaggcaattagagtaggcacaaaggtgaggaacggccgattgggtatatatgagcgaagggtcgcatatggtgggtttggaggaaggagaaaactaggggcgggctgtataggggacaaaggcgagattgccttgcttcctctagaagattccattttctgtgggctataagaacttggaatccaaaccgctggtttttgtaaacttacaattaaccattcaactatatcaacattttagggaaatgacctacttaagcattaatcaataaactccaatatgtcacatcaaggtaaatcccaaacctcacttaacactaccccgaagtatcacaaatttctagttcacggccgatttgcaaaggtagcccttcctcaccatactctggttgttattcatttgagaatttcattattcaattaatttcacaacactacatactttgacaaaattatcaccaaaactgtaaatttaaatcatcatatcacaaaaccacacatttaatgtcaaacctacctcaaaactataggttgaaggcataaaactataaaatttagcatatgatttatctactatagtaaaaaaacggagtccatccgcccacgcaatgggtaacccactactacataaaaaccatccctagagaaaaaaaaagaatttgatccaatcctacatgaaaacgaactcagaagcaaatcaacccttcacatccacatgtaaccaactaggctagagttacttataaaggtgtgtaaattttggatttttgtttcaaggaatgaccaattaactaggatggagcttttaaaattcatagttctgtgataaaaactaacactaaatctgtaattttacgactctatgacttaaatatatagtttcttggtaagttcagcaccaagtttgtagttttgtgatgcaatgggttaaatatgatacggcttaaatatgcaatattgtggtagttttatcaaagtatccatagtttttctaaattttactcttcaactttattggactgaattttggacaaaaaatattggactaatagttggtggaaacaaagtggtggatctacagtaataccactggtgtcaggcgacaccgacgacttttggcaaaagctatgcttaaactgactatccatatattataacactatattctaaatgtaattagcatgctatgacaccgataaacacgttatgacaccaacgaactaaatttctggatccgccagtaaaacaaacacttccggtagtgaacacaggaagcaactccaagttcgtaacaagtgcagcaaatcaggaaacacttgctatagttgagtctcatgtacattgttaggtccatgattagcttacatatttgacgttctagataagaatagcagcatttgaggtggtcagtggtagcggtggtagtgcatgtaatgactactgctaacagcatcaaatggaggaaaggttcatgttttgtatgttatttttttgtgcgtgtgtgtgggatcaaggaggccgactagaggggggtgactaggcggtttttcaaacttttggctaaaaccgagttttgtatgtggaagcgtaaatcaaaatggttttgcacaattcaaaacctaaatcaactagtctcaagtaagtgcacaaagaagctagcctatgttgaggtttgcaagcctagggtgataatagcacaaataaactctagtatgtaaacttgctcaaagtaaatttgcacaaaataaaggagacaagagacaaggaattttcaccgaggttcggaaactcgccggtttcctaatccccgttgaggcgagcccaactccaccgctcaaccacgaagccaccgcacggccccttcgtcaaggggtgggcaaggcgggagccggcccacggagaggactaccaaagcctcgatcactgggaaagttctatcttcactccgaaggtggtgaactcaaaaccactctcaactggcgccgggcctcctccacaatctcctcggagaggtcaccgggcaacacctccacaagccgtctaggaggcagcaaccttcaagagtaacaagtctaggatgcttgccaaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttgcccttgctgctggggagtgggtatatatacccccaaccaccaaaactagccgttggagtcgaaatccccaactctatgctctgccagtcagaccgccatagagtggccggtcagaccggactactttgtaacggctagaaaactagtagttacagggcaatcattgagcccactcaacctggccggtctgaccgcagtgaagcggccggtcagaccgtccacggctgggtcagaccgccatcggctcggtctgaccggttgcggctctggcggctctgtatcgccaccaaaaaccagaccagtgcaacagaccagtagggccagtcagaccggccttaccacgccggtcagaccggctaacagccccggtcagaccgacctaaggcccacggtcagaccgcaggtcacttttcaacacaaccaaccgttagtaaaacggcgatatctcttgactcggatctcggaatttggcgttctcggactctatggaaagcttattcaaagggctatccaacccattaacaatccatccaagaaacacaacttttctcagggagaaatgactcacactccaaaggatactccaccggacataaccacgtgtggctacccaaacctataggatgtgcccacttctctctttgtttgggacttgataaaactcaccacacttggctagacaagcccacaaaatgcatctatatgcatatgaactaatatggcacaaaatcatccgcatgctcgcttcatagacccctcttgatagtacggcacctatctagtaaatccggtctacaccaaacaccaagaccggcaaaaagactaagaaaatattcttagctccattatacctttgccttgtgccatccaacttggggtcaatgcttgagccaacatcaacacttgtgaccattcggttgaaccatgtttatgccgaggtctttgccatcctttgtcaagacttaattctcatcacaagcttgacttcattcttgccaacatgacgatgtccttggcttggtgaccattaacccatggtgtcattcattagcctcatcgcaattagatctattcctttgcacggctcaaaggaaaacgttagtcccaacaaatcggttggcatcctccacttggtgaccaaccggttgcatatgaaagatatggatatgtttgttgagtattcattaacatcataagtgtcatatactcgtatgcaagctcaagtgcaaagatccgatatatataataggtgaacaacatggatctaaaacatgaacaataaatgtataggatttgctcccctaagtatatgcatacaaagaaatatacaagagagacaagtgtatgcataagtaaagaagaaccaatgggggtttatcctatacatatagagaaggcatatgtagtaatgatgaagataaacaaaaaaaacacatatcttcatgatctccatgttctcaatgcaaaggagactaaataagataagactcaagtaaacattagtctcacacttatataacaataacatggaaatcatatatatatgaacctatcaaaaagtaggagataagaagtgatacatatcgctttatctccatgaatttcatccttgtcatgattaatgtccatcaccaaagaatgcatatctaccacatctcattatcgggaaataaccttgttgaaaacttatgtaaaagagaggttaatcccataaacataggtttatcatctatcaccaaagtaacaattacacaaattgtttaatccaagatctttcaatcttttctctcttttgtgatagataataatccgatataaacaatacaaagagatgagatgaaagataatttcaaatcaaggttgagatcttataatgaacaaaatatagaataagctccaccttaagatgtgcatacatatggatatgaaggaatgcatatgcacataatcaatcaagatcaatgagggagctcacactgtattttggatccacaagagagaccaagttagaatatgtgaagtttaatacatacctcccatcatttttactttcatatccaaataagactagtcaaagaaaggctcataaaaacgttagtctcatataattagatttgtcattaatcaccgaaaccaaattaaggcacttgaacttacaatctccccctttttggtgatcgatgacaaatccattaataataaccacatttggatatgaaggatataaaccaacattatattgaagcttgacaattgaattatatccatacatgtcaatgagtaaatagaagtgaaatatatgccaatgacatgcttatgcatatgatgcatatgtaatggtatgatgtgggatcctagaatatttcccccttttgtagctatgatcataaggagatcataaatattctctccctttaagatcaaatgtgggatcctcaaatattctcccccttttggcattaatcacccaaaaatgaaaagggctagaaaataggcaattacaaaagcccaaaaaggaataaagactaacaaggccaaataatatttttgtgcaagcacaaagcaacaagtttagaaatgacccatttaggaaaactcccccttactcatagagtcttgtctttgaatatggaatttggaatagatttcatatgtagaaggggttagtttgagcacttgaactttcacttgagatattctcatcaaaggttttctcaagaatgtcaaaaattgagaagagcttggtcaaggctatttggaagaattttacaagtgcacaatatcggcaaagaatgaaaatgatgagatagtgccgtgttcaagatgatcaagataaactaccatttatttagagaccacttgtgtataggaattcgaattctctatgtgtataggaattcgaatttgggatcaaggaacggtatttggctttagtagcaaggattaacttgtattttggtggaaatgattggaatttggagtctatccttggaggcttggttttgaaaagtccaaaaataacttttgagtttaggtggtttcatatatcatgggcatttcaaaaaccaaaagagttcaaataaggaacatatccaaaagagctcaaggatcatgaagttttcaaaataacaaagagctcattacttgaaacttcttatatttcaccaccatgctcaaataatcaacaagtgatatgcactttgaaatccatgtttagctgaaaaagcacatagcaatggtggcatcttttagcaatagaaacttgtggaaccaagatcggaaaaataatccataaatcctggagatagttcatgtaaaaatgcaaaaatttcattttggggtcctttcccagctctcaaccgaattgaagaaacaaatctcacaagctttcagccaactgaaaatttcagactttttcagatttttggagactgaaaatgaggttgaaaagacatacaaatgaccacttaaaattctgagtaaatttggaagtaaacttcaactattgaggatcaaaattcatattgtgatcttcttcaaatttgcaacccatttggagatacaaaaatcacaaatcagcccaaaaacatggttgttctgaaaatttcagcaagctgagcaaaacgagaaaaagtcaaaatctttgcaaatcaaatagaaatgagttgaaaccttgcagatttgatctttatacttgtgaggaacttttccaaaaagaatttcttaaaaatcatttttctatcaaaagataagacaaaaagagcattgtaggcctttagggtgagtaaatttgagttgagagctcaaatcacattcaaatttgaaatcgatggattttgacatttgtaaagccttaggagggttatagatacacttccaagccaagattcacaaagaactttggctctaaaggcttaacacaccataagcaagtttaggcgaaaacggtcaagtcaagatttttgctgaaattcaaatggttgtagagtttgaatggttggtattttggaaaaactttgaactagagaaatgtttgaaatgactaactctaaaagttttgtatagaaagattttccaaaaactcaatagattttgattgagaaataaaacattttcaacaaaaacaagatcctaaaagatcctattgagaccaattttgctattttgcttcacaaataaaaatttttacaccaaaagccttgcaaaacatttgaaatacatattaggatacttttgaaaggattttcacaaatttgggccatttaaataagaattttgacttttgaccaaaataggctcttttgaaaggctataaatgtaatcttttggaaaattcatgtttaggagcaaagggaatatgggtttgattcagattgctcccccttgatgcaactctcctttttgcttcatgaattcaagatttgatactaaaggccaagtttgagaaaaaggctacacaagctctcttttcaaatacattccttcaaaagtgcaaaaggaagcaaatgagatgatatttgagagaaactaatatgcatgaagttcaaatatgatttgagccaaaaagatgcaattattcaggtttaagaaaataactcaaccaagtgctagaaagtgaccatatatggtctagttaaaatttttgggagttttgacatcaaatttcttttaatagattggtcttttggataaggttcaaaaaccaaaaacatttgaaatcaccaactctatctaacttgttttgggctctttttcaaattccctttagaaatccttgtagagagaaaaatagttttgctccaaaataagatcctagaaactagaattttggccaaaaatgcattttcactttacaaatactttttcttgcaaactaaagtttggaaaacatattagagaccttttgaaacattttccaagtaatagttttcaagaattatagtttttttctcaaaaaattgacttttggtcaaaatgggccttttgaaaacctttctaccacttggattactttgttcacattctaagggttgtagtgcatacgtaagaaatgcaatactttcccttaatgtgatattcccttcaacccaacaaagataagcaaatagacacaagatccaataaatatcaaataagattgacaataagcacaagatgataaatatgttgcattaatatgatcgagcctatagcttcatatgccactactcattatgctcaacatgcatttatgatgactttcataagagaaggaaatttaattttggaactatgagtatgcaatgcaacatacacaaggctatataaaaaaaattacaaaccaaaagcatgttaccgagatggcattggtccttgatgtgaattctccatcctcattattggctccaattcttgaacttggtgagaatcacattttctcgcataggccaaaactctaatgcctctcatgtacttatattctcattttggtgcattttggtccccaacaaaattgggtccatcaatgttagttaccaaaatacgaggcacccaaatggtcctccttctagatgcaagtctaggtaaaccaacatatctagcaaacacattgccttgcctattttttctaagcacataatcatcaaaaataatattaggcttaggagtattacctatgggacaatttttaccaatatgtccctttttgcagcaattgtagcaagttaggttttggcctctatgacttgtctttttgtcttgcttcttgccggtttgcctcaatttgaagttgcacttctcatccttcatgtttgtgcacacggagacaaagtgtcccttctcatgacaaccaaaacatgtaatgtgaggatggttcttacttacatttttctttccatcctttcttaagtatgcatgcttccttgcatatttaggcatgtgccttgtcttcttagcattctccttgcgatgaaagctaagtccacacttgtcatttgagctcttttgcttgcttaggatttcgtcaagtgagttcttccctttgtagcttctatccaagtcttcttttaaatctttgacttgggcttgtgattgcttgttttcctctacaaggttagcaacaacatacatagaggaggaagaacaagaattttcatctatgtttgagctacaaggtacatctaacaagtcatcacaagaggtggacacactagccttagatgtactacatgagctagctacacatggcatatcatcatcaattaaattacatgtgatgcctatgtccacctttagcttactaaatgcattgccaatgagaagagactcataagcttcttttatcttcttataagaatcacaaagttccttataagaatttattagctccacatttgagtctttcaaagagagaagagttttctctaaaatttgatttttcttcttctctttggcaatgtatttactagcctccctaagcatgtcaaaaagatcatcatatgaaggttcatcatcatcaccatcatcatcaacaacacaagtattttcaatagtactatcgagagaatcattgtttacctcattcttaccatttgtcattaagcaatgag

SEQ ID NO: 56442 - DNA, 19634 bp, Oryza sativa
  unsure (1)..(19634): unsure at all n locations
ggcacggtaaacagcgctagttgacgtggcgctgaggtgtctaagttcaacgccacacgatttgacgcggtcatttttgaaataagttttggcaacagtttatttataaaattagttttttcaaatggtcaaattgtcaaaatttgtacggtatcatgattggcatacagtgcttttgcgctacattattttgatttatttttcaactacgagaacttttgctaaactgctattggaaagtttcagggttaagaaaaccttaataactgcttctccatcctaaaatataaggtacaaatctagataaattgattgatggtctcataagagagttgggagtctcctttccaaaaaacaaaaaagaagagagagttgggagtttcttcaaatcaatattgaaagctcggaggaaatcaaatgcaatgtgggccaggagctcacgacatgttaagccactcccaaaaactttggactcgataatggtgagttaaaaccaaaacatgaccatcttcccggaggcaactcaagagcgtaccaaaatgtcaaaaaagagaaacattctctctttatactccgtcaggttacataagtagaaaattagaacagaacctgatgcaccaaaacagagttgggcgcaatttggatgttggcaataagccaacaaactgttccatgttcactagatattgatagttacagcctcccaaaatagacaggatttattcaatttaccacaagataatcaagcctttattttactacaaaaagtaaaacaatagtacattcactcatggtcttgctttcgagcagagcagaaagagaaatgaatggggcataataagtcatgtgcttataattatcgcagccgattgtgccatcatcaaacctggcattttgtacaaccatccgtggagtggcaggagcaggtcaaaagatgaacacaacgctgtcgtggaccctgttcttctgattctgcgcaacacactctgatatccacatcaagttcctaatctcctgctcccgtagccttatgtaagcaaagaaaacagcatagtggaactgcgcaaacaagatatggagtcaaagatcccagcatgagaatccgcaatagtggcataatgctcacaagtttgttatcccctcatattggactagggataaaataaacagaactagatgagtgcactcaagcatgtatgcaggcttcagtgccacatgcattcttttagcaagagaaactagctctttgcggagtgcttattattactccctacggttccataagtcccgtcgttttggacaaggttgaggtcaaactattagagctttgactatcaataacttcaaaaatatttagtttgaaggcactagaacatgtatatttatttatcgtatattgtatagtaggagatcatagtcaaagatatgttttggagactgtcgttgtccaaaatgacaactatggaactgagggagtaaactcgtaagtggaactagaagatcccttgaagaaagttggtatattaaagtccaaaatgagaatgcagatgcacccccaccatggaggtcctaaggtaactaatataaaacaatgaaaatcatacctgctgttcaaatgacaagcacagcctccgcacttcctcctcatagaaggccttatccaacatttggctttccccatacgaaattttggcaaaaatagcctggtatggagggtacttctccattacaccacggacctacatgatgtgaaaaggaaaaaggtgttatggaagtccaaaaaaagaaggatcaatgtaatggtgatgatgatgcaaaaaaagaagaatcaaggtaatgtgatgatgatgcatatagtgtaactaacatattttacaggaattctttatgtatgctaatggtgcaccacactcttttttcatctacctatacaacaaacttaacaaaaagaacagcgtcaagccagaacaaaactatggttatactagtaagcatggtagaccaaagggcaataactaaaactacctattgctactaatgacgggcacaatagaagagaagacaaaacatataatagctaaagcagctttccaatctgctccagatgaaaggcacagaaaaaatagtttggcacacattgatcaaagcataaaacatgtgtaagaccatgcgctcccatgtaataatatgcccattccattactcaaggaaggttccaacacagaattttcaaaacaaataaatgtaataccagtatacaaaaaaaaaatcattgtgtcttggctgaaccaactactccacagacgttgatatagagcagtcagaaaaccaagttcgatgtatgcccatcacacgtgatacgtgtgccacaaaaacatctcccgtggaataccacgattctccatctcttgtgcagaaggcgttcggcctagggcatcatttttgttcgataggacttccaataaatctatttagtatgatgagtggtccttttgctaaacatgttggtaacactccaatagtgttcatttttcatattagcagtttaagttggccaatgtaagcaaatatgagaagcaagatgtgattaaacaattgaagatgtatgtatactaaaacgtgctagaactgaactatgagcataaatgaagacaaacctgatcaacatcttcacaaacagccagttcttcatgaccatatggatacctggaggtcgaaaaaaagtattacaaacatatcttggcaaaaggtactatcaagctggttctaatagaaacctacaataaaccaaagttggagtacagcttccgacggtcatctctagtcaactctgtaccaatactagaaaacatgacagagagatgtcagtatcacatgattgtgcacataacaacaaacaaggaagtatgtaacaaaattatacggtttgaagtggaaaacagaaaaaacttggcaacctacctgtttattgtaatgttcacagctcttctgtctgcttcaaatgacagaagatcgcacataatctcagcagttgcaccaccaagtttctgtataacacaaaaagtcaatatgaacactagatgaaattggaggatacagttgaagccactatatttgtgtagttcatacttcacagaatttgtaaaagtcctcaaggtatgctttgtaaagagtgttcctcataatctcgatattcatgtcatccaaatcctgtaaaattcaggcaactctcattatcaagttagccttggtgttcaaattattaaatggattgtaatttattggacaccacaaaaggttacagctatttacctcagatgtaatgcattctgagaagtatggggctaacggtgtgtcaaccaaaaccaatctgtaaagctcgcgcatattttgagcaactgcaagagatgcaatgctattgcatggcaaaaagaacacttagtatcataagaagacctccactcaacagattcgataaagaaatcaccagaatacctgtcaaacattcccaatggatggcatttctccaatagttcattaacatctctctcatgcaatgttccggtaacaataagtacaacattgtcgatcatgtggccatacctgcaaatgttatctcatcagaccaaactatgctgcattactaaagttgggcacattgacatgtgcagacaaaacagaagtgaaagggcatatcctagcaatattgttgcttacgttatatactgtaagaatgtggatagtggttcagtcgcctggcacatcatgtgtttgtactcatcaaccagtttaagagtgcacttctccacaattgtagttgtgtgcaggggtgaaggttctgcagttaatcagaaataagttcatagtacagatgtatcacattagcgtgtaacaagcatgcactgatgcactgcaattatatcacgacaagcatcaacgcaaacagtattccatataagaatagggacatgtggattctaggaactatagcaattattcctaaggaaaataactaaatcctcagtggtttaccggaattcgatcaaaatatacccttccgagtggtctctagtaaaagctaagttgcgaccctctacatgtatagggcaaatcgtatcctttaactgctgcactcctacagaatgcgaaacctatgatactctagaccaagctaaacaacatatcagaacaatctgttaaagcgatccattgactttggtttcttgcaagcatagggcatcgtgggcttaatcaactacttgaaaatttcaggcaaagagcaaccaaattagggcaacccccaaatccccaaattggcatcgcaattcgcgcggaccggatcggggatcgccgatcgatcaggacagtcatggcggcgctacccaatccgatccgatccccccaaaaaaggagatcagagggcggcggcggcgagagagggaggtcgtaccgttctggaggtaggggccgtactcggtggcggtgaggtgcatcttgacgtcgtcgaggttctcgcactggcagaggttgttgtagtcggcggcggtgaggaggcccgaccggttcccccgcacgatggcctccaggaagccgtcgtggatgttgaacgagagcatctcccacccgtacatcctgtctctctcgccggccggcggcggcggcggtggcggtggcggcggcgggaggggtggatcgggaggagggggggagggaagccgcggcggtggcagatccgggtgcggatgcgggcggggtttgtatgagacgagacgagatcggtcgtgctctgctcgcgtgagcgtgtgggatccaggattggcacgtcggcagtgggccccgtgcccgcgtcagtgctcggggaccttccaggccgggccggggcgggtcaggcttagtgggctgggtattttggttgcgggtctaaagcggaaacgctaatacgcgcgcgcgtttcgggcctagaagacccagcgccgctgtgccagcgcgcgcgcctccttgctcttttttcctttttttaccatttttttccttttctttcccacttttttctgattttttttatctttagcatgttttgagtttgaaagtttataaattttgatttgaaaattttaaaatctgaacttgaaagcttttaaatctcaacttgaaagtttttgaatctcgatttgaaaattttcaaatcttgatttgaaattttttgaatctcgagttaaaagttttcaaatctcaaattgaaagttttcaaaattttcaatctgaacttgaaagttttcgaatctcgattctcgagttgaaagttttctaatctcgattctcaagttgaaagttttcgaatctgagttgaagtttttaaaatttgactttaaaatttaaaacttaaatcaaaagttttcaaatctaacataaaatattttcaatctattagtaaaaaaatctccagaatctttcctaattactatcattagtgttaagtatattaactaatactagcaaaatgcccgtgcgttgcaaccgggtagtagtgggatgagtactgtttgatcttaaaaaaaatatcgaagcaactaagcctgatcataagcatcaatgatgtgttctatgaccacaaaagcaaatttgttcttggacaattagtctactctacatgtgtggcatgtaaatgatgcttataacatgtgggcccgatgattgtagcatgggaataatggatgggcgaaaaatactgttgcctttgcacataaggcgacagacgaaaatttgcgtgacaaacaaataaactgatatttgtaagcctaacgagtgtaaattggaaccacaacactttgtaaggggtattacacactctctttataggttgaggtcatttattatcttgtattatattttcttttatgaaagttttatatttttttcgcattcgatgctttttatctcgataaatatttaaattgaagagcataagatttttatcttagcgaattaaaataatagtaagatgacacttatcctctagctctctcgtttttctctctccctcgcttcttctcaccactgctcctatccgttgtcacaggccaaatcaactactgaccccattccatcgtcgttggtcttctttttcctctcggcatgtgctcaaatcaaccaaggagacgtgatcagtgagtttggtgccaccgaataaggtcgattatgatgggtgcctctttctcatcctactgtcaccgtatctagattccctaagtttagaccatgtttgagaagagggaaaagaagaaaattaagaagatatgtaaaacgaggtgagtcattaatgcataactaattaagtattaattattttaaatttaaaaaataaaataatatgcataggaggagcggaagatggagaaaaatcgagcatgggagacggtccacctaagatgtacattagctaacacacgggtggtcgaccatggatgaagcatcgtgtgcgcgtcgagtcatggttctggggtagtgttgcgcttctctttagcgacttcgagctcctcgtctatgctattgtagcctccgggcactggcggcatggaaagctcatgtccgcatgcgatcaacactcagaatgcgacgatttagcttagtttagggcacatgaccaaaaatatgcaacgttttcttctgtctcactatcccgatctgatgctatgagcggaggatgattgttggatgcttggagtgaaaagaatcccgatccgatgtgataagcggaggacgattgttggatgcttggaatgaaaagaatccaggaaatgcacattactacaacaaaaacatttttacatatggtcaaaactgatttttttttcgtgtgatttgaccaactgtctgccctgaaaggtgtacggaaatattgatttttccatgcgggtgacgcatccacatgcgaaattttgattttcgcatgtgggcgcctaagtcgtcctcacgcgaaaatgaaaaacgcaaagaaattccaaaaatcaaaactggaaccataaccctagccagccgccaacgccatcatccgcccttcccgtcgccgccatcggcggagaggcggcgggatccgggcaggagggggaggggacgcgtggaggccggatcagcccctcccgtcgccaccgtcggcggaccgcgcgcgtggaggccggatccacccctcccgtcattgtcgctggagcccatcgccctcaccccccacaaccacggcccacggtgccctcgtacagtgcctcctccctagctgacaacacccttatcccgatgagcaacgccctcgcacatcaccctcccccagccagcggtgccctctcagcggcatcaccctattctccggcacaatggtggcaacctcttcacggtagtgccttggcaacagcaccctacttgcggtgcacaacggcatgcccaccaagcttccacagcctcgggacggcggcgtgcttggcctccattgatcagtggtgccggtgttttagtttttatgatttaattttctggaatgattttgatttattgttgttggattttttattttatgatttagtggatatgtgattttgtgattcagcggggtgaaggacgaaaaatcaccacgaaaaatccgaatatttatattagttatagtttatagataggtagttattaagactaaaggggagggggaacagtccccagtctaaaggcgtacatgtcccaaccttttactttattatttttcattcgcacgttttcctaattggtgtgtgtgttttaaaaaatatatatacagcaaagttgtttaaaaaaaattgtattaatatttttataacttttttttagaattacacagtacaacgcaaacacacataacgcacgcgcactcactcctatgaacacatgcaagtaaaccctacccctataagcatcttcgaagactggaccagcaaatactggagagattgactatgagcatcttcgaagactgggccggcaaatcctggagagattgacgaagtcaccacaggtgcctcatcttcgaagactgggccggcaaaccctagagagattgacgaagtcaccacaggtgccttgctgtcgacgggtacgtcgcctaccactgaaagcacaacgccgttaacgcactcactcctatgaacacatgcaagtaaaccctacccctataagcatcttcgaagactggaccagcaaatactggagagattgactatgagcatcttcgaagactgggccggcaaatcctggagagattgacgaagtcaccacaggtgcctcatcttcgaagactgggccggcaaaccctagagagattgacgaagtcaccacaggtgccttgctgtcgacgggtacgtcgcctaccactgaaagcacaacgccgttaaaatcctggaaaattcactcccatagggagtcgaacccaggacctcaagtgttactgaggctcttgtaaccactaggctacaggacctttcactaatatttttataacttaattaaacatgtatgtcgttttgggtacgtgggagagaagtttacaacctttcctcccgaactaaggggtgcctttgatttgtaagaaaaaacatagaaaattagatgatttcaatcctatatgaaaaattcctatgaaggcatttgaattaaatgattgaatcatatcctttcctttggaatctattatattattaaaacagtcttgaaaaaaggcaccacgttcgctgtggaggctagaaattcccacattaatcggtgaaaaagaaaaggagagtccaactagaaatacaatttaaaatagttgaaattcggaattaaaaataaacactattgaaagaagagcccatataagaacccaatacgaaattcattaatattcagaataaaaaataaaataaaatccgaaagtagaaaaaaaagaaagaagagttcgagtagaaatataatttaaaaataactaaaattcagaattaaaattaagcaatattggaagaagagtccatataaaaacccaatatgagattaattaaaattcgaaataaaaaaaataaaaaatcgaaattagaaaaaacaaaaagaaaaattcaactaggaatacgatttaaagttagctgaaattcaaaattaaatataagcaatattgaaataagagtacatataagaacccaatacgagattaaaaagagagttcaaataggaatgcaattttgaaacgactaaaattgaaaataaataataaaatattaaaagaacacaatacattattagttaaaattcgaaataaaaaaaataaaccctaaaattagaaaaagaaaaataagatttcaactagaaatacaatttataaataactaaaattggtgataaaaaataaagactattggaagaaaagactatctaaaacacatgacgagattaattaagtaatagacctataaaagagtagagtggtggcggttaatgggacatctaaaaattattaataaaacaccaaatagaatgatggcgggtaggtcgtgaagcaaccgatcaaggctgttggcgggacttctagaaagtaaaaaaaaaataagccccaatgataatcatatttgatttgtaaaatctcaatgacaataaaaataagaggcagcggacaggttgtacgggagtacaatggcaaagctgccgatggtttggggaacttctagaaagtaaaagaatgaattccaacgatagttatgttcgatttttagaatcccaatgacaataaagaatagatagcggacggtcgtagaggagtatagtggcagcgcttgacgggatttctaaaaaatataaaaaatgaaatccaatgagacaataaattataaaaactataaggtccaattttaaaaggttcgggcttctgaaaagtaaaaaaataaaccccaatcatgatcatgtttgattttaaaatcttaatgaaaataaagaagggaggcagcgggcgagccgtattggagtacagtgacaaagtcgctgacgttttgacgaaacttctagaaactaaaaaaaatgaacctaaacgataattatgtttgatttttaaaataccaatgacaataaagagatgaggcagtggacaggccgtagaggagtataatggcagcgtttgacaggaattctagaaattataaaaacgaaacccaacgagacgataaactctaaaaattataagatccaattttaaaaggctccaaagagaatgaatagaaacaatgatagatcaagcaagcaaataaagaaggatatgacagaagtaacgggtagcaactggtgtaaaattataaaattagaagcacgagaatgataaggtttggtctttcaaaccttatcatataaaaatatataattttgtatgggtgctagccgcgcaattgcgcggtaacaatcctatagagattttggagaaaaaatggcaagagatccaacctcttgaaaaatttcctattggtcaatctctctcatttgattcatgtatttttttctactgcataatcaaatgattattcatgtattttgtattcctatattttacacttgcattcctatcaaaatctttttttcctatttcttcgttttctcaatcatgtgtttcaaagggccttaaagcctgtgttcgggagtgagggttgggaactttcactccctagcacacaaaacgaagcactgtttagcgcgtgattaattaagtattagctaaaataaatttgaaaaatagattaatatgactttttaaagtaactttcatatagaaattttttttagaacacacaccgtttagcaatttaaaaagcgtgcgcgcggaaaacgagggagatgagttgggaaagtagagataaaaacttagccaagtatctctgtagtgtgtttttcatggcagtgattcccctgttgaagctggtataaaggagttggatactttgggtagtcattttgctcggtaatgtgagcaacaatatctacagcgaaatatcacgaatgcggaatctattttgccgtggctggctttctttcaacaaagatattgcaaggggaaaaagaaanagctttgttccaatggaatgaggttcctatcatgctttctataaaagagtggtatttccctacatgcatttgtgtaagtgtgtaacaagtgattccttgaaacatggcaatcactttctgaatatcctaccaccaatgtgatacataggtcagattattccctagtggacaattgtgaacacattacactaatggaatatttgtctttcccttgatgaatttatgcgatactttatccaaagatcgtgatcttcatacatggtcttacgactttgctgaggcctgtgtttttgggtaaacagtcacctccgcctggtcactccgcctggtcactgtgaccctcttttgcgagggggcaccccttctccaagatcacgattgaagaaaaattcttcaaatttagtcaaaaacgttggtgtgaaattcagagaacactaatttataacacagtgtgtcttattaacccaatctagaccaataagattttcaccattgtgccgtaattgcaatgcttttggtttagcataaaagggaaacccaacccctgtacgaggaagcaaaagcctagtgatcttctattgtttgacaattggagaagaaaatggatgattggcttatgggtggtgacttaatggctggctcattatttggagataagaaactagtggaagcttggagcatagattgtttcctgaaagatcatgttgtcatgttgatgccatcctttagtagatgtttgacatttggagaaaatcacacttgggagttgggactgtacttagagaaggctactgcaactgcaattcaaagggtgtagttcacatcaatcaatggcctttagcacatgaagttctgatgcttatgattcgcatcctaaattcctaatatctgaacattgtagatatagtttcagacttctgctagtttgcttttggaaccttgtgggctgttctgtttgactacttccataactgatgaagtttgatgctaactgaggaagatgaagaaagcttgatgtaactgttatgttcttttaaaaaaaataaagaagaagtctgatactaattgctatcatgataatgacgggatggtaaaggtccactttgccttgggtgcctcagccatgagtcatctgatattctttccctcaaacaccatccaaaaacactgaacaggtagtactgatgccctgctactgaagagcctctctgaagtatttctagaatcctaaatagtactactctttggtgaaaaatactttcttttttgggggcaaaactctacaaaattgaaggcacaaaattggtttatatttgtaaatgagcaattttacggtccttgagaagataccatgaggtactaaaaatttagtataaaatttggtacctcataaaatctagatattaagaggtataaaatttacaataaaaaaagtggtaccttatagtatcttatcaagaactgtaaaattgttcatttgtgaatatacccaaaaaaaatgtgaattcattcactccaatgcccccggtatgattaatgccatgaataatctagcaacacaattacaccaaggtatacctgtgtgatacatgcaaaccacaccttttattttgcaagattatgcgaaattacataggtaaatgcaaaccatatttctgacctgtgtaatttattactactatatgtaacttccttatagaatgaaattgtgtgttagaagtagattgttcatttcaagtatgcttatggtatccgttattctgacttgtcaaaatggcatcatctccttagagaaaagcttatttcctttgttaaaggttaacatcaaagcggttctatcatatggtccatggcttattcctcatgcatttatgcatcaacgaaatcaccaaagttttcatgatatcataaaggtcaagtgaagtccatgcactcaagtgaccagaaatttttggacctgcctaagatcagcaaatctagtgaagccatgctgttgacatgtgagattaaggtcactctccaaagtccattctactccttttcttcctttcttgacacaaccattaatctcgtgctctgcttttgtccatggcttgttgtgttcctaacttattgttcttggccacttggttccattcagagaggagtagtttgcactcacaaagtgaagtgacaatcttctttgaagggttaggacatgatcacctgttaagtgagattctgtcttgacttgtgagcagagcaaagcagcaggagcagagcttcacttgatttgcctcctctctggtgaagcagagatgaactccccaaattatcatttcaaaagtggcaaatcaccacttcaactatatatataataatgttcaaattgtggtgtatacatgcttatgaataaagtcgaattttcttctttatttttcttctatccaccgattttctccctatatcgcacgctcgttattacaccagaacgaaaaccgattgagctcagagcatcctgtcggagaggctgggcagccgccggaagaagttgacggccgccggcggcatggggtcccggaacatcgggtggcggaggtagtagaacccgccggcgacggccaccatcttggacggcatggcgtacagcgcgacggcgacggcgaggcagacgccgacgaagatccggctggcgcgcgggtccctccagctcaccagcgcctgcaccctctccccctgcgccgcgacgtcgcccatgacgcgctgcacccgccccgccagcgtccgcagcctctcgtagcgcgcccggagcacctccggcggcggcacggcgtcgaactcctcctccaggtcgtcggcctccaccgtgtcggcctgcgacagccgcgcgtccatgccggcggggccgcgcggccggaaccggtagtaccagacgcccatgaggaagacgtagagcgacgccgtgggcacgggcagctccgggtaccanacgaggacgaggtagaggacgtgaacgagcacggtggtggggcgggctgcgccaccgctgcacgctgtcgagccaccgcgcgagcccgacggcccaggcgagcacccccatgatgcggaaccagttcgccttggcgcgccgcacgctccacgtgtgcgcgtccacgtcgagcatgtggcgcaccacctcccgccccagcggcggctcggaccgctccagccacgcggcgacgacgcgcacggcggcggcgcgcagcgcctcctgctgcgcgacgccgatcgggcggaggtagtgcatccgcggcagcagcggcgaggtgtaggtggcccaggtgtccggcaggtgcgccggcgacgtgaaccgcacggcgagctgcacctcccccatcttcttgagccccgaccggagcagcacgagcagcgggtacgacgccgtgtacgcccggttgctctccagcgtggacacgcgcacccgcaccttcccgatccggtagtcctgccgctgctcgtccccggcgccggcgaaggcgaacatccgccagttgtcgaacaccgccaccgtgagcaccgtgcacgggtcgtacacctgccacgtgtactgctcgttccaccgcgggttgaggctgtccgtgacggtgcgcgtccgcacccacttcttgccgtacttggccacgcagtaggcgtccgtcgaccccttggcgccgcccttcgtcttcatcggcagcagcccgcacgccccgatgatgcccagctccagcacgcccaccggcggcctccacagctgcttcgccgtcggccggtagtcgctgcacacgtgcgccgcctcgtcgagcacgtggtaccctccttccaggcacagacggaggtgaagccggccggagtagaaccccggcgggccgccgccgggaccaatgccgatgtcggaggtgccaccctcgaggctgaaccacctcgacgcgacgagttgccgctcgtggagacgctgctcgacggagttgacggggatggtggcgtgtccgagcagcgccggctccttgatcatggagcggtcctcgacgaggacgacgaggctctcgtcgagcggctcggacacgacgaacatgaggtcctcctcccacgcgaacgccgagccgctgctcctgctcgccaccgaccgccgcgtcctcgccgactggaacccgacctggatcttgacgcgcacgtcgaacggcagccccggcggcggcgccggcacgcgcaggtcctgcgcctcgatcaccgacgcgcgcaggtaccagagcttgggcgactggtacaccttggagcgcgtgtacgcggcgtacggcgcgtcggtgttccacgcctccgggaacgcctcgtcggcctgcgtgccgatccacaccgccaccatgatgtcgccggtcaccatgccgggctcgccgccctcgagccggtaccactgcggcgccagcgggccgtccggctggtcgcggaccggcacgtcggagaggtcgaagcagacgccaccgaggaaggcctcgatcggggacggcgcgccgccgtcccagacggatatctccagcgtcggctccggcttggcgtggttgatggcgaacacctggttccactccgggttgccggtgccggagacgtcgcggccggggcgcgaccggagcgtgtgcgggccggcctggatcttcacgtacggcccctcgcaggcgcggatgccgcgcaccttcacgacgcggacgaacaggtagcgcatcggctccaccaggtcgtacgacgactgcaccggctcgacggcgtcgccggtggacacgaaccgcccggagatgacgcgcggcgaggtggcgtagtactccggccccaacccgccgctcaggtggcgcgcgatgcggacgcgctccgtggccatccgcgtcttgcgcacctcgggcgggtaccccgcctcgccgccgtccggctccggttcaggctccggctccggctgcggctgcggatgctgatgctgatgcatcggcggcgccattggcccgtgcggcccgtgcaccgccggcggcatcatcgggccgtgcgggccgtgcatcggcggcatcatcgggtgatgcatcggcggcggcgcctcttccacgatgatgacagggggatgcaccggcggctgctgcacctcgacggcggcctcggtcggcgcggggatgtccgggaggtccctgggcgcctcaggcgggacctcaggcggcggcgcgttgtcaccaccaccaccctccggcggcctatcctccggcgaagacggcgcctagtcgtagtagtaaatcttgaggccaacctcgccgcggatccagctgagcaagctccgcttctcgaacgggaagtacacgatcccctcctcccctcgccgcgagaactgcgacccgtagatgcgcacgcggccgaggaagtgattcttcccgccaccgccgccgcngccgccggaagggttgaagcggcggtcgtggtagagcgagacgtcgagcgcctcggcgtgcatggcggccgggtcgtgcacggcgaactcgagccgctcgtgccactgcgggctgaggtcgcgcggcacggtgcgcgtccgcttccgctgcccgtcgaagtccacgacggcgaaggcactcgacgtgccgagcccgtccttgggcaccaggtcccgcgcgtccaccacctccaccgccagcctccgcgccacccgcatcgcccccggcggccccggcggcggcggcccagactccggcgggggcgcaccggccgccatggaaacagagtggaggtgggaaaggaggtaagcgaacgagagagaggggagagagtggcgaatggaatagggttcgcttatgatgtgaggctcatggattggatgctttttttgcttttggacgctgcggcggcagctgctactatcatactatggtagctagagtgcgtgcttttggagggagaatctgggcaaagagtgagaggaggaggaagatggatggcggctttcttggcctggaagctcacgatcgctttggtgctcgatcgatggcgcagaatctgatctgcttgcttgctttttttctttcgagtatgtgtgcaggtgatgccggtgtgatctgaattgtcgccgactcgtcgtcttgctgctgctgccgctgcttcttcttcccgccttttttcacctgcgttcccaacagaggcggttaaataacttccaccaaccgcgcgcggcgccggaaaggaaaaaaagaagagattttacacgtgtcatctctcatctgtcctgtgttgtatccttctcggaggattttgatagtattttccttagaagttctaacttttctgttaaatcaaatgtttgaacgtatacataaaacataaaatatgaaaaaaaaaaccaattatacagtttacatgtaaagtgcgtgacgaatcttttgagactaattacatcatgatttgataatgtggtaataacggattaattagtcttaatatatttgtctcgcagtttacaggtagaatttataatttattttgctattagtttacatttaatacttgaaatatgtgttcgtatactttaattttttttaaatggaactaacacggcccttgtgctttgctgcacgctgcacggggaatgcccgaccttttcaggttctcgcctctttggggtaaacgtatctgtttcttccaagagagttaagagtatatatatatatgagtatatatatatatatactactatgccccgttccctaattttttttccaaaaacatcacatcgaatctttggacacatgtataaagcattaaatatagataaatgaaaaaactaattgcacagttagggaaaaataacgagacgaatcttttgagcctaattagtctatgattagccataagtgctacagtaacctagtgctaatgccagattaattaggctcaaaagattcatctcgtggtttctatgcgagttatgaaattatttttttcattcgtgtccgaaaagtccttccgacatccgatcaaacatccgatgtgatatctaaaaattttctttccgcgaactaaacagaccctgtgtacacagtacacgttgcaggggtgcagagttctctgcttttcttgtagattcagtgagatctatgcgtcgtctttgggcaggattaccgattacacatttacacccaatcgtcaaatggccacgtgcaccaaactagaagaagtagaagaagaactctgtttcttttgctcaaaattgcgcaacatcctcaagatgttgttcgacgagacgacggcgagcttaaatcacgagatagctgagtatctccagttctccacgtcgcagagcaaaattagacccatccccaacaaaacacgtgcgtatcatccaggtatacacggtgtatacttagcgtggcactcaggctatctatgtggaatgtggtgccctgttcggtactccacgtggcttgcttatactggtgccacgtaagcactgaatgagaaaggcgttattttttttcctgattcctacttatgcattttctttctttcaaaataaaatcactttgcttatttcatttcccgcatataattccctaatattttagccttttttaagtcgttggttaaattttactcttatcccgattgttcacatttgttccgtcttaatgaatatcttcctacattcgccccgagatctagacaagaaattattgagcacatgagccactggcccaccgcccaagatactttctacgggtagtctaaccaccacctcacatgtgttcctctaccctctattctccagtggtttcgcccttaaccattctatcatagtcatagttatttttttcttctcaaatatttccatgtgggcacaccgtgtgcttctgctcctcggttgcttgtcgtctcctgatacatttatactttgtttctttttcctctttccctctgtcacttttgtctcgaatgcctcatgatcatttagaccttacaacccttattgtcactaacgtgcatagaggttttaatagccttaccattattgtcttgccacctttgtcactcatgcctaggctacctttatcccaacctccttaaggatactaatgatgtcaactatgttgactaatttctctttttattacttaaaagtgtagtcattcatcttccccttccctccctcacttcgtgtgcagtgcatactgcatactctcgcataaaaaatagaaaattccccagataaatagttgttagttaaaaaaattcccattctttaggctagatccattcccagtgatatagccaaaagtatcagaatttaggtattgctaaaactatagaagacaaaagatgaagcatagtcaaccctacatacaacgaatcaaaatgttaagggttcgacccattttctcgaagaaaccttggaatgaaccgcaatgtcgattgcttagctcattttctctagaaaatcttttttttttgaaaaagaaaagttgcctatccatttctactcattgaaacgggggaaaatatgtagtgcaaaccatatatacagtggaaactaccgttga

SEQ ID NO: 56443 - DNA, 4935 bp, Oryza sativa
  unsure (1)..(4935): unsure at all n locations
ttccaagttttcactacatatgtggtttgcactacatatttttccttgaaacggcttacataaagttcttaaaacccagaaaatcacatgatgtacagtgatgatacacaatggttctcaactttttctttttctgttccaaactaggctagcccacgacggtcaacgtaatgcacaatacccggagatgctcgatcgtctaggaagggaggcatacgtatcctggtgttcgatcttgagattgctacgaccgctggtggtgaaaggcagaatttattctatctgcgtcacaaaagtcacaggccagctatgccgacggcgtcctcctcctcatgctcctgtagagtcatagaatgattagattggatagattgtgggcgagtaaggcctgtttaagtttccaaaaacttttttcaaaaacatcacattaaatctttgacacatatataaagcattaaatatagataaaaaaaattaattgcatagtttgcatgtaaatcgcgaaacgaatcttttgagcctaattaggccatgattagccattagtactacagtaacatatgtgctaatgctggattaattaggctcaaaagattcatctcgcggtttccaggtgagttatgaaattagttttttcattcgtgtccgaaaaccccttccaacatccggtcaaacgtccgatgtgatacccaaaaattttcatttcaccaactaaacaggccctaaaacagtactctagaacggagatgatgatatctactactccctccgtcccataatataagagattttaacattttgcttttattgtttgatcactcgtcttattaaaaaaatttgtgtaaatataaaaaaataaaaaattgtgcttaaagtactttagataataaagaaagtcacaaataaaattaataataattccaaatattttttggaataagatgaatggtcaaatagtgtgtcggagaatgaactcctccaccagggaaccgtgaggcccccctttgtgagttcggccggggcagcgggtgagattcgaggatttggtgagcgaaactgtgtggtcttgagggggttagccccctccaagacgatcagatcaaagaggtttatacaagttcgggccgctatgaagcgtaataccctactcctgtacatgattgattgaatgtagaacacaagtgcttgaggttgtgagacccaagcgccagttcgccccctcgtcccccctccaccactaggcctggacctccttttatacctcaaggggttaccacatgggcccaacaacctaacctagctctggtggagaagtattataatctttgcattaaatgcatgtcttgtctcttgacttgggaagccaagcacgcgtcgtcttgatgatggggcctgtcaaatcttgccgcctgacacggggggtgcccctgtcagtcaccatttaatggataaagacttctgggctcctattaaccgggaaacgggagccttgctttgaccagagcggaaggaccgactccggctgggataagaggatgagaacctctcaccatcactattagatgggacatgtcaggctgcacgccgcctgacacccgagcagcgcacaggcgcactagccagtcccatcggtcattcgaccggtcacagaccggttgagtgcaatgcacgcagtagtggcgcgaccgctcgggacgccataaatgcgggtaggtgggcacctggaggtggacacctaacccaccgtacgtggtgacctagagagggggtcgggggagcccgacccctagttacgggagggggcggctgccgcctgacctcaggcccgctcccccctcgggggggagccatgaggcgcctggggcggccttctccctctagtctcggccagggagtggcagccgccctacctcggacccgacccctctcggggaagggccacgtagcattggagggcagcctcctccatccagtctctgggaaggagtggccgccgtcctacctcgggcctgactcccctcggggaagggccacatggcatcgggggacagcctcctccgactagtctttggggaaggagtggccgccaccccacctcgggcctgactcccctcgggggagggccacgtggcatcggggggcagcctcctccctctaaacctgatacccccggatccatatcaccgacatagtgcaagaaaaaaatcaaaatccttatattttatatcatgagacggagggagtagtagcttgcaacgaactaaagcagtgacgtggccacgctcctgtaccgctgactatgctcaaccttggcaacgccgtcgacaaacagctgggtttatgtgacgacgcagacgtcacgccaagataattgtgcgatattgagccaccgtgccgccactacttgaaaaaagtttttgcaggcaagccaaatccatctttacgtacgggtattctgtctgtaaggaaacgcctatgaagatagataaataattttttagacggtagattcacccgactacgaaaatattttcagtgaaaaaaaaatgccgctgccggcgtgtgacaccctgaaaatttcaaatctagattacgggaacaaaattcaggattatcaaaaaacttttctaaaatccgtcacgctggattttatctcccattttctgttgcacttggaccacaaggacaaaaatctacggacaaaatctattttagattcaaatattatttattaaaagaaccatgattatgaaatgtattaattaagaaaatatttgtaaatacaattatctttctgaaatcccttttctatgaattagaacctatttgatgtatttgttttataaataaaaacaaatactagatattagaaaacatcattgtaagggataattccctggaaaactatttttacaatgaaggctaatgttaactaacctctgaaaatctagaagttaactattttggagttgttttacaaataaaaactagaggaaatttactagtgaaaccctatttgcgaactaaaatttttaaagaattcatttcaaaagattcacggaaaagtctagtttttcctccttgaaaggcctagcccaacacgcataatgagatttgtgttaattgtgtgcatttatatgtttgtgccaaagatctccgttaatccattcttgtgaatcccaatccttgttgggattcctccagattcgaattccacagttcgatcctcctcctaagttaataccctcctcgagcaaattattcgggcatctgcaaatactcgaacccagtgattttctggaaacgcctctcagtgtaatatccgttctctgttcctccccaactccactagacggttacagtaccccgtcttttccttgaaccgtcagaataacacagataaatcgatccactcaaagagtgttcccccaaaccgacatccttccttaccttctctttccccgtttgtcttgtcaagcacttcgatgttaaactgatcgaagtcccaaaattctttcatttgccacaataccatttctttccccgaacccttggaaccttgcgatcgaatcaaaacccgcttcatcttttcgactcagcctccctcagattcccttctttcctattttccctctactcgaaatccccgagttcggtctttcgcttgaaaccactaaagttgctcggcagatctaattgtcgtgcgtcgacccgtatattctcaattctatttctacctttgaaccccaccatgacgaatggatttgtatgccataaaccgctcctaaacccatagtcgatattgtccctacctttgaaacactaccgcgtccgatggatttgcatgcccaagcgtcgcttctaaaaatcccatcatatcgtcgtcaatttattcaagtggtcgcaaagaaaccctaagtcaaatacttgggcgactaaatggccgaatcacttccaatccaaaccccagttacaatttcagctcaaagtcaaaagtccagttatacagtccatttataaggcgcccagttatacatacaaaagtccagttatagagtcccgccttatatatgtttgtggagtgatgcaccgcattgatatatcttgttatttttttagtgaattttaaaaacatgaaaaaacgagatatgtgccctcaagagacaaatagactttctgtatttaacttgtttaaaacctaacaacctgaaattaaacgtttcatttatttccctttaattcgaagtttccaacattctctaagccttagatatacaccctccatcctaaaaagattagcttctgatccttagaagttgattttttcctttttacggaacattacacatcaatgcctcatcaaatttagccttacatatttataaagtaatctatcccatattaatggacgtgactacacagctagtggtagctggtttgtctaaatcatctaccacttcatctataagagatactatccacctatacttcaaatacaattttctcttaaactactcatccaatctacgatccgattacaccgttgtgttcgtaataattaaatctttacaacaagatctcacatgattatattttgatgaaaaatcacaaattacttttatgatatgtctaaattatttttagatttcactaagttacttcttagaaatacaaaagtaaattcagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttg

SEQ ID NO: 56444 - DNA, 2365 bp, Oryza sativa
tctgtggtaattttggatgtaataatccccttacatcatttttgtcttgtgtgtagcctactataccttcagatggtaaatcgattcccaaaattgggaatattggtcacatgacaagaataaccaacaagcttattcagttgggaagcagtaacggcacaatccagattcacttgcaggtgatatttcctttctttccattgactcaacagtctttaattttttgaactatgaagtacctgagttctctgctcactgtctcgaattattttttaacaataggaaaatagtgagtgggttgactggcaaacagatgttctagtcaagcgtaatgaggtggagaatgtttatcattgggcttgtgggtatgtgactgtttctttttttgattgcatgctaaacttgcatgtcttgcttctgttttttcactgaatagtttatctatatgtcttgttgctgcaggcgcccaacatcacttcatgaccgtggtagggatagtgatgatgatgacttccgagacagggattatgatgtggcagctcttgctaataacttgagccaggcattccgatatgggatatatagcaatgatgatatggaagaggtgtgtgttttgaatgattttgtttctcttgctttgatggtttgcgtcagtcaacatgtttctctgccagcacattttgttaggtttaatttgagaggattctatggtggataaaatatcattctgttactcgtgctatatattatctacttgagtgactcaccagctctaaccatgttccagttttgcagttccttaaagccttactataccagatactaatgatacttgtttgtttcttgaatgcagaatcaagggacacttgaacgggatgatgaggtatatttaaggatgctagtttacccccatttattgcttttttgttcttttcacctggtattaagttcaatttgattaaaattcagtatagttcctaaatgcttgcttcaatcaaccatgtaaaaagaacagaatgttgcatgcggataatatagtgtctagaaccatatttgttgaagctgtacttttgagtgagtggatttccattgttttctcctttcaggatgtctattttgatgatgaatcagcagaggtcgtaatatcttcactgcgactgggagatgatcaggatgggtaatttgtgatcttaaaacatactttggtatctttggtttttttgtccttgggctaattatgtgtttatgtatttaaaagcagttccctctttacaaattcgaattggtttacatttgatggagagagaggtattactgaccgtttggctgcggttccttcgtcttcacctaattcagaggagatttccccagacactgaggaaactgatgatggtgaagtcgtcattggtactgaggatcatatggatactgtcaatcttgggaatggtcctatcgaggaggcagaagatgcagcggaatttactaaacacccggctactagcacggaggatgagcaactacaaaacgctgaagggattgagcgacacctggatgtttcaaatggtgatgctgaagctagtacagaagctgcagaggcagcaccagtatcttcagccccatcttctgatgaggtgcagacagagagaactgcagatgaacccactggctcatctgattcgggtaattctgtctcagaagttttgccagatcctgaagatagtagcattgatccagccaacacagcagtatcgtctgaacaaactgtggataacgaagacgtggagttaccaactaaggaagttccgtctgtggatgttgaaactaaaaccgatgaaatcaaagcaaatgagtgaaggggcaggaaatctcatgggctaaaatggcatagttgaccagaacagttgttagtcagatcggtcagaaagacaagcaagcctcacctgctcatcaggcatggacatgtccgaagcaaactgctgtacaataaaaagagtgtactatttttgccatccattgtggtctatccctgtacaaaaatgatcaccatcatctaaccgcacgctcgtcatcgcaacatctgaaactggtcaaaatttgtttcaagttcgcctccagttcatgggaaaaataggttggtgccaaacgtcatttgtcagttagtctctgtgtcgtgtcttgatatatggaaaagaacattctttggatggcagctagttctgtcaacgtggtcttttgtttgcttttaggtttaacactttgaactgtaatatgggatgtgctatttatttatagcctaactgttatttgtaattttttccaacatgacgtgggtcagttcaaatggaacacgtcctttttgataaaa

SEQ ID NO: 56445 - DNA, 18182 bp, Oryza sativa
  unsure (1)..(18182): unsure at all n locations
tcttgaagagcacgtccaaccgccaatttccttgtagttttcttgtagaacgtgtaatggtgcttcggtatgtcgttgggaatttccttgccgatggccaccgccatcttcatccatccacggaatttcacaaactggatcagcattgccatcaagtttggatcaatttcgcaagaaacatgaaaacatatctaatctctcgagagaacattcttctgtaatctctttctcgataatctctcactcgttatttttttaacattcttctatgtatcggtttgatacctctctcgctaagcgctcggaattacccgcatgtgtgccggtgcatgcgcatgtgcgcccggccataaccccggctggcaagaggtgaaaaattagctacgttcctataatttcctctctttttatccttgttgttattaggccggtttcttgcatgttctgctacatccttatagacttgtttttttagtaatttccttgctcctctaatttggatgggattattattttgtttgcgctctcagtctagcagtatgctacccgcatgttaaaagaattattaatcggttttgctataattgtggtaacacattttttatggaatcagagtcaaattttagacagttagatttatgtaagatttgtgcatgcgtacgagggccactgacttggttttttggcgtcattaaacaatgcagtcagtagaagaagcagaagaagcagttgtattctatcaaacaaaataacgataatctgtctggataattaattaaggtttgatttaatatttttttcatctcgatttgtcctcacacttttgcatgaagagaagcaaatccaaacctgagtcattaaatatgtgctttgctttctccttacccgagctaatgttgctcatcttccggcacattacctagtagtagcaaacattgtccaaggctacacatcagtggaagaatgaaaatagagaacaaaagagaatgaaaagtagagaagttacgatgtgcatataatgttcaacactataattatataattatattgtacttacaacacacttatatgatataattacactatacttacactacatttacattgtacactacatttacattgtacttacactacacttacacacttaaatagtacttacgttggacttacataataattatgttgtacttacattttaattattatgtaattcctatattaagcatactgtaatagtgtcaatcggttaattaattagcttgctagcttcaggggtgcaaatattatttgttttttcacggtttccacaaattcccgatgctgttcttgttcctttttctttggctaaaatttaagttccaaaaaaagctgtgtttatgctaattttgatcggaagtcaaaaaaggtcatcttttttaccaagggactactagatggatatcccaataacttccacaggctctacggtttgagataattaaatatgcaacttcttcccaagggctgctctactatttggaaataatttaacatgaacttcccaaggacgctacggttttaagataattcattaaattgataactgcattgcattctatagtttgatatgcgtacatgtaatgcgtacatgtaatcctcaagatatctctacgtataactaatctcgcatatcatgcccattcacaattagatctcatctcaactcacaataataatcgactatgctaaaattccatcgacaatttttttcattaagatttgtcgaattttcagccgttaatctaaccatgagattcgtgccctctttgtgtcggcactcccatgaaacgtaactcgtgagcacttgaccacctggtggtactgtacatccatgcacacggctgattatctttgtcgctcactaattaaatagtttaaagttgttgttaatcatctagtgtacggtttcctgtcaaattcatgttacccaaaagcgtagagaggattaaagcatggtaatgatatgagagagagagagaggaggtaagttgaggaaaaaaattacagtgtaaatatagtacttttagagtgtaatttgttgtaattacattgtgactcgttgtaaattacaatgtaattctattagacttgtatgtaatttattttttttctatttttcactaagtgtaagttacactttatttttaactataaggttatatttaataatgaattctgtgttatgatacgtatgattatataagtattaaaaatctgagtgattttatgtcgggtgatctagatactacattaatataacatgtgcacaaacaaatacgaagattatggtggcggataagagccctatcgacaaggctgtcctccatggcaaacacgagcaagatgatctacgggacgataaggtggtttacgacgtggagtagaagcaactcctccttcccacatgtcggcggtgccgtacgcgctatcgcagggcgggtggctcagcctggtgctcttcaccatggtcggtgccaactgcttctacaccggcaaactcatcgaccactgcatgcgcgccaatcgctgaatatggagctacctagacattggccaccgccttcggcggctatggccggatggctatcagcctcgtcatgtacgtcgagctctactttgtcgccatcagcttcctcattctcgagggcgacaacttgacaagcttctccccagcacggtggtggagattctatggtacagctgcacgggaagcagctgttcgtgctcacggtggccattgtcatcctctcgacgacgtggctcaagaacctcgctggtttgggccggcgtggccgacaagtgcttccacatggcgggaagcaacctctagaatctgagcaggttgcccaccacctgcccaccaccctcagcctctacttcttcatctatttcatcggccatggcgtcttcccgaccgtgcactccttgatgaagtctaagaaggattttcctaaggtacactttttaaaatgtatttatatgttttacttgatagtaagtttgctaaattttgtgataacaatcaacaatgtaaatttagaattatggttaatgaaaattgaaaagtcaatggtggaattaaattagcaacaggtttagtaagaatacaaacaaattgttttttattacatgtatgcatggaagacacgcacactcataaatatttttgagaactcgtacatcactaatcatgcacacctcttaatcatcatcgctgctacgttctcatcatactcaccattgcaggtctatatatacatcatgtagataaaatttaagctaataagtttatttgatcgtccaataagaattaggatcagacgaaatgaacactaaaatcatttattaaaataagttgtactatcctaaaaaaagatgtaatgttaatttacagtgatacggaatggcgagtgcattactggcaagtgcaatattcacaatttagcattaatatatatttttgcataatgatgtaaatttagcgtaatgtcagattggcctttagactaatttgacgtgtgcggtgacatggaggcgtactgtgctatattatagcctatcaccccagtggaataaactggtgaatggaggcaattagggtcgcctctcaactatatttggttacctctcatccacccatgtaaaagcaatgtagcttaaagataaagctaatcatgagccgtctaatatggtttaatttatttgctaaaacttgaacttagaatatgcgtctagcacttcaaatgaaataattgtattagccatttgaatacatagtttacgaaattttgtttttaagtaatttaatgcgtagtccaaaacaattttaggtaaattaaaaggtagcatatctaaagttggaagatgtgttgcatcataaacttttcaatgccaagttaaaatagatatctattatgtcgtatatattcttgtactaagtttagactcaaccaacagctatgagaattgttagggataagatgcaaaagttgtagggcactgactattgctcaattaactcatggaagtttcttaaacaatcttggaccttttaccattcttttactgatacttatccatgatctaacggcatatattgtatcaaccgttgcattcaatggtccatatcttcagatgatgtagctcaatgatgttgcattttaagttttacctttcacttggagagatttggcaaacaatgataattgatcattggattatcaattccaattatcgtaatttggtttatgaaaccacgatgatgatgataatggatcagtactccaataatgttctattcctctccaattaatatgcaggttttgctgatctcttcggtgctgtgcagtctcaattacgcagtgacaacattattgagatatctgatctatggtgaggatgtgcaggcgcaggtgacgctgaacttaccctcggggaagctatacaccaggatcaccatcctgacgacactgatctccctgctagagaagtacggactcgagatccagctcattgcaacggtgataaaggagaagctgtcgttgacgacggcagcggcgacggacgccgagaacaacaggcagaccagggtgctcaccagcacagccgtcgttgtcagcacggtggtgctggcgtgcacggtacccttcttcagctacctcatgtcgttcaacggatcttcgctgaacgtcaccattgccgtgttgttcccatgcctgagctacctcaagatctacatgccctgaggaggagttggccacttcgaggtggcggcgatcgtcgggatactggtcatcggagtgtgcgtcgtcgtcgttggcacctacacctcccttcaccagattataggcacatttttgtaacatcccggcctagggcttaataggattaatagaatactcatatcaacaagttgcaacttcttttccggaagccgatctccaaagaactccagggttaagcatgcttggcctggagcaatttgggatgggtgaccgatcgggaaattctttccgggtgcacacgagtgaggacaaagtgtgcagaaaagacatgtgttggtccgtgagggcagtctatgacttatgaaagctgccagatgtaagtgggctcgacctgggagaggcaggtcgttacaaaatggtatcagagccgactctcgcggtttcacgggcgcgtgtgtcgcagttgcgcaggcatggtgcgcatggctggtgtagacctggagtggtcacacagcatggcacatgcgctagcactggacacacggacgtggccaagagaggacgttcctggcctggggttgatcgacgggggcgtcgatctctcttaagggggtgagggtgtaacatcccggcctagggcttaataggattaatagaatactcatatcaacaagttgcaacttcttttccggaagccgttctctaaataacttcagggttaagcgtgcttggcctggagcaatttgggatgggtgactgaccgggaaattcggatttcccgggtgcacacaagtgaggacaaagtgtgcagaaaagacatgtgccccctctctatgacctatgaaagctgccagatgtaagtggccttggcctgggagagggtgcagaaaagacatgtgccccctctctatgacctatgaaagctgccagatgtaagtggccttggcctgggagaggcaggtcgttacaattttagtaattaaataagtttcaaattctttttttactttgtcctaaaaaaacaacagatatgttatacagagtgttaagaatcaactgagcggctatatattacatgtgtactctcctggaatgcctacgtgtattatcactaaggaagtttgtcacgcccagaaattcacaagtaatttccgaactaatttgtacattaagacccttgttcaggaatcagccgaggtacacaaactgacaatttaatatacagattcatcagaataactaaaacaataaatacttacataagaggcacttagtcctcaccatgaagaaaactgcagcgaaaaataaaatctagcgaagcttatgctccactcccacagtcagctcaactgggatctaagccaaaggtcttctccttctggatcctttttcttcaactgaggttcgatgattattgcaagaatgagcatatgacatactcaacaagccacacagtaaatatgcaagtgcacaaggataccaaaggatggcataatataggctcatttgcaaaagcagcatttagcaaagatactcaacaagccacacagtaaatatgcaagtgcacaaggataccaaaggatggcataatataggctcatttgcaaaagcagcatttagcaaagatactcaacaagccacacagtaaatatgcaagtgcacaaggataccaaaggatggcataatataggctcatttgcaaaagcagcatttagcaaagatttaagagtagtaaaacagtagagtaattaatcatcaatattaatcaacactgaacagcacaccaatgctgctcaggcccaatcaaacctgaacaaccaatcccggtcgtacagatcaaacctccaaaccaggaattaaccattccaaaccaggagtcaaattaattatcacattgttatcattaatcagtagtgtgggactaatcatgaaaaacattgctcaactcgcccataaccgcaggcatggctattcgaatagttttactctggccagaggtgtaccactgtacctacaagacacgattccacacatgttgccatgccccgaagtaccactacggcactgcaaagggggaaatcgtgacaatacccttcgcacaacacaactcaccacagtgcaccattcctggatcataatcaccccctctataaatataaccagaggcatggactccccagcgacccccacggacttcttgccgcttctcagtctggtgccccgtaatgaatcatgctatacaaaaggtaaagccgttgcccacgctagcttgtggttggcacggttaatgtctcacaacagtagctcgcgaaccggtccttaattgccatgagcacgaccttcaaaaccatgtgctcacaacccaccattaaccaggttttaattattaattaattaacataacatgattaaccatcgtgatctaccattaaatataaccataattaataataataatataatataatttatatttaatcctctttaattagctaatgtttctaagcatgactaagcaaacatacatatggcatttagctgaaccaatccaatatataaggttcatgctaatcaaattataacccataggaaaataaagtcatcttcagccgttaattaattgggaaagactcaccacccgatggcattcgaaaataattcataagttgaaataaaacattaactttaaacgggttcaacatgctcaaagtgttgtttgggatttgtgtgacttgccttgcaaacaagcgtcttcaattcatcttcaggaacttctccaacgaacgaatgatcctccgaaacaacggaaaactaaacctagaatgcaaaacgagaaaaacactaataaaaaccaaataaatagtacaattaaagttcataaatagatagagcttgaatttagatgaattatgagacttgaacgacctccttccgagttcgtatgaattagatatgaattttacaagatttaattccaattaaacctattaaagaaaagactattccaaattgattaaacaatttacaaatgatttatagctgagacaaaagattaaaacatcctccggaaaagattagatcatatttggtagatgacatttattaaaaaggaataatatgtcattgaaaagagatgacaaatttatattaattttggatggccaagatggcgcggttgtcagcgatgacatggctgccacgcaggatcgacactggcgagcccgggaacggcggttaccagcgaaccacggtacaatgacgcaaacggagggcaccggaagagaggagatcaaggcaacccttaccaccacttacgcaacgacaaacggcgagggagatggccggcgacgagctccaaagggcggcaaccttgggttgacaatggcgacggctttccggcgatgggcggcggcaacggaggggtggacgagcttctcctcacagctacgaatccaatggaagcaacggcgaccgaaggcgacgatagacgacgacgaacagcgcggccggagatagattagatcggcttcacggtgacgaccacttccagcgggggtttggcgcaaaggaacgggtggccggggtagctctcacccttgcgaagccgagggaggtgacggggctgaccggcgacgggcggggcgacggcgcacgacggctggagaggcgaccggaggtggagagagagggagctcgcggggaggcggctagggttagggaaaaaattcgggaaagagggggaaacggaagaggaggtcgaggggctgctatttataggattcgtgcgaagagattggatcaaaaacaacgggatttggcgagagaaaaacgagggtttatccgagttcgccggaaaaacggagctcgaaaccgcgtcgaattcacgcgatatacaacgatattcaaaggggtttcttagggataaggtagaggagatcgaggggaatccgtttttgcaaccaattttggaaacggagcacaggatgcgacggattttgcgaaggaagcggcggcgcacgcacacggctcggctctgtacggctcggctggaggaggaagaaggtactgtagcgagggtagataaagtagacttttcctgggcttccttttccttacttgcttggcccgattgctagagggaagaaaactggacttcggctaagagagagggagaggagtgggctgaattcggcccaaacaaagaagaggaattttaattaactttttaatttaaataatttctgaaatgatctttcatttattaaaaatacttccaatgctcaaataattctggtaaaaatacagaaaatacttgggaatacaaagtatttaataaaattttatctagctcaagtttatgttcaaatttttcatagattttattcacacacttgctttaattattaaataaattctaaaaattcctttttcacaacaatttataatttagcgattttcagggtgtgacaaagtttcataactttcattgtcttcttgttgactaactatcacagctaaaatttaaattttcgagttagttaagtttttagttgttatgaagttttttcatcatagtttatcttcttccacccttagttttaaatcactagtaacacatataaaagttgggatttgctatatatgtgtctacattttttttggttttatctataaattatttttggtttgtttcttttagggcttattagcctacaactgaatcttgtcgattatgaaagtatggtgaaatatggcgcaaatggccatgcattttatgagattatttttttatgagagatcggtagaatatattcccttcgtttttttaatagatgacgttgttgacttttaaatgagtgtttgaccattcgtcttatccaaaatttttatgcaaatgtataagatataaatcaatgcttaaagtcaagcataatgaggtggagaattcgtatcattgggcttgtgggcatgtgactctttgttttttttgattgtatgctaaacttggatgtctttacttctgttttttcactgaatagtttctctatatgtcttgctgctacaggcgcccaacatcacttcatgactgtggtagggatagtgatgatgacgacttccgagacatggattatgatgtggtagctcttactaataacttgagccaggcattgcgatatgggatatatagcaatgatgatatggaagaggtgtgtgtgtgaatgattttgtttctatcgctttgatggtttgcgtcggtcaacatgtttctctgccagcacattttgttaggtttaatttgagaggattctatggtggataaaatatcatcctgttactcgtgctattgcattatctacttgagtgactcagcagctctaccatattccagatttgcagttccttacagccttactatactagatactaatgatgcttgtttcttgaatgcagaatcaagggacacttgaacatgatgatgaggtatatttaaggattctagtttacccccatttattgcttttttgttcttttcacctggttttatgttcaatttgattaaattttcagtacaactccttaacgtttgcttcaatcagccatgtaaaaagaacggaatgttgcatgcggaaaatagtgtctataaccatatttgttgaagctgtacttctgacagagtggatttccattgttttctcctttcaggatgtctattttgatgatgaatcagcagaggtcgtaatatgttctctgcgactgggagatgaccaagatgggtaatttgtgatcttataatatactttggtatgcttgtttttttttttgcccttgggctaattatgcatgtatgtatttaatagcagataggctaacctttggaatcctattttcagaaagaaatacatataccaatatgaattcattctaggattaactagatacacacaattcgtgagagcacttttctaatgtatatatgctaacctttaccataggcttaagacatagttatactaatcttggtttatttaataattgaaaattacatatgtactcgtagtatgtgctatgaattactcatataaatttaaattcagtacttaattttaaaattgttttatctatttttaatacttataggcactttttaataacggataaagttaaatactactcaggatttcagcgcatgcctatattttaaacctattaagaggtcagcgtaatgtatagtgacgctgagttccttttacatggctaatttgtgccaagtcgggtagtgctgagacgttttagttcagcgtcatcagggttagcgctgaggtcacggtctatttttttaaattagtttgacatggtttatttttaaaatttttatagaaggattaatttgtcaaaattacagtgtaaacagaagtatccaaatcaatacgtatagtgatagaccaatcttttcctcttttctttcttcccacgtgggcctacttagtccattcaatcgtgcatggaaccttgcccatgatgctgcatgagccatgcacaactgtgtataggcgggttgcatagcatcgtacacgcgtcagaaaagcattatgccacctagaccaacaggcagctggcaaaacaaccatcatgagaataatagatagattattattttgtttgctctccgtccagcagtatgctacctgcgtattagagggattattaattgagtacctatatttatgtcgccatatttttcatgaaaaaatagtcaacatgtatttacattgtaagtctttaaattacatatgtaattttagtgtatttacaatgtaagtcccaaaattacatatcaagtctctaaattacatatgtaattttctaattttacaatgtaatttaactttgcaaccggttgtagacataatggaggaccgtgtacacaatataggagaagaaaaagcaaatttattatcaattgtacgagtccacgaaatgcaaatgcaaatgagcacataagagttggagcttgataaggtgtcccaagttagttacgctttcggatagctttgatctgacacaaaaaaatatctgactgtagtcaggccccaaatatgtcgccacacgtgaagcaaaaccttattaattttgttgacataaatgaacgaacaactaataagcatactgtaatagtgtcaatcggttaattaattagcttgctagcttcaggggtgcaaatattatttgttttttcacggtttccacaaattcccgatgttgttcttgttcctttttctttggctaaaatttaagttccaaaaaaagctgtgtctatgctaattttgatcagaagtcaaaaaaggtcatcttttttaccaagggactactagatggatatcccaataacttccaaaggctctacgatttgagataattcaatatgcaacttcttcccaagggctgctctactatttggaaataatttaacatgaacttcgcaagggcgctacggttttaagataattcattaaattgataactgcattatgtagtttgatatgcgtacatgtaatcctcaagatatctctacgtataactaatctcgcatatcctgcccattcaaaattagatctcattttaactctcaattaataatcgattaagctaaaaataccttgacaaatttttctgttaagatttgttgaattttcagccgttaatctaacctttagatccgtgacctctttgtgtcagcgctcccacaaaacgcttaacctgcgagtgctggacctggactacctggtactgtacatccatgcatacgactgattatctttgtcactcactaattaaatagtttaaagttgttgttaaacgtctggtgtactgtttcctgtcaacttcactttgcccaaaagcgtacaggggatgaaagcctggtaatgatgagagagagagagaggaggtaagttgaggaaaaaatacagtgtaaatatagtacttttagggtgtaatttgttgtaattacattgtgactcgttgtaaattacaatgtaatttcttttagatttgtatgtaatttatttttttccctatttttcactattacactttaataataaattatgtgttatgatacatatgataagttatacatgctatttccatatgtgtattaggtaattattaaaaatctgaggtgtttggtttaaaagtctgtcgggtgatctataaattcattattactaataacaggtacacacacaaacacaaatattatagcggtggataagagctctatcgatgaggctctcctccatggcaaacatgagcaagaagatctatgggatgatgaggtggtttatgacgtggagcagcagtagatcctcggctcgttctgcatgactggcgcttccttcaggagaagctgcctcaacctcagcaacgtgatctgcagcatcgggatgctctacgtgtcgtacgtgctatcgcagggcaggtggcccagcctagtgctcttcaccatggtcggcgccatctgtttccacaccggcaacctcaacgaccgctgcatgtgctgatcgcggcgtacggagatactccttcggcggctatggccggacggccatcggcctcgtcatgtacgttgagctctacctcgttgccatcagctttctcatcctcgaggccgacaacctcaacaagctccttccggcacggtggtggagatcctagtgtactaggtgcacgggaagcaattgttcgtactcgcgacggccactatcatcctcccgacgacgtggctcaagaacctcagcatgctcgcctatgtctagcggctgggctcgtctcgtcggtggcgctgacagtgtcgctgctctgggccggcgtggtcgacaagggcttccacgtggctcttgagtctgagcgggttgcccactgccctcagcctctacttcctctgcttcgcaggccatggtttcttcccaaccgtctaattctcgatgaagtccaagaaagattttcctaaggtatactttttaaaatgtatttatgtgttgtacttgataataagtttgctaaaatttatgataacaattagcaatctaaatttagaattatggttaatgaaaatttaaaagtcaatggtggaataaaattagcaataggtttaagaacatgaacattttgtttttttattacatgcatgcatggaagacatgcacactcataattgtttttgagaactcgtacatcactaatcatgcacacctcttaatcatcatcgttgctacattatcatcatactcaccattgcatggccctcatatattttgttggccctcatataagtttattttgatcatccaattaaaagtaagaattaggatatgacgaaatcaacattaaaatcatttattaaaataagttgtactatcccaaattaaaagatgttgtactacttataaattttgtaatgttaatttatagtgataaggaatggcgaatgcaatacggaattaatggcaagtgcaatattaacaatttagcatatatatatatatatatatatatatatatatatatatatatatatatattgcataatgccataaatttagggtaatgttgggttggcctttcgaccagtttagcatgtgcagtgatgtggaggcatactgtgctacattacagcatatcaccccagcggaataaattggtgactagcgtggaggtgtattgttctatattacagcctatcaccccagcagaataaactggtgacttggaggcgattagagtcgtctctcaactatatttggttacctctcatccacccatgtaaaggcaatgtagcttaaagataaagctaatcatgagccgcctaatatggtttcatttatatgttaaaacctgaagttagaagatgcgtctagcacttaaaataaaagaattatattaaccatttgaattagagtttacgaaatttttttaaagtaattttatgcgtagtccaatacaattttagataaatcaaaaggtagcgtatctaaatttggaagatgtgttggatcataaacttttatatgccaagttaaaatagagatctattatgttgtatatcttcttgtactaagtttagactcaaccaacgtgtataagaattgttagggataagatgcaaaagtggtaggacattgactattgctcaattaactcatggaagtttcttgaacaatcttggaccattctccattcttttactgatacttatccatgatctaacggcatatattatatctactgttgcattcaattgtccatatatttagagatttgacaacaatgataattgatcattggattatcagttcgaattatcataatttggtttatgaaaccatggcgataatgagaatggatcagtactccaataatgttctattcctctccaattaatgtgcaggttttggtgatctcttcagtgctgtgcagtctcaactacgcagtgacaacaatgttgggttatctgatctatggtgaagttgtgcaggcgccggtgacactgaacttacccacggggaagctgtacaccaggatcgccatcctgacgacgctgatcaccccgctagcgaagtacgtgctcgtgatctagcccatcacaacagtgaatgaggagaaattgtcgacgacaacggtggcggcagcggacgtcgagcacaacgggcttaccagggtgctcaccagcacagccgtcgttgtcagcacggtggtgctggcgtgcacggtacccttcttcagctacctcatgccgttcaacgtatcttcgctgaacttcaccattgtcgtgttgttcccatgcctgagctacctcaagatctacatgcctcgatttggagttggccgcttcgaggtggcggcgatcgtcggaatactagtcatcggagtatgcatcgccttcgttggcacctacacctcccttcaccagattatatgcacagtttgattgtgcatttgtgggtaaggttgtaggttttggtagtgattaaatatgtttcaaattctttttttacttttttttcctgaaaaaacaacagatatgttatacagagtgttaagaatcaactgagtggctatatattgcatgagtactcctggaatgcatttgtgtattatcactaaggaagtttcataactttcattgtcttcttgttgactaactatcgcagctaaaaattaaattttgagattagtaaagttttcagttattctcaaatttttccatcattgtttatctttttctacccttagttttaaatcactagtaatacatgtaaaagttgggatttgctatatatctgtctacaattttttttggttttatctataaattatttttggtttgttttgttcaaggcttattagcctagaactaaatcttatcggttctgaaagtatggtgaaatatgacgcaaatgtccatgcattttatgagattatttttttacgagagatcggtagaatatattcccttcattttttaatagatgacgtcgttgacttttaaataagtgtttgaccattcgttttatccagaacatttatgcaaatgtataagatataaatcatgctcctcttatttggatgggattattattttgtttgcgctgtcagtagcagtatgctacccacacattagaagaattattaatcggttttgctataattgtggtgacacattttttatgaaatcacagccaattttagatagttagatttatgtaagttttgtgcatgcgtacgagggctactgacttggtatagtgtcgttaaacaacgcagtcactagaagaagcagttattgtcaaacaaaacaacgataatctacctaggtaattaattaaggtttgaactaatattttttatctcaatttgcccacacacttttgcatgaagagaagcaaatccaaacatgagtcattaaatatgtgctttgctttctccttacccgagctaatgttgctcatcttccagcacattacctagtagtagcaaacattagccaaggctacatattgatgaacataagaaaatagagaacaaaagagaatgaaaagttgagaagttacgatgtgcatataatgttcaacactataactatatagttatattgtacttatactatacacactttacagtacacttatatgataattacactatatttaaactacacttacattgtacttacactacacttgcacacttaaatagtacttaagctggacttacatgataattatatttatattgtgcttgcattttaattattatgtaattcctaatttattaaactgtaattttgtgatcactagttttctagatgaaatttaatttatgttgtgtattttaatcgacttacttatttttaaatggctgtaatctagtctaaaattgaaccaactattataggctcaattttgtggcgcctgagctatagatagtcctcaatgagcgatgtaaataatatatttacaaatagctaataagcaaactgtaaccgtgtaaatcggttaattaattagcttgatagcttcaggggtgccaatattagttgttctctcatggattctacaaattcctgatgatgatcttgtgcctttttctttggctaaaattaaaagtttcagaaaaagctgtgtcatgctatttttaatcagtagtcaaaaaatttcatcttttttgccaagggaccagattactagatggatatcccaataacttctaaacgctnnntatggtttgagataatttaatatgcaacttcttctnaagggttgctctactatttggaaataattcaacatgaacatcccaaggccgctatggtttttagataatacattgaattgataattgcattttgtaatttgatttgcgtatgcgtaatcctcaaggtatctccacgtataactaatctatcatccccattcacaattagatctcatctcaactctcaataataatcgactatgctaaaaatccgtcgacaaattcttttgttaagatttgtcgaattttcagccgttaatctaaccttgagatccgtgccctctttgtgtcagtgctcccatgaaacataactcgcgagtgttcgactacctggtggtactgtacatccatgcatacgactgattatctttgtcgctcactaattaaatagttcaaagttgttgttaattgcctagtgtattgtcaaattcactttacccaaaagcgtacaggggatgaaagcttggtaatgacaagagagagagagagagagtgagagaggaggtaagttgtggaaaaaattacagagtaaatatagggcttttagagtgttagttgttgtaattacattgtgactcgttgcaaattacaatgtgattt

SEQ ID NO: 56446 - DNA, 11212 bp, Oryza sativa
taccaggtagtccaacacttgcgagttaagcgtttcgtgggagtgctgacaccaagaggtcacggatctcaaggttagagtaacggctgaaaatttgacaaatcttaacggaaaaatttgtcgagatatttttagcttaatcgattattaattgagagttgagatgagatctaattttgaatgggcaggatatgtgagatttgtacgtagagatatcttgaggattacgtgtacgcaaatcaaactatagaatgcagttatcaatttaatgaattatctaaaaaccatagtgccattgggaagttcgtgttgaattattttcaaatagtagagcggcccttgggaagaagttgcatattgaattatctcaaaccgtagagcctttggaagttactgggatatccatctagtaatctggtccgttggtaaaaatgatggcattttttgacttctgatcaaaattagcatagacagctttttctggaacttttaattttagccaaagaaaaaggaacaagaacaacatcggaaatttgtggaaaccgtgagaaaacaactaatatttgcaccactgaagctagcatgctaattaattaaccgattgacactattacagtatgcttattagctgttcattcatatgtgtcaacaaaattaatacagttttgctacatgtgtggcaacatatttgggggctgattacaattagattttttttgtcagatcaaagctatccgaaagcgtaactaactgggacacctgatcaagcttcaactcttatgtgctcatttgcacttcgtggactcgtacaattgataataaattcgctttttcttctcttatattgtgtccacggttcaccattatgtccacaatcggttgcaaagttaaattacatttaaaaaaacaaaaattacatatgtaattttgggacttacattgtaaatacactaaaattacatatttaatttacagacttacaatgtaaatacatgttgactattttttcataaaaaatatggtagcataaatataggtgctctgaattagtaatccctctaacatatgggtagcatactgctggactgagggagcaaacaaaataataatctatctattattctcatgctggttgttctgccaactgcctattggtccaggtggcacaatgcttttttgatgcgtgtatgacgctgcctatacaccccgcctatacacggttgcgcatgcctcatgcaatatcatgggccaggtgccatgcatgcacgattgaatggactaggtaggaagaaagaaaagaggaaaatattggtctatcattgtacgcattgatttggctacttctgtttacgccgtagttttgacacattaatccttctataaaaactttaaaaataaaccatgtcaaaaactacttaaaaaaatagaccgtgacctcagcgccaaccctgatgacactaaactaaaacatctcaacaccactcgacgtggcacaaattagctatgtaaaaggaactgaacgtcactatacattacactgacctcttaataggttttaaatatatggcatgcgctgaaatcctgagtagtatttaactttatctgttttatcaaaaaagtacctataagtaataaaaatagacaaaacaattttaaaattaagtagtgaatttaaatttatacgagtaattcttagcacatactacgagtatatatgtaattttcaattattaataaataaataaaccaatattagtattactatgtcttaagcatatgataaaggttagcatatatactttagaaaagtgctctcacgaattgtgtgcatctagttaaacctagaatgaattcatattggtatatgtatttcttgctgaaaataggataccaaaggttagcacatatctgcttttaaatacataaacgcataattagcccaagggcaaaaaaaaaaagaggataccaaagtaagttttaaggtcatctcccagtcgcagagaacatattacgacctctgctgattcatcatcaaaatagacatcctaaaaggagaaaacaatggaaatccactcagtgagaagtacaatttcaacaaatatggttctagacactattatccgcatgcaacattccattctttttacatggttgattgaaacaaacgtttaggaactgtactaaaaattttaattaaattgaactaaaaaacaggtgaaaagaacaaaaaaaaagcattaaataggggtaaactagcatccttaaatatacctcatcatcccgttcaagtgtcccttgattctgcactcaagaaacaatcatgtatcattagtatctagcacactaaggctgtaaggaactacaaatccggaacatggttagacctggtgagtcgttcaagtagataatgtaatagcatgggtaacaggatgatattttatccaccatagaatcctctcaaattaaacctaacaaaatgtgctggcagagaaacatgttgactgatgcaaaccatcaaagcaatagaaacaaaatcattcacacatacacctcttccatatcatcattgttatatatcacatatcggaatgcctggctcaagttattagcaagagctgccacatcataatccctgtctcggaaatcatcatcatcactatccctaccatggtcatgaagtgatgttgggtgcctgcagcaacaagacatatagagaaactattcagtgaaaaaacagaagcaaagacatccaaggttagcatgccatcaaaaaaaaaaaacaaagagtcacatacccacaagtccaatgataagaactctccacctcattacgcttgactttaagaatatcatttatatattatatatttgcataaaagttttggatgaagtgaatggtgaaacactcatttaaaagtcaatggcgtcatctattaaaaaactgagggaatatattctaccgatctctcataaaaaaataatctcataaaatgcatggccatttgcaccatatttcaccatactttcagaatcgacaagattcagttctaggctaataagccctgaacaaaacaaaccatagataaaaccaaaaaaaaaaaattgtagacacacatatagcaaatcccaacttttatgcgtgttactagtgatttaaaactaagggtagaagaagataaattatgatggaaaaacttcagaatatattaaaactgaactaatttcaaaacttaaattttagctgcgataattagtcaacaagaaggcaatgaaagttatgaaacttagtgataatacacatgcattccaggagagtacacatgcaatatatagctgctcagttgattcttaacactctgtgtagcatatatgttgttttttcaggaaaaatagaatttgaaacctatttaattactaccaaaacctaccaccatacccacaaatgcccgatcaaaatgtgccgataatctggtgaagggaagtgtaggtgccaacgatggtgacgcacactccaatgaccagtatcccaacaatcgccgccacctcgaagcggacaactcttcctcggggcatgtagatcttgaggtagctcaggcacgggaacaacatggcaacgacgacgttcagtgagaacccgatgaacaacatgaggtagccgaagaagggcaaagtgcacgccagcaccgtcatgttgacaacgacggctgctggtgagcaccctggttagcccgttgttcctattgtcagccaccgccgccatcattgccgacagcttgtcctctatcgccattgtgatgggctggatcacgagcgcgtacttcgccagcggggtgatcagtgtcgtcaagatggcgatcttggtgtacagcttccccgtgggtaagttcagtgtcaccttcacctgcacatcctcaccatagctcagatatcccaacactgttgtcactgtagagttgagactgcacatcaccgaagagattagcaaaacctgcacattaattggagaggaatagaacattattggagaggaatagaacattattggagtactgttccattatcatcatcgtcatggtttcataaaccaaattatgataactggaactgataatccaatgatcaattatcaattggttgccaaatctctctaagtgaaaggtaaaacttaaaatgcaacatcattgagctacatcatctgaagatatgtaccattgaatgcaacggttgatataatatccactgttagatcctggataagtatcagcaaaagaatggtaaaaggtccaagattgttcaagaaacttccatgagttaattgtgcaatagtcaatgccctaccacttttgcatcttatacctaacaattctcatagctgttggctgagtcaaaacttagtacaagaatatatacaacacaacacaatagatctatcttttaactcggcattaaaaattttatgatgcaacagatcttccaaatttagatacgctaccttttaatttatctaaaattgtattggactacgcattaaattacttaaaatttttttcataaactatgtattcaaatggctaatataattatttcattttaagtgctagacgcatcttccaactttaggttttagcatataaattaaaccgtattaggcggctcttgattagctttatctttaagctacattgcttttacctgggtggatgagaggtaaccaaatcccaacttgagaggcagccctaatcgctaccattcaccagtttattccgctggggtaataggctttaatatagcatagtacgcctccacgctagttaccagtttattccactggtgtgataggttgtattgtagcacagtacgcctccacatcaccgcacacgtcaaactagtcgaaaggctaacgcgacattaccctaaatttacatcattatgcaaaaaaatatattaatgctaaattgtgaatattgcacttgccattccatatatctgaaattaacattacaaaatttataagtagtacaacatcattttttagcgatagtacaacttattttaataaatgattttaatgttgatttcgtatgatcctaattcttattagacgaccaaaataaacttattagctcgaattttatctacatgatgtatatgtagacctgctatatgatgggagcgccaacaaagtatatgagagccatgcaatgctgagtatgatgagaacatagcagcgatgatgattaagaggtgtgcatgattagtgatgtacgagttctaaaaataattatgagtgtgcgcgtcttccatgcatacatgtaataaaaaagtaatttgtttgtattcttactaaacctggtgctaatttaataccaccattgacttttaaattttcattaaccataattctaaatttacattgttaattgttatcacaaattgtagcaaacttactatcaagtacaacacataaatacattttaaaagtgtataggaattatgagtgtgcgcgtcttccatgcatacatgtaacaaagaaacaatttgtttgtattcttgctaaacctgttgctaatttaataccaccattgacttttaaattttcattaaccataattctaaatttacattcttaattgttatcacaaattttagcaaacttactatcaagtacaacacataaatacattttaaaagtgtataggaaaatccttcttagacttcattgagcagtaaacggtcgggaagacgccatagccggcgaagcagacgaagtagaggctgagggcagtgggcaacccgctcagcgcaaccgacaaggccagcccgaccgccgagataggcaagcacgctgaggttcttgagccacgtcgtcgggaggatgacagtggccgccgcgagcacgaatagctgcttcccatgcacctggtaccctaggatctccaccaccgtgccggggaggagcttgtcgaggttgtcgcccaagaggatgacgaagctgatggcgacaagctagagctcgacgtacatgatgaggccgatggccgtcaggccatagccgctgaaggtgaggtggccgatgtccagtagctcagcgatcgacgcgcatgcagcggtccatgaggttgatggtgtagaagcatatagcttggtgaagagcgccaggctaagccacctgccctgcgagggtagatcagcgatcgacgcgcatgcagcggtccatgaggttgccggtgtagaagcagatggcttggtgaagccacctgccctgcgataccagcatggagagccacatgccctgagatagcgcgtacagcacggagagcatccttacgcttgagggagcatgttccttacgctggagggagcacgtgcgctgtacgcgatcgtccctagatcttcttgctcatgtttaccatagaagggagcctcgtcgatagggctcttatccgccgccataatctcatgttccagacggttgacgtttgaccgcacggaaaaaattgtttctctactagtgtactaacggcttctataattagtttttttctactagtgtacgaacggcttctataattagtttttttattagtgcccaaacaactcatgcaataccctatataatatccgatgtgacgtgccaaagctttatacccatggatctaaacaccccctatgaactgtaaatatgggatggatgtgctatttatttatagcctagctattatttgtaattttttccgacatgacgtgggtcagttcgaatggaacacgtcctttttgataaaaaagaaatctctctgcactcctcatacactacacaattgattttcgaaacgatttccacatcagccttctgttatgttacattactactaggttccatcaaaatttgaacaattttatatgttcttgtacagctctttcaaagagggccaattgatcttcatgatcactttagcttacgctgctttctactactcgactcccctggctgcacgttgcacctgtgcttagtgtaggggctctcctgatctccggtgggctcgaagtagagcttccggtgcagcctcgccgtggggctctcctcttcctcttcctgctcgcgtgggtcgtagtagaggtcgccgacgttgatgctccggtggcggcgctcctcgaactgcacgctcgccgccgcctccagcttcagtttggagaggttctccatggccgccatcctgatgccgtctatggagttcgccgtgttgcggttgcggtgcaggtgcttcgtctccaacttgtagtggagcttgtactcctggttcttgtagaacacgtcgaaaccatgcttgggtatgtcgttggggatctccttgccgatggccaccgccgtctgcatccatccacagaaattcatcacaacgcgggatcagcattgccatcaaatttggataaatttcgtaagaaacataaaaaaataaaattctaatatctcgagtggataactcatcgtgtagcttttacttccaaattcaatacatatggttgtaagaaattctgaaagaaattgaccgtgttgagtataatagcatctatcactctaaaaatcaagttgaaattcgacttaagctttgattaacaaatgataaattcgggtgcgaatagtattcatacaataaattagtcccttttttttatatctcaatgtgtgatttgattttgtacctaagttttttccttttggagtgggatatgtatatatgttgtatatatgaatattgctacgtttttttaataaaaaatcataaactaaactatttgaaagggttttaaacaaatgagggacgaggtatcaaaatagttaatttctcgtacaaacagttgagagtgagtttggcagaaattaaattgagtgagttttgtaaaatttagttacctcattgcaccagcaggaggcgacgtggttgatggtgtagccgccgccgccgaggaggaggagcggcaggttgaagctgcggatgaagctgacgcactgggcgtggccgcgcgtggtcaggttcagctcgccgagccggtcgccggcgagggagtcggcgccgcactgcagcacgacggcctccggctggaacacctccatcaccctcgccatgatcggctcgaacagccggtggtactcctcgtcgccgatgcccacgctcaccggcacgttcagcgcgcagtagcggccggggcccttcttgccgacgtcggcgacggcgccggagcccgggaagaagccgccgccgtgctggtggaacgacaccgtcatcacccggttcgacgcctcgaaggcggcctggacgccgtcgccgtggtggacgtcgatgtccacgtagagcacgcggcggaagtgggcgagcagctcgcggatggcgagcacgatgtcgttcacgtagcagaagcccctcgcgccgccgcggcacgcgtggtgcatcccgcccgaccagttgatggcgatgtcggcggtgccgctcccgagggtgcgcgccgcggcgagcgacccgccggagtagcggaggcagtaatcccagaggcggtcgaacaccgggttgtcgacgccgcggccgccgcccttgccctcgacggcgtagatgcccctggcgcgcgccatgtcgccgaccccgtcgtcgcctccgcagccgtccggggtgaggtcctggaggagggcgaggtagccctcgtcgtggaagtcggcgagctccgccgccgtggcgggcgccgtgcggaggcggcgcatgtcgccgagcatgccgtaggcggcgacgaggttgtgcgccatggtgacgcggtgcggcaccatgacgtggccctcgccgtagtcgacggtggagatccccgggtcgtagtagtagcacacccgccgcttcttgtcgtcgccgcacgacggcgaaggcagcgaattgccgccgccgccggccatggccatgtttaacctagctacaccggcgagatgcagacgtcacggtggcgcatgcaccggacgtacacacgcacatatataggctaaacatatgtaaggctgatcgaagcccagttcgtgccggagttggattgttaattgacttttaaattattaattaatccgaaaacaacttccaaattaacttccaactacctgatcggaagtttggaacggaactcgtatatatatcctcttaactttcttcccgtgcaacggcgtctcctccccgcacgcgcgcttcctaaccctacctttcctttttttttcttttaaccttcttccatatatagatctaatcctctctcgctattttcttttaaccttcttccataaccccggccggtgagagctctcgtccacagctcgtcacatcatcgttgtcacgcgcgtctccaccggtatatctcctccgggcgtgcggcagcggtgtaggcggtgcgcacgccgcggccgacatcgatctacaaattggtgggagaggtgagaaattagctacgttcctataatttcttctcttttttcccaatttttgttattaggctagttaccctgcatgttctgctatatctttctatacatgcttccttcgtaatttccttgcttggatgggactagaaaatcgatgcgcccgttggcgcgctcaatatttatagcctattatattattatttaatgggttttaaaatttaggtttaaaactagaatagtgcccgtgcgttgcaacggataaaaaaatacaataataaatggatgacaacgatttaattatatcttcaggatattatctaaataacattatatatttttttatgaaaccttatatgtttgatattgtgcattagagtggccatgatggtaaataacattccaggaaaatatatttgttaaaccagccgtatcatttagagttttatagaattgaaagaaaaataagtactcccttcatcaaaaaaaaactcaacctagaagtggatgtgacccctcctagattgatgtatgttgttctaggaggtttttgttagacggaggaagtatttgttgaatcgtcatggccagttcattagttatactaggtaaaaccccgtgcgttgctgcgggagttcagtataataacaataagtaaaaataatgtgtaaaatagctaaacaatataaacttacataagttgatatggtttatgataatttaaatttaaatagatatatataataatgattcaaatgtaaaagtaagatgatgtggctttatgagagaagaaagggagtgagatactttggaccgtagattaatcgtgtaaggcaaaaaaaacaattgatatgatatgatttaatgggagaagagaaaaataatactaactaagtgaggatgaatcatataggtatatacgatattataaaaaatgatgaagatatatattgaaatattatgtgaattatgtgggatgatgatttaacatgcttacattttaaaactctaaaatgtaataaattataaaattatagataatataacatgtttgcatgatgtttaaatgcaataattgttagtggatgatgatgtggcatctttgcatgttgagctttgggatctagtgggttataactttataataagaaaagattatatataaccctatttttgctcatattacaaccctgataattgatagcaaaatttctgaaataattttgatgccaaattttgtgaatttaattttgaaataatttgattgatagcaaaataattatgtctgaatttaaatatgcatcaatgcaaaataatgttgtatgagcaaacaatacaaaatgatgtgtgagcaaatgtttgcccagagataagattgccttttcatacaacttaacggagaggagttaacaatagtttggctgtgatggaatttctgggagaaatatgcttgtacgatggcattttcaggaagttgtgtttgtcgatggcatttctgggattagggtgtttgttaatggtatttcatggattttctcttgattatatggatgagtatatgttaaatattataaaaataatgaatatatatgtgtgttaaaaatattgtgaataataatgtgaaggaagatgattggatgttgtttcgtagaattaaatgaattgtagatgatgttgcatgcttgcataagttttctatttaattattgctagtgaatgatgaggtggtatatttgcatgttgagttttagaattagtgggggttataat

SEQ ID NO: 56447 - DNA, 2178 bp, Oryza sativa
ctaatttctgctattactacttgattattgatacaattaggccgtcacaaaatcacattggttagggtgggtttacttcgtgaaaagaaaaattttaggtatcagatcggacgtttgaccggacgtcggaaagggattttcggatacgaatgaaaaaactaatttcatcactcggctagaaattgcgaaacgagtttattaagcctaattaatctgtcattagcacatgtggttattgtagcactatggctaatcatagactaattaggctcaaaagattcatctcgcgatttccatacaaactgtacaattaatttttttaatctatatttaattttctatgtatgtgtctaaagattcgatgtgatgttttttaagaaaaagttttgagaactaaacaaggcctaacgaggccttgttacaaattatgtaatactctgatcaaattaattaggcgtacatcgacgtgtgccgcctgcggccggcatgcgcgcgggagttcacgttctacaagggcgccataaaccaaggctgcatgcatgccgtcaacgtgcatcgttggctaccacgagggcttcggctgcgacagtactgtgcatgcttaatcaatcgcgttggcccgtgtggaaagtaaaatagaaatggaaagcgtgagtggaacgcgggcgaatttttttgcgcgggcatatgcctgctgttcggacgacggaagaaaaaaaaaatccaaatcctattgccccgtggatcggcggattagataattacggagtaaaccgatgacgtccaacatttgttaacaaaaatatcttcaatttttataatagtagcgaaatacacgatgaacaaaataataacatatgtgttgctttataatacaagcatattatttatggtccttttcaagtaaaaatatacataagattttacatgaataaattcaattcttgttaggatgtgctacctgtctaccggctgaaaaatttcttgctttcagccgcttattttagcgctggataaatgtatcggacgatccaacgatttcctgcggcgctatcagcctatcacacattccgtcagaatttaaaagttgtcctttttgcaaaatagccatcaattttgtgagaattttagatacacccttcttaggcctaagctgttacaactttttcgcataactacctatagtttttttttataataaaaccaatgaaggaaaacttcctttctccttcgcatataatacttaagtagttttgtatacaagattttaaaaatactgttttgtatacaatctttgtgtgcaaagtactcggtatgctagttttttttgctaatttttgccatatgtgttcattcacttttctaacatgtatatagactggtcaggatcacgtctttactaccgattcaccattctctgtttgttttgttacgaccttcacgaaagtgaaacgagacgagaattgtaggcttctttcctaaactaaaagcggtggttcttgcctccctgtgcctaaagcgcggtgggcgactgcggtttgagtctttatcgatcgggtagatccatatgttcttgggggagacgaggtgtagcgcagtctggtcagcgcatctgttttgggatagtcatctcattgatatttttagtacaacatctaatctagcttaatcaacgtgcgtctagcttaatcaacgtgcgtctactttagttatctcattatttttttgtcaccttttgtattaatttactaataaatgtttcttgtttgtttgtaattttgttagcaaatttttaggtgtaatgagtagttgtctagtatctctcttatttctattttgtttcactaaatgtaagttgcactttatttttaactataaggttatcattaataatgaattctatgttatgatacgtatgataagttatacacgctattttcatatgtgtatcatgtaagtattaaaaatctatcaggtgattttggtttaacaggtgcacacacagacacggggattatggcggcggataagagtcctatcgatgaggctcttctccataggcaagaagatctacgagatgaggtggattacgacatggagcatctcctcctccctaccggcagcaacatggagcagcatctcctcctccctaccgcagcaacatggagcagcatctcc

SEQ ID NO: 56448 - DNA, 4594 bp, Oryza sativa
cggttgggctcgtctcgtcggtggcgctgacggcatcgctggtctgggccggcgtggccggcaagggcttccacatggagggcagcagcctcttgaatctgagcgagctgcccaccgcccttagcctctatttcgtctgcttcgctggacatggcgttttcccgactgtgtactcctcaatgaactctaagaaggattttcctaaggtacactttttaaaatgtatttatgtgttttactttatagtgaatttgctaaaatttatgataacaattaacaatgtaaatttagaattatggttaatgaaaattgaatagtcaatggtggaattaaattagcaacaggttcagtaagaatataaacatattgttttttattacatgtatgcatagaagatgcgcacactcataattagtttttagaactcgtacatcactaatcatgcacactatactcgcacatctcttaatcatcatcgctgctacattctcatcatactcatcattgcatgcttctcatatattttgttggcgttggcgctccattcatacattaggtctatatacatcatgcaaataaaatttaagctaataagtttattttgaccatccaattaaaagtaagaattaggatcagacgaaatcaacattaaaatgatttattgaaataagttgtaccatccctaaaaaaatgttgtactagttatcaatttcgtaatgttaatttacactgataaggaatggcgagtgcaatataaaattaatggcaagtgcaatatacacaatttagtattgatatacttttttttgtataatgacataaattaagggtactgttgggatagcctttcgaccagtttaacgtgtgaagtgacgtggaggtgtactgtgctacaaaacagcctatcactccagtggaataaataggttcctggaggcgattagggtcgcctctcaactatatttggttacctctcatccacccatgtaaaagcaatgtagcttaaatataaagctaatcatgagccgcctaatatgatttaatttatatgttaaacctaaagatagaagatgtgtctagcacttaaaatgaaagaattatattagtcatttgaatacaaagtttacgaaatttgtttttaactaattttatgtgtagtccaatacaattttggataaattaaaatgcagcgtatctaaatttggaagatgtgttgcatcataaacttttctttgccaagttaaaatagagatatattgtattgtatatattcttgtactaagtttagaccaaccaataggtatgagaattgttagggataagatgcaaaagtggtaggacattgactattgctccattaactcatggaagtttcttgaacaatcttcgacctttcaccattcgtttactgatatttatccatgaatattgacaaatattgtatcaaccgttgcattcaatggtccttattttcatatgatatagctcaataatgttgcattttaagttttacctttcaattagagagatttggcaaccaatgataattgattacgaattatcagttccaattatcataatttggtttatgaaaccatgatggtgatgataatggatcagtactccaataatgttctattcctctccaattaatgtgcaggttttgctgatctctttggtgctgtgcagtctcaactacgcagtgacagcggtgttgggatatctgatctatggtgaggatgtgcaggcgcaagtgacactgagcttacccacggggaagctgtacactaggatcgccatcctgacgacactaatcaccccgctagcgaagtacgcgctcgtgatccagccagtcacaatagcgatagaggagaagctgtcagcgacgacggacgccgagatcaacaggctgactagggtgctcaccagcacagccgtcgttatcagcacggtggtgctggcatgcacggtgcccttcttcggctacctcatatcattcatcgggtcctcgctgaacgtcaccgttgctgtgttgttcccgtgcttgagctacctcaagatctacatgtcccgaggaggagttggctgcttcgagatggcggcgatcatcgggatactggtcatcggagtgtgtgtcgccattgttggcacctacacctcccttcagcagattataggcacattttgatcgtgcatttgtggttatggtggtaggttttggtagtaattatataggtttcaaattcttttttattttttttctgaaaaaaaacatacattatacacagtgttaagaatcaactgagcgccttgtttgtatcataatttggcttttagttagtccatttatgcaagccaaattatttagaaaagtgttgagtggtttgctcgagagtcagttaaataaatatatatgtgcagagaagagaagtatcggttatttgcaagttactagcaaagaactatagcatgcagttcggtatatttctgtatctgatcagattttgggctaagtgctgtaaaaggtgcagatggtacagctgatgagattatcgtgttctttgatggttttggatggacaacatcaaggaggcacagtgaatagcttgacaacatgaagacatgatatggattcttgtatttttcattgctgtcaaagccttatggtgttaatctagaaaaaagcataagcaggagccaggtctgtgctggtgttaagggaggtgaccgagatgaatttggattgtatctcgtctatacatactgattggtcacgtgaagtgagatttggtgttggtttgcatgtgctgaggacgattagcgcatgcagtggccagccagctgaggattgagatatatttttatcactttgtttccttctaagatcagagaatagcattatacgcatacatatccatggtactactttatgtgccatatcctgctatggatattaagcactattattagtacaatatatgggctgttgcacttgcctttggctctgtttgtgcatgtcttgttttttattctctaatgatacaagagattctctttttattgggtgttttattttttaagtggtttatttatacttcatgaagggttaaattgaaccatattatctaaaaaaatcctcactagagcattaatcattggaataatcaataaattacttgagccacaattgatggataaaatattcttaaccactacttcttgctattgcccaaaatttgatattggcaaagaacaaaacagatcctacatctgtgaactgagcaaccggggtggcatcactagcacgttgcgcacgtacttacacttgcacagttttatcttccacaacaagagtgaatagccaatgcggtctcttaattttttttatgttagtttaatccctgattttatattgtccaaactccaaataaacctcttaatttatcatgtgacttgatatagtctctaatccaccgaaaccgttatacagacatgccacgtcatcctagcatacatagttaaaatcaaaatattcattctaccttgtatataccatagaaaataagaaagaagaaaggaaacgacaaaacataatgattatcatatctttgtgtctttatttactacatttttatttgtcctttttctctcctttcctctttatttctctttttcttaaaaaaaatggcataggtgaggataaaatcaaagttggatggaagtaagtcaatggatctcaatccgaggaaggcacataatctcattttgttataacgtcacacaaatataactttggataaaagcatatctaacaccctaacctaaacgcttcaacttactacataatattgttcatataacttctaaggttgttttgaacatgctgatttccgtatacagatactaaataaggttttggttaacaaagatgacaaatttcaggactaatcctcgattattgtgattgtatcgatcctcagttattggtgtaaaaaagagtgcatgggagaatttgacatatatcttgaatatatctactcctcagtccgaagataacttcatttctaacatgaacagtttattctaaaataagttcatttctagcctattataaattgtatttcttttataccttttattctaaaacactcgtaatactatttctttatgaaaaataagttcacttttatcctgttataagttttattccttcaatacctttatctatctacctactcatcaatactattttaaggattattccttcaatgtcctttatctatctatccattcatcagaatggaatgctattttttttttcttttgataaggagactttggtcttttctctcaaccttagtttgaagtttgaacaccaaagactaaaaatagagttatttttgaatagcgggagtgtggcgtcactaaaatcatctattgtacatgtaaaattagataaaaccgaataaaataattagataaaaagcactttagcggttatacgaacagtattatgaagttgatagagttggttatccgacttcaaagtatgaggtgttagatggacttttactgagggtatattgacttctcc

SEQ ID NO: 56449 - DNA, 11106 bp, Oryza sativa
aagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagctggtgttactttgatgacctagctagaactatatgcttagccatgcttaattaccactagctcagtcgatgggataattgcagtattagacattttagtatcttggtgagctgcgtgctcgagacatctggccatgcttcatggtcgtaattattcaactaaaatgcgactgaatggtgggctgtgggtgcatggttttgctggtcgcatccatggcagttaaggaccggttcgcgggatgccttggaagaatttatcgtacttaccacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcagtcgaccagattcaccgtgattagtctcacacttaataaatcgacccaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagacacaaaccatccttgtatccccttgcacgtctgcatcgttggtgtggcttgctgagtacggtggttgtactcagccttgctattattcccccttttcagaagtgtagtgcttctgagctgaagatggagttaaaggaccaaggctcagaccccagttgagttttgcctgtggagtggagctgaagccccgctaggatcgttttttttttccgctgctgcttttgtttcggtgtgaggactaagtgcctcttctgtaagtattttacgcttattttacgtttggaactgtatattacttgtcgttttgtgtaccctgactggtcctagacagggatttaatacgcaaaatagtctggaaatttgggttaaatttctgggcgtgacaatggctgcatctttggacaaagctgtaactaggatcttacttccccgcttcccaaaattcagtgtattacgtacttggtcccgttcttgctgagcaacatccgactggagaccatccagcgccagcaagaaccttttgtctctcaattccgcttttagcttattttctagggcatcaagattttggtacttataggatggtcgcccaatggctccttcgagcatctgtctgtaaattttatccacactgaaactttgagaaacatcaacccacatgacaggtgaaaaatggccatcctctttttcatactcacagacatattgtgcaaggattgtcttcccggatccagcaatgccatagatgccaattgttgttgaataacacgggttgttgctggagcctggttcaccgtcccctgctgcttcgcgcaacatatttactatctttgtacgatctacatctcttccaaatactcgccccgtagctgaggaagtagtgcccgacatcgtctcctcgatagttgtctccgtcattaataattctcgattcacaagcccgcccttagttagtttttgtagcttctctaggcttttcttcagcttactggttgtgtagcttcttctggcttttcttcagcagctcacgtaaccatgagtcggtattagagggagagctgacctgcattaagtttaggcatggcagagtcatgtaacatgaaacgtgcttattggcccaaaggaaaattttagtagcatataagttttttttttttggacttgtagttttatggctccttcagaacgcatggatgggcacatgaatcatttctttctatataagtacaatccactaagtacagttatggcaataaagttctataagtgagccatcggaagacgactcacgcgtcgcctcctctcgggcgacacgggaggcgcccagctcgccgtcgcccgccgctccctcccttctcctccttcgcctcaccgctgcccgagcggccggcagcaaagtcgcgcggccgcaaggacggcggcgacggggcttcgctcagtctcaccgcacaagggcaggggggactgccggcatcgggaggcggaaaccgcccagatccgtgccgaccggctggacctggcgcggcggttgctggtggcggggtacttcgttcgggcggtagcatttggcgggggtggcggcggagtttggaggcgctggtggtggaggacgaggctgccagatccgtgccggatctggcggatctggcggggaggcatccggcggcgcccgacgctggcgggaggatgtcggcgtctgctgggggacggtggagccggacgacgactggcgacgggggcagcttcttgtccggtgacggagggtgcggctggtagcgacgggcgcgacgacgcggaggccgcgacggtggcggaggggcacgaggccgcgcctgcggagttggccacccgacgaacagatcgggcgggcgagcttgcggcggtggcggcggagctcgcggcgatgggtcggcggcagcgggtgagcgacggcggctacggcggtgcgcggctggtgatgacgacgacagcggtggctgaggcagccgcgacagcgcccgtggtggccggcgcgaggctctcggtggcgacagcggcgcgcggctggtcacggcagcagcggtggttgacggcgcggtggctatggtatctattactctagcgggtgaatatcaattttcgcaagcgggactagatttatggtattatctgtagctattttttgcaaatggtgatttttcatagtccgactggaaaaataaatggtgacattgggaaaaatcgtttttctggtagtgaaaagtatttgcaagttactctagcgccatcaccattggtggaggttttgcacatctcaacatcatatgtcggagttttacttaagattttaattatttctatctagaagattattcttcgttatgaatttctaaataatatttattggctttgtggttacatgtaaagctacacacaatgaattcgaaaacctcatctcatcgtcccttatttaaaatttgggtttatccagaaggacatttgtctatctttttcttcggacgagtttacgggtcggacgtccgatcggtttagagaaaaatcgggcgccgatgttagtgcccgatttacgtgcaaaactattttaaactgatttttctcttaaattacttatccaaatcatgatccgattgcaccattaaatttgttacaattaaatcttcaaaacaaaaccacacatggatatattccgacgaaaaattttttaagcttattattgaattatttttaaatgttgcacgatgttccattagatatatcggaattgtttcactaagtagattgaaaatgtttcactcgtttgaatcgggtgtcgtttcaccttatataaaaacaatgtttcagcaaatagcgaaagaatgtttcaattcactgcaacatttgatccatacatagtgaaacattataagtacactaggtgaaacatttttcggtggaacaaaaaatgaaatgaattctcttaatagggggtttccaaaatatgtgggttttttttgttgcaatggaatatttcagtgcactgcaacattagatctatacatagtgaaatattgtgagtacactagatcggggggaacgcccgattggctccacccccgtcgggctcccgagccctgtcattctcctttttcttttcatgctttagaatgcatcacatccaacaatttatttttatctattcgacaacaatgcgtaggttgtcttctagcaatagccaataaggcttttgatgggaatctatgagtaaaacagatgattggaaaatataggtaaaatacaaaattaaccacttggataaaccacgtgaattttaggggagaattctaaaaaatccccttgtcttgaaccattccaaataaatttcatatgatttttggaagttctaaatttcaatcttttgttccaaactgatcaaatactcggtagaatatttactgtatgattcaaacactaaatttcttccaaatgagccttaaaaattcctttctacgatgttttcaagcaactttgtactaaagcttcagcgtttaatcttgaaaattaaatgaaaaaacaactgtcacgtgtttgaactaaccatgtgcttaaaaaaatggcaaaatttgcaagctggatttcaccgtcatgtcacaattaattacttatatattattcccatgcatacccactctagtctccaggccattctgaatacctaagcaaaattgtaaaaatggtactccctccgtttctaaatatttgacgccgttgacttttttaaatatgtttgaccgtttgtcttattcaaaaattttaaataattattaattcttttcatatcatttgattcattgttaaatatacttatatgtatacatatacttttacttatttcacaaaagtttttgaataagacgaacggtcaaacatgtgataaaaagttaacggtgtcaaaaatatttagagacggaaggagtactacttttatctcccccagtcctgaaacttcttgtggtgaaggtggaggagggggctagaaggtgtaaagtatactaccattgtggactaacaagtttatctgagcaaggtccaaaatagagttgctaatgatggaacaatctccgaattcagttgatatatcttatcatcctcaagcttgccggtcttttgccatttgatttggccacgtgccatggttaatctatactttctgtaaagttataacccactaactctaaagtttcacatgcaaccataccacatcatcacccactaacaataattacatattcaacctcatgcaaacatgcaagagcatccacaatctatttaattctacaaattagcacgcaagcatattcaatcaccacatctcacatcatttccacaatagttttacaaatctctattatttttataatatttaatatatacttataaacatgttctacattaaagtgcgaatttcatttgtttcttgataaatatcgataagccctgagatttgattttttttctttttactcctacctgaattgtaacgaaaaataatattgaaaattacttagtaattcccacagcaaacacggggaatcccctagtttttaagataaatcatggccatgggaattatgggcttgtttggtttagtgctctacgaatactagtattggtagtgcaatgtatcaattcttttttattattatacggatagtaaatcagaatttttattatagtaccaaattagttttaatatatctaatattgaacgtattttgatattttatttttttataaatatggttagtaatttgaattagaagggggaaaaaaaggtcacttggtttggtttgcagccaaagcgacaaagctgcatgtggagggcgaggttaaggtaatcgtggatgtccacgatgtcctctgcgtcgtagaaggcagatctgaggctctgcacccacttgtccagatacggcatggatgtcatgtgttccatctgcctacgcagctgcggctcaagacatgccaccaggttgcgcagctgggcttcttggtcgcagttgagcaggtcgatgcctttgttcaccgccttggtggtcatgggcgacacgatccatccgatcgtcctgatcgcccacccaaccgccacaacctccaacgccatgacgatcgagactcaaagtaaatgctgcttgttggttaattgaacgatcgatcaatataatcgtctctcgtcgacggagttggagcacaatgcaagactatatatgcttggtgccggccggatttatggaacgaggacctagctatagcttaactcaagtcaagtcaaccccggccggtgcaccatcagtgaggctatctgtggaaattaatctaaaggaaaatcaacccacgtggggtttgggttgttcccccaccttatttttttgaaaagtactcattttattatatagaaaagacagagattagggaaagaatccccagtacaaattgatcatacaccaaaccatcctttctaaagatgagacagactgaactaagggaaacaaattcctgatgtagccatacagtgataatggatgagatcgacaggagtagcggcgttgccgtgacgactacatccatgggccttcattgacgtgcacaccgcttgacaaaccgataatcccctttggttgcctccacgggaacggcacaaattgaaggtttgttgttgagtcgtagattttggtgtgagcttcaccggactttaacagttgatttccacggagtttatcattgaatctgaggagcactgacttgcaatcctgcgaaacaagattgctcggacggtctgccctcaacccgaacgacgaacccagcatgggtaccactgcatagaaacatcaagaaagaggtccccaaactccggccaaccttagtcaagaactaggatggcattgattgatctgctgtctttctacttcagcttggagctcaacaaaggaggatgaggagaaattaacctggtggccagctgcaattccttgatgagcaactatcatccccagcccatctaccaacagatcatgcaagcaccaatccgaccagcaccaacgcagcattctcgagaagcacaggctgccaaatattttgttacctgctgtccttgaatccgagagctgtcgccaccccaacaaacaccgtcgccgccccaacatctggagggggagaggccggagacggagagggtgggtcatggtgtccggggacaaggcagccaacgccgcaactgtcgttgcgtgccggccagatgcagggagggggcagcgccaccaaacttgtgctggatctgacaggttgaagaagttcctttgaccgatctgccttcccctcattgcaactcctcctctgtttttccaaactaaaccctcggcgactaaaagcgactccttccgtcgccgggacgacggtgccgaactccggcgatccatcgacttgaacaaacgggaagaacccgacgacaggaagacccgactacgagagaagaccaacacctaagctaatagattactaaagggacgaaaatcccgccccctcccctcacgccggcgatcggagggtcgccggagatggaagggaaggggccgggagaaaaggggattttttttttctccggaaacgcctgtttcaggttgttcccccacctgacacccaatccctccctgtgaatccccctctcgtccacttgcgcgggtggttggtgggattattagcagatattatccctgggtttggatagagggggattagaagggatcactaccattcaaaataattcagaaatgataagaaaaaaaattgatcatgaaaacagaaaaaaaatcaatgtgcaaaataattgtaaaaagcccccaaaaatagaaaaacgtagatttaccacagacgaattctgaaaaatagtccagaattttttttaaaaaatcataattttggatagattaaattctacaagcagtaaaacatccaaaataatcatatgttttccatagatatgctagtcacagacaagagattgagttgtcatactagtatagcaatagattggaaattaagcgcatatatcgtcttccacattcggccctgcatatactgatctgttgaaacagtacaattacagactcctaaatctgcagttctgctaattgaattaccattctactacgaataacagttctgcaggcaaaccccaaaagaactgacgaaactaaaactagtttatcatcaagcccttgaaaacaaacttttccttgtctccgaatttttcccaaaaataaagagagttcggcaactaccaccatcagcttccaaatccatcaaaagtcatgtctcttaatcttaaaaacctgaaaaacaaacaggaaacattatggacacctgaatagtcatatgaaaatttgtttggaaagtgacaattattctgtgttaatttggaaaactaaaataagaagtgagttatcatctacaattctggaacaaaaatatttttaagacaaggaagaaggtcaggcacgattaagcccagtacatatactcacaattttcagcttttaagcactcaaccatacttgctatagaaaacaaggactatttggacagataaagtacttaccctgatatacatcatctctacttgtctttgtctgaacggaccagaaagccagcgtctcatttttcatattgttcttccctgaaaggttaatccttgaatataagcacagaacttgcaatgccaacagttgcaatatcaacacaaatgagttatatgtcgatttgtccgtactccgtagttctgcactacatatagtaataattgagctagtcaatgatattcatgtttttgtcatatctgtgagaccatgggcagtggcagcactgctgaatgtggtaaattcatcagatatatcatataattattaattatgttcgtgatagagcaggtagctccttggaaaaagaaaagtatgcataatacctgttatatttgtgtttcttggagtatcaaccaataatgtaggacctgtccagcaaagaggaaatcggtcaactttaaatatctataactacctgacaaattttcactcaagtttcatttgcaatttcctttggaatgtattacattacagagagtgcacttctaaagaattgttgaataggcatttcacacttttcacagctattatctcacaacatttcttcagctaaactgttaattttgttgatcgaatcatatcaggtgaaccttcaatgttggaacaaagccaacgaaaaaattgatctttgcaagcagcaggacaagaagctgtgctctgcacctctgcatgagagaagcaactggaacaatgacaggctaatactagcacctaacactgaaatggagctgtctaatttcacttgatcctgtcaactgtcagtatacaaagggagatcgtgcaaaatcagaaagactggtttggcttctactcgctcatcttaatgattggtgggagaaaggacagacaccgagcaccaactaggttagaaatatgactaatacttcaatccatacagccactcaatacatcaactagcaacaaattcatccactagaaaagtcacaaaatcttttcatagtaggaaaagaggagatcaagaatcagacctgcttcttgatgtccgggctgttgccctcgaccttgccctctcccgcaaccggtgaatccgaagcgaggaaggagagatggcgagcggcggcggctgtagcgggatggagaccggcggtgaccgagggcgggaaggagaccagtggtggctggagatatgctgctcccggacctcgcgccgcctccaaacctagcgccgtgaggagtcgaggaagatgagcgccgtgtatgctcgggaagaaaaaaatcgtctccgagacgatttttctgtaccgggggtttggcatggatcgggtggagaatttcccccaccccacctcgggccaggcgaacgcgtacatgcaccacggaagaaaattagatctggccgggatggcacacggggatttcggcccattccccccaaacctagcctataagaacgaggcctgagagatctattcttaaatcatttgtgttgatcaggaaacatgcgtatgggacaaattgatgtgttcgcactatattatcttccatagtcgacctaattttttgcacatttaattttggggggccataaacctgcacgaacggcgttcacgaatcaatgaatcatgggctaacacttgagtaagaaattatcgttgttctcagtcaaattatttgacatttgattttgttttgtatccgtgctagttggtggctcactactgcttccggttcaaaattttcctctcgttttgtgagattgaggtgactagacttatgactagtaattattaagacccacttttgaatcaaacggaagttgtaggaattttggagaattttatcctcataggattatttttctagtagatagctccttgaataaaaggaatagacacaaatgaatcctatggaatacctcttccatgcaagttttggaggaaatttaatatgaagtagaatctcatgaaattttcttttgactttttatctctcctctaattcctgtgtttttcttgtgatccaatcaaacgaccattcttattatttttctgtgttttgcaatgctttatttcagtgccccttttaattggaggaaaaatggaagaaaaacaaagaaattaaaatcgtacactgttcatgcctttaattgctaggaatgagtaaaggaaaaatgtaggaaactttcctattcctatgattctggaggaaaaatataggaaatttaacattcactctaagctaaagttctagctatctcgcttaggatcgagacaaatctagtagctcatggtcacttttctattcaattagtgtagattagatatgtataagtaaataaccaactcaattaactccaataatacagacccatttacggtccaatcaaacactgtgttttccaattctctgttttgcatatgtttcatatcctatttctttgtttttcctattcttacaat

SEQ ID NO: 56450 - DNA, 1719 bp, Oryza sativa
ccatatacccacaatgattgattctccgactggttacatgggataataaatcatatggttagaatatgtataggataagactcgggtattgcgttgtcttgtgtatcaagtaaataacctgtaatcttagtcggttatgattgtaaagtagttatagagatttaaaccgtaaagataaagtctctatcttgtaatcccagcttctccaactatataaggagggcaggacgccttattggggggcataaccacaattgagatcgtcagatcaataccacaatcagcggaatattttcccagacaggagtaagatattacttctcattgagagggtctgaacctgtataattttttttatctcataacccatctactttcctacttgttcgctaccccttttagtattgctgaaatatagttttgacagttggcgcgctaggtaggggcagcgtcaagttttctcgccgactagtgcgatgggatctacatcaggcatcgacgacttcgccttcccccaagagcaggtgtatcgctttggcagccttgacttcatcaccgacaatttcggcaagatctcttttcttagctcggattcaaaccagtcggtaggagacaaccactccactccgtttggtttatcaaatacggcagagacctaccctaaagttttctcccttgagttggcgtcaaaccactcgggtgagatcatgaagacctcaccttcttcaccaagttccacttcagacgtgtcggcataccctcaaatcaccatgcgactaatgtggatgtggattttcattcctcaagaggacaccccttcgttttttttaaattacacagttcaacgcagatactcacaacgcacatccactcacccctatgaacacacgcaaaccctacccctacgagcatcttcgaaactgagccggcaaatccatcttggagattgacgaaatcaccacaggcgcctcgctgtcgacgggtacatcgcctaccactgaaaacacaaagccgttaaatcctggaaaattcgctcccacgaggagtccaaccaggacctaaggtgctactgagactcttgtaaccactaaatagttatcaaaatattcgaaaaaaattgacaacatagatttatatgaaatatatcactccacaaacatgcaataccaaattcaacttttataatttgtaaaaaaaactgaaaatagttattgtacattctcagctttatttgttattgtacatgctgctgctgctgctgattcgactcggacaagaaatgcttttcttttcttttttcttttcattttccaaattcgagtttttttggaagtccaccaaagtcgagttctggcgggagccgtggtcaacgtgggccgaaccaacacgttacggcccaatattagtgggccgcacggagcacaatataagcccgttcaggcccaaccgtacggcaaccacctccgatcccctctcctcactccgtctcggcggcggcggcggcggcgaggcgtctccgacgaaaaccctagcatccctccccccacctcgcgtctgtctacgaagccatggtgagtagcaaccactcccacctctccgttccgatctgctccagatccatctgaccgatttctgttgttcaggagaggcgagatcgcggcggcggaagcagcagcaggaatcctcatggagctccggtggaagaggaggaggagctgg

SEQ ID NO: 56451 - DNA, 1734 bp, Oryza sativa
tgaaggttgctctgttgggaggcactagattggaatatctggtctttcaacaggctagttttataggtgtaaactaggaaaatctatcaatgcaatgacttgctgtagttcctatcaatgcaaccttttgttcttggtgatgttactttactctgttttcctctattttgttttgttgatcaatccttgctccttcctcattcttctctgaaccttccccctttctctctgcaccttctgtttgagcagtacaagactagtcataactaatcaccatgtctgtggcataacgacttgactgaactatatgatttaacctcttttgttagttatccctttatgtctattcaaaatttttaactatcattatgttgagttctctctatttttctaactagttactatcattgattaaaaaaaaaacagtcatcgctttaatattttctgctaaaattctggcaccttcacgacaatgcccttttctctttaatgttatataggtataacagagccaataaaagctggtatcagagatgcaaaattgggtgtggggaagcaagagcaagatgacttcttcacatcagaagataatgtgcaaaggaggaaattaaacatagagcttgaggagactgaagaacatataaagaagcgcgaggtgtgcaatcgaacactgattccttaatattctatttcttcagggttgatgcttgcactttgaaatcttatatctagctgttggcattacatattgatatttgtatcttattcatgcaagagttgctagcatcagccctcatgatccttgagcattttgggcattttttatttggtggttctttttcctgcttggtgcaaatcatgacaatccaggtcatagcagaacgcgagcagaaaatacgtagtgaggtcaaggagatacagaaggtgttcttttgcagtctctgtaacaagcagtacaaattggcgcatgaatttgagtctcatttgagctcatacgaccacaatcataggaaggtaatgtgtttacttggtgcagcgaacttctcttctactgccttttcttttgtgaagtatgggtgcacatacatatattcccccttcactcttacatattaattgttcaggactatatttctgataagttcactgtggttacaacagaggttcaaggaaatgaaagaaatgcaaagcagcagcagcagcagccgtgatgacaggcagaaacgtgagcagcaacgagaagagaaggagctggcaaaatttgctcaactgtatccatcccatgttttagtcaataacaatgataactcaatgatgtgctaactatgaacaaatgtgctgaatgtttattgaacttgcaatttccttaatgggacttcagtgctgatgctcatagaaagcagcagcagcagaagcaagaaccatcagagagctcatcagagagaattacaatgaagaacttgcctaacccttcaaatcaggatcagcgtaaaaccttgaagtttggcttctccaaaatggctccttccaaggtaccccacatctgaacaacatattttgttaaactgatatgaccatttatggaagtaaagtagttgtgtgcttgcatggaactctgtgaatttgttttatcttttctatattctccattcttttttcattgctctagtttgccgttaagttgaaactttcttaggcttttttgttaaactgtaatttcctctcagcatatgt

SEQ ID NO: 56452 - DNA, 2173 bp, Oryza sativa
gtcaaggtctcctcctaatccgattaattacttaattaagctcataattaacttgattagcgaataataatctggtgttaattaggaggtatccgaggccacgggagctgtgcgcatgctcgcagtgtggggaggtgttcaacaaggccgacagcttggagcaccaccaagccattcgccatgctggtaattaactaaattttgatgaaaatttctacaaatttcatcaactttacataaaccgtaaacgatattgatatcaaccatctccattctaacgaaaaatgacaaactgaggttcatgttgtgtgaatagtagtcaatgcttttggggtgtagaacaagttaagatagtactcctagctaatccaagttagtaacactaatgaggaggcattgagatctgcgtgtgtgggtactatatattgcccagtcaatatgattggtttactcatgacaaaatgatgatggatatttccacatagacaccaatattgtgataattattattataatcttagtggagtgacagtgttattagtttactagtttcttggcacatcaaaccatgtgagatgagatgagatgagaggagaggagacaaacagaaaggagaaggaagatgctgctcatcaaagctattaaccccatctttcttttcctcttttcctttgtcttttgtgggttacaaggaagctactgtcttgtgcacattaatcatctttggttaattattttagttaagattggatggcaaaaatacatcaaaaggtatctgtgcctagccatcttttgcatgcttgcagtcgcatctgcatctccatttgttgaaggtagatgggtagaagctttctgactactgatggcatctcaatgcatgtaggatactgcatgcacatgattagttattataaagatcattaattaacagcaatgacagtacagtgcctgattaagacaatgcaccagaagcaatagaatcaatgtaggagtactagaaagaactgcagagtgagatcccagtgcttctacaactacagtagttgggcaaagtatccatccaatctgccaatttattatattagttggtagcacacaggatctgcatgcacttttgtgtaccctcacaaacacgaacacactcacaatttgtgaaattagtactctgaaaggaacacaaagtttcagattgttcaggtgtcgtttactccttcggttccattttaagtgtagttatgagtttcgatatccaatatttaactgtttgtcttattttaaaaaaaatataaaaaaattaaaaaaataagtcatgcataaagtaatattcatgttttatcatctaatatcaataaaagtactaataataaaaaaaaactttcaaataagaaggacaatcaaatgttggacgaaaaaactcaaaactgcacttaaaatgagacagagggagtacttgcttgtcctttgatgcctttattttttttatgaagtttctagggcagctatagctccttatagaatttctcagctttcgaaacacatcagattttcacccaagtttaagaatatatagttatagaattcagaaaataaattaaacaccagaagccaggaatcaaactttaaattctcaatagcttgctactcccctcgttcgatatttgtttagaaaatgatcttttttctggtacgaacaagctacttagcagaatctcaagcttccaaatagatgcagaacatgcatagctgattatacagctttaaactgccatgggccatggcagccactaaggttagttaagtgatcgatgtgcttgcatgaacatgtacatcatcctcttgaactgtttaggtcaattgaagtgtcctatcacatgacagtgctgcactatttgcaatgccattattgttgttgatgcggccgagatgaagtactgatctcctgaatttcagtgccttgattgcacactgtctgctatgataactgtgagcttagcttgcacatgctgatgcactcactgcatttaatgcacttagctagctagctgtgcgtggttaatctctccactaattacattacattacggtagatccaattaattagcttgctccctggaggattagcgagtgattaattttggagtgcatgcaatgcatatgcagtgtcggagctggg

SEQ ID NO: 56453 - DNA, 703 bp, Oryza sativa
acacccttcctccgtactctacagtcgggcctagcaaggcttggttgctccagttcactgtaagtaaataagttgttattatcatacatgcttatttgcgaccggatgagtgttttgtactaacatttcattctcaattgtaggcggaccttctgcaccctgacgctgatgattactcggtccgacgctcccttgaggcgtacctgttgtggttgttcgggtgggtgatgttcactagcacccacgggcacgctgtggacttccggctagtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggttgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttttcttcacataacatgtctaattccgatcatgtttattgcagcgtcgttacgctcacgtccaggtgagacgtggttacccggacttcgtgttcgagtt

SEQ ID NO: 56454 - DNA, 3218 bp, Oryza sativa
ccccgcacgcgctacctccaccaattccgccaccataatatccgtgattgccgccgcccaggccattttttcctctcttcatcctcgctctcgcccctcgccataaaaaacgaggtgatcgtcacagcggcaatcctccccgcaacgaggtggcacaggcatggcggcctcaacatctttgtgttgcttccttttctttatttggtgcactcactgcattcgactattaaactctcttgtttttatttttcactaattatttttagagattatgcataactttccgtttggctaatattgtgcattgttttaaatgatgtttcacatttcagttacaaatggttcatcaaacatctagtgtgatatgccaataattaatttttttaagtaatgtttccccctccatcactaatgttgcatgtatattacaaaactttcatcattcaattacatagcatggatcagatgttctgaaccatagtctcttctattaggtgttgtcatctcatattttataaaactgatttaccttaatcatgttttaaataaataaacccatgaataatgaaaactgagtttccacaaaccagggaaatcatttttttaatcaaaaactactccatgctgtttttactttttagccattgcttcgttcgtccaccccacctcatcgctagcaccatcaccttcttcaccaactatattcatccttctaagacaagagccagtggaccacagcagcattttcccctccatgccacgcattgcgctcccaagtcattcctcaacagctttggcagcatcaccatcaatgtctaacatctttgtcaacaatgaccttgattgtgtcaccatctccatccttagtgcaaccttacatgcatgggcttttgctaattggtgcgcgcgccagatccgtatctagcgcgagcgccctccacccgctgccacgggtctcttttttttagcgattttttctgtgcgtttttccttttttttggcgatttttttcttttcattttgctcttttttattattctttttaaaaatttcagcacaagtgcttttaaatattttgtgttataactttttaaatcatgacttgaaaatttttaaatcttaacttgaaagttttcaaatttagacttgaaagttttcaaatctcgagttgaaagtttttaaatctgggttgaaagtttttgaaatttgagatgaaagttttcaaatcttgagttggaagttttcaactctgagttgaaagttttcaaatctcgagttgaaagttttcaaatctgggttgaaagttttcaaaattgagatgaaaagttgaaagttttcaaaatttgacttaaaaaattcaaaatttcgagttgaaagttttcaaatcaggtttaaaattttgaaaatttgacttcagatatagttttcgctgcctgactgcgacatactccgtactactatagtttagataagacatgataatgtttttagggagtgttacgagatgcaacgagtaactgtatggagaaggagcaagcaagatgacagtgaagaggaagtaaaaccttgcttgccgaacccttttgcccttccaacccatcttctggagccgacgttggaggaggtgagctgcgtgtcgacggaggcctgctccagcacctccgtgtcgaggttctccgtcgggcggtggctcatcggcagccggaactcctcaaaatcatcatcctcctccaggccgtacactccatccccctcctcatcctcctccaccggagctccaggaaaattcttaatgctgttgccgcgatcgagttctccatcaactccctctcgacatacttgctaaaatcatacccgctccccttcttgctgaacccgcgtagctctgtggtctatcctgaacacccaaaaggcagaacaagctggatcacaggatcggtcagatggatctggagccgagccgacgaagcaactatccgagcggatcgaaacggcgaggtcttggttgtggatactcaccatgggaaagaggggaagagatgcgtgctagggttttcgtcggagacgcctcgccgccgagaaggagtgaggagaggggatcggaggcggttgtcgtacggttgggcctgaacagggttatattgtgtgcggaaaaagtacaccgaaggcccctcaacttgtcatcaaaatcgtcccctaatcttttctaaaatgacactggacccacatttcatagacacaaatgggcccatttgttatccactagaagtgtcaaaacagcgaagctccaatgtttgcctgaactcttactctcagaatgcctttatgcttaaaattgatctttctaaagcttttgatagattggaatgggattttattgactctgctcttcaaaggaaagatttttcatcatcatttaattaacctggttaaatcctacattagttcctcttctttttctgtaatcattaatggtcaatcttatggttctttcaatgctaacaggggtataagacaaggctgtcctctttctccttatcttttttttcttgctttaaatgaactttctgatcaactcaataaggttcttcataatcaacacatcaatggcattaaactaagtgattctggacctgttattcactctcttctttatgcaaatgacctcatcattacaggtacagctaatattgaagaagcttgtcagataaagaacatcattgaaaacttttgcaggaactcagtgcaaactccaaattatgataaatccagtataatgttcagtaagaaaaccccttcccacattcaagaggctataaggctcattttccctatcaatctcatggatgccaacactagacatttaggtcaccctctttttgtcaccaatagaaacaagtttgttatctataaattcatcattgataaattcaaagccaagctgaccaccttgaaggctaataatatgtctcatgcatgccgtctgaccttgattaactctgtctttgcttctttacctgtctactatatggctactattcttctcttaaaaaatattcttaataaaatcacagctattattagaaaactttggtgggcaggtgttagagaaggacatgacaaaaatcctttatgcttgagagcttggaaggacatttgcaggcccatttcaaagggaggtcttggtattagagatatacaagctgttaataaaagct

SEQ ID NO: 56455 - DNA, 733 bp, Oryza sativa
agtggtagctgtataaaccagatgtagaggcgagggcactagtcatcagcagacgagacgaccggcgatgaagatggtaaggccaatcaacactggcagaatcatgcagccatggaagtgaagaaaccagtcggcagccatggcaaacgtaggcagcttgtgttgaagatactaatgcctattagtagtgacagcgatgtagccagccgtgaagaagatagcatcagttggcgttataacaagccagccgtgcaggcggtgacaccagtcagcggcggatgcggcggccggtcataataggccagccgtgcaggcggaaacaccagtcggcggcggcgaaggcaagccgatcggtgaagacgtagacgcccaacaacggcagcataataagtcagccgtgcaggcggaagcaccagtcggcggcggacgaggcggccggtcggtgaagacgtagacgcccaacaacggcggcataaaggccagccgtgcaggcggaaacaccagtcggcagcggtcgaggcggccggtcggtgaagacgtagacgcccaacaacggcggcataataagtcagccgtgcaggcggaagcaccagtcggcggcggacgaggcggccggtcggtgaagatgtagacgcccaacaacggcagcataataggccagccgtgcaggcggaaacaccagtcggcggcggtcgaggcggccggtcggtgaagacgtagacgcccaacagcg

SEQ ID NO: 56456 - DNA, 8090 bp, Oryza sativa
  unsure (1)..(8090): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcactactttcaggcccacaaagtcactgtgccgtcgcagtaccctttgggcgaagtgctacggggcaaggaaattactggctgactcagcaagtgggcggcggagctatctcccttcgacctacattttgtcgcccgcagtgccatcaagtctcaagtcctagttgacttcgtggccgaatggacacctgcattctcccctgaacccgagcccgttgaacagccttgggtaatgtactctgacggctcgtggtcacacaagggggcgggcgccgcggcggtactcactttgccaaggggcgtgccgatttggtatgctgcaaggctgcagttcgacacgaccaacaacacgatcgaatacgaagctgtactgttgggcctaagaaaggcgaaagagttgggggttcggcgcttgcttatccgaacagactccaaactggtggcaagtcatgttgacaaatcctttgagacaaaagaagaaggaatgaaaaggtatctagaggctgttcgatctatggaaaagtgcttcgccggtataacggtcgaacacttacctagaggtcagaatgaggaagcagataccctggcgaaatctgccgcctgtggaggcccgcattcaccaagcatcttttttgaagtcttgtacgcaccaagtgtgcccacagaaagcctggacatcatggcaatcgaccaggcagaactgggcgaagatccagaggattggcgaacaccgtttgtcaagtacctcaagaacggctggctcccggaggatgaagcagaagcgaagcgcttacagctcagagccacaaaatacaagctggtctccagccagctgtatcgctccagggtgctccaacccttacttcactgcatctccttcgccgaagcagaggaaatggcgaaagagatacaccaggggctgtgcggtgcacatcaagccgcaagaacggttgcctccaaagtgttctgccagggagtgtattggcccaccgtgctgaaagtttgtgtcgagcaagccaagaagtgcgaaagttgccagcggcatggctgaagccaaacggcacctcagtatgagctgcaacctatagcaccagtctggcctttcgccagatgggggttagacatcatcggcccatccccagtggcgcgaaatgggtacaagttcgcaattatggccatcgaatacttctcccgttgtatcgaagccgaaccactcagtgcgatcatttcggtagctgtacagaagttcgtgtggaagaacattgtttgccgtttcggagtgccaaaagaattcatcgctgacaacggcaagcaattcgactctgataagttcagagaaatgtgcgaagggctaaatctggaaatcaggttcgcttcggtcgcacacccacagtcaaatggggcgtccaaacgctcagatggcaaaatccttgaggcgctaaagaaaaggcttgagggggcggcgaagggtaaacggccagacgaaatgctatctgttctctgtgcccttcaaacgacccccacaaggccaaccaagttcagcccgttcatgcttctctatggcgatgaagcaatgaccccaactgagctaggggctaactccccaagggtaatattctctggaggtgaagatgggcgcgaggtgtcactcgaactccttgaaagggtgagagtcgaagcactggaacacatgcgcaaatacgccacaagcacttcggcaacttataacaaaaaagttcgaccgacagagctattgcctggtcatctcgtcctaaggaagaaggcgaacccggtggcggtcgggaagcttgaattgaagtgggaagggccatacctcatcaagtacaggtccaggacaggctcctttcacctagcgacgctggaaggcgaagagttcaaccattcctggaacgctgcttcccttaagcgtttctatgtctagaatgggtggcacccaaatcgccaacttgtaaaaatatacatattgttatgtaagcctttcggcactatgtaagcccttaggcacaaaaatgcaaaaaaatagaggaaaatgaaaaaagaaaaaaaactggatgtaaggctattatccaccctggaggcctgaaccagtataaaatctttgtgtctttcgcctttttacttgtgtgaatgataattcgttgaaaaaccccaaggcaaacgcctgatcagcgaaaacgccagggggccgaaacgaatcggccgaagaatttctcgccgaacattgagaccgcgacagcttgttttgggaaataactaaccgaacaccgttatactcgatctatgtgaaaacacaagcgcttctttcggcgcgggacaccaccgatcgaaaacggaagacgaaagctaaaaagtcagcagacctatttcgctaatatacgcaaaggggccgacatgttccaacctaacgaaagcatgaaaggtgacaatgcgaaaaatagcgaaaaggaaataacacacatctttattaaacttcgaaaaaataatcgaagagtacaagccatacaacatggtacaagcaaagaaagcaacagcttcacagcctacctcacaaataaattacatcttcgcccccaaagcaatccccactccctaaggaatgattcggcgaacatggctcgtcatcactactaatgtcatacacaaccctaagggggaagggggcgaaacacaaactagaccataacgacgctgggcgatcatttcctgacgatcggtcctctgatggtttcaccaaaagcgaaccatttcctcccggtgttctacatgggcacaatcgtagtcctctagggttcgcccggggtgcgtccacatccagccggcaactttcagaaccttctagctgttgccgtttattatcatctcgcagtaaacgagccgaaaaggacgcctaatcttcggcaaacttttcgccgcaacaaacttctcgttatcgtttcgccaattaccagtggggggccgaacgcatactttccggccacaagcctactaataaagcacaaaagaacaagtgcaaaaggaaaaagttcggatgaaatcaataccactgtccaacaggataataaggttggcgaaacactaatttttccattaacgaaaagtcataagagctacaaggcgaaaacggctaaaagccgaacatgcaaaaagcctacatacacagcagggctaccaacaaaagaaaaaaaaagaaagtcatacgagggcgaagggcctcacacctcagggtggtctcggccttcatcttcctcgcccccatgctcagtagcgggatccgacggcccggggtcttcgcctacgttggcggtagtggtgtctttggccttcgccatcttctcaagttgctcgcgtaggcgggtcttcgcacagtccttgccgccatcctcccaaaagccctttcagaaggcccttaaagccgctccggagacctgggagttttcgggccagtcccattcacgagctcggagaagttttccacatggccgcaaccatgctcgtgaagcaagctgagcacgaaacccaccaaaacacgcgcgcagcagtccccataggcgctagccacttcgacaactgagccggccccttcttgcgtccactcagaaaagtcgaaagccatcccgtcatctcccggggcacccttcgcgcgcgcgccaagatcgttgagggccagcctaagagtgtagtaggcttgcttggcggactccgctgccggtgccatggtcgaagcaacagcttcggccgggacaagacgagcctcaagagacttgatcttctcctcggccgcagcaagttgacgctcccattcggtatcccgcttgttcgccgtctcaagctccgcgcgaagagacttgacttcgcccgtgagagttttgttctccgcgttcgtcttctttagggcgttcgctacaacacgtcgtttgtcatctttatggcgaaggtcctcctcgtttttccggagacgaagctggtacccatccagcctctccaaggcggacttctccgtgcgtaaggggaaccaaattgtatctacagtcattccgatttgagaaagtggtcaaagtggagagagatttgtaggtgagggagaattggagagatattagcagatttgttacagctgagattccattttggcgccttggcggtaatattttggtgggagaatttttagatccgcgggaattatttggaggcaaattgagactcccctgaaaaaaaaaactgagactgtattcttttaaaaaagaaaaatggttttgactacgaattatcgtatcaaaaaaaaattatattttcttttctacctatttggtgggaaaagtttttagattggtggaaattatttggaggcaaattgtgctgtagaatgagactgtattctttattaaagaaaagatggttttctacaactatgaattatcctattttaaatttgtaccgtcaaaaaatttcagttaacttctgtaccattaaatatttggtatgaaactttttagattggcgggaattatttggaggtaattcgtgctttggaggtattgtaaataagattgattgtagcgagagagattgagcgagagcgagagattaagggaatgaatgagcggatcctttattgataacagtgttacaatatataggagggagagaggcggcaaccgaagacgcgatggtttgggaaccatcgcatctgttgctagaatcgccgtgaggcgagaagaggtgtggggcacaaccaaccgtcatgtccctgaattggttgctgctctatccaaatatatggatgagatcacccaaatatttcataacactcccccttgatcgaatccagctttgatcattgctcatttattgttccagatatctgtaaagataatcttagaaataattatagttagtatattaaatacatcacgtaaaactcctcgaaaacccagtgggaaaaataaggagagaaccgtgatatattattgactattgttagatctcttatgagtaaagctcatagtatgatccaaaatagtatattatctacagttatcatttagtaaaaaccccaatgaggaaaagccaaatgataagacatataacttatgttgatattacctcgttaaaaactttggatgagaaaacctaaagggtaaaactcatacaaaggaaaaagagtataatatgacgaaaataggttattttccagagagaggtactccccctgaatcctgcaaatttttaagtcgtctcataccaattccctcgacacatttaaagaatgtggagtatggtaaagattttgtgaataaatcagcaagattatcacatgacttagtttgcaagatgtttatctctccatgttgctgaagctcatgaggataaaaaaatttaggagcaatatgctttgtgatgttgctcttaatataaccagtttccatctgaacaacacaagcggcattatcttcatagataatggtaggtgattataatgaaccaataccacaagatgttaatatgtggttaaccattctgcgaagccatacacattcacgtgatgcctcgtataatgcaattatttcagaatgatttgtggaagtggctaccagagtctgtttagaagacttccttgaaatagcagttccaccttgtaaaaatacgaatcctgtttgtgatatggcattgtggggatcagatagatagccagcatcagtatacccaattaaagtaggatcctggtcctttttaaagaaaagtcctagatctcttgtgccattaagatattggaagacattcttaactccagtccaatggcgtttggtaggagcagcgctgtatctcgctaatagatttaccgagaaagcaatatctggtctcgtactatttgcaagatacataagtgcgccaatagcactaaggtatgggaaatcaggtccaagtacatcctcaccatcttcctttggtctaaatggatctttcttcacgtctagagatcgaaccaccataggggttttggaaggatacgacttgtccatattgaatttctccaaaattttatgggtatatgcactatggtgcacaaggattccagaaggtaaatgctcaagttgtagacctaagcaaaatttggtttgacccaaatccttcatctcaaattccgtctttaaatgatgacgtgcttcattaatatcttgtgtattgccaatgatgttaagatcatcgacatataccgagataatacaaaatcctgtgggggactttttgataaagacgcacgggcaatcatcatttttagtgtatccctttagggaaaggaattcacttaatcagttgtaccacatcctgcccgattgttttaagccataaagtgacttctgcaacttaacacaatacatgttacgatttaccttctgattcgggatatcgttccatcaggaaccttcatgtaaatatcagaatcaagtgacccataaagatatgctgtcactacgtccatcaactgcataaatagacgattttgtactgccaatgatattaaatatcggaaagttataccactcataactggagagtaagtttcgttgaaatcaacgccaggtttttgcgtaaaaccttgtgctacaagccttgctttatatctcaccacctcattgttttcattctgtttccggacgaaaacccatttgtatcccccaggaaagataccacgaggagtaggcattacagccgagaatacatctcttttgtaaagcgaggccaattctgtgtcaattgcgtccttccatttgttccagtcagagcgcttttggcactcttttatagacctaggttctggatcaacttggaggcaatcagcaatttgttcaaaaaaattagtgtcgacaattgtagctcttctatcaaaagattctccagtttcagagtagttgatggcaatttcatcaacccttacagactcaccatgatctcctgaaacaatatgtctatggtcttccgaattcctagtcttagcattgtgcaccactgagctaggttgcagactatcacgatctgcttgatatatagtatcaattcggtgtgtaccaactaaaggttggtttgcatttaccgtctttctttgcttattagcaattgtttctcgctgagtggcctgtcggctcccaaaactaacgattcggaaaccgacatgtttaactgtatcaagccctggatcagtagattgatacaggttcaacaatctggatcttcatcgcatacatttggtaaagactccaaaggagatatctttatataaaataataggacatttacaagtttgtggctaactattacagcagaggctatacgatgactcaactctgccgttttactatagaattaaaccatctaactacactagacttgaagattaggtttaaagggaactaacttatgtgattgaactcccagcttcggcaaaaactccaattaaactctgaaaaagaggggttgaagcaagggtgagtacaacgtactcagcaagctattatattaaccaataatgaatatatgaaatggtaatatctgtgtagagctaggtttacttgcagaaagctgagaataaagaggtagaaatcctgaaatgcttgatatgcaacagtatttaagaaaatcttgaattatatttctaaccaaagtaccatatgagtcccgatgctcaatccgtgagcacattcatactgcagtagatgtacgctttacccgcagtccacgacttgccaataatcattagcttagtcatggcccatattaggttattaacaattgtggcacctggttcatgaactcta

SEQ ID NO: 56457 - DNA, 2111 bp, Oryza sativa
aatataggataattatgctcaaggggaggaataataacttgccttgctccaacgcaaataaatccaagataggcaacctgattatacgattctcgaaataccataggttgccatccaaaagacaatagtctttactgagaaagaggaagaaccaaattcaataaaagccataaaataataagaaaacgataaacgactaagagggctagggtttaaggtataacctatctcttttatagggtatagggattatggggctagtatttgctagtggtaggttttggtagtataatagctagggtttagttatatgggagtcgactgtggagtaggacagtatctcggctaggctctatattttatgtggaggctctcgtggtttggacgataggaaatatactggatagttgatatggttaaataggcatgtggctaatatgggttaaggttggctttgatagaatagtggctaaggtttagttgtttaggccgatatcgaggtaggataaatatcggctagggttttgggtgtttgctagtcgtcgctagagttggacagcatgacgactaggtttggtatcatttctagccgtgtcgatagacaacatatcggctagaagaataggaggtgggtgcaagtttagtggggcggaagtgttactccgacaaccgtgagtggcggcagagcggctaggatcacacagagctcaagagctaactgtgcggcgtgcaatggaggtcgaggggatagtgaagctccgaccgctgtacgcatcaaggcgtggggtgccaggagcagcacttcgaccttaggtttggtttttgccgggctttacaaccaacggtccgacgttgaggtccgtagaccgcgcaaacgtccccatggaaggcgtaaagttccaaccggcggctttttagtggctaacgggcattttggaaataaaagaaaatatttgaaaagcaaatataagtttaaattgtaaattcaattataagattaaatcaaatatttattcaaatggcatttgaataaattaaggaaattcaaataaaatcttaaaatagcaaatttgatatcaaaatgaagagttgaatttagatgaatttaggtccaagtttcactagaatcggatctacggtttaggagatatgtgcttctaaagaataggatttgaattaaatctagaaaatgagaaaagtcactgtgcaggggcccacctgtcagtctttctttttctttttcttctccttcttctttctcccgtcatcttcttcctctcttcttctttttcttgccggctacacaggagagggagagagtgggcgccggctctccggtggacgaaaggcggcgacgtcggcggccacacatgttcccgagcacgacgcacctggggtgggcggtggctggcggagagagtgagggagatggctggaacggcgagtagaagagcttatcttcggcggcaaagagaggtggcggtggtggttgctatggggtgggggagaagggggaaacaggaaaaatggaatcacctcgtcgaggcgaactcgatggcgcgatggtttggcttgcgaagctccggtgagggagatcgggtggtggcggccatggccggacatgggagagaaagagagagagatggagctctgattgtatgtagagaaggggagggatggccggctatttataggggagagaggcggtggtgaaaggcggttgtggaggagatcgagaagtgcacgggcgacaatggcgtgaagattcgaactacggcggccggcttcgtttccttagcggcgaaggaagaggagttggcggcggcgtgagccgtgcacgggaggagggggcggctcggttggggtgtgggctggtttgggccggctcggcttagctgggccggcagctcaagaaggaggaggaaaatagaagataaaagaaaagggattgggccaaaaaggaagaaagaatggagtttcggcccgatgacaaaaagaaagaagcctaatttgaatacttgatttggataactaggttttgcaaagaatttgaatttggaaagaattcacaaaagagatttcctaatttatttgagtgcaatatttagagg

SEQ ID NO: 56458 - DNA, 2183 bp, Oryza sativa
gttcaaggacaaaaattggaggatttcttggaccataattcataataataaaaatggtttttaaactaaatttgaataaaagagttttagtcgaaagaaggtttaatatttgaaaatagaatttcaacaagaaataccaaatatgtttttaaatgaaaaacacaaaagggattaaataccagagaggttttatgcgagttagttttaggagctccctctaattatattttcctaggtttagaaggttattaagaacataagaatcagcatgatgcaagattagaaaatgacacattttcagaatgttacatggccatacttcttcctctctttttagtgagtggaagttgagtagttttatttggtacctccactctttctggcgcattctgagcgggaatgaaagatttagtcacacctttataattggtaaatgcatctggcaggttatttgcaagtctttgcaaatgtataattttctgaacttgaagttcagtttcagtagtacgtgggtctgaggctggaataccctgggcatcccaatcaatttcctggcattctttctggtacttgaagtctccccctaatgccgggaaatgttcctcatcaaagatagagtcagcgaaccgggcagtaaatagatcacctgttaagggttctaaatactttatgatcgacggagatttgaatcccacatagatccccactttcctgtgtgggcccatagctgtacgctgtggtggtgagatcgatatgtatacagcacaaccgaacttacgcaaatgggaaatacttggaggatttccacgtactaactgcattggggaagtttcatgatatgcagttggtcgtagttggacaaggtcagcagcgtgcagaactgcatgaccctaacacgacgaaggtaatttgcaattcatcaataatggtcgagcaataagcttaattcttttgatcaatgattcagacaaaccattttgtgtgtggacatatggaacagagtgctgaacctgaattcccaatgccatacaataatcatcgaaagcatgagatgtaaattcggcagcgttgtctatacggattgattgaatcctatgttcagggtaatttgccttcagccttataatttgagacattaatttggcaaaggcatggtttcgtgtcgatagaagacacacatgagaccatctagtagatgcgtcaatcaaaaccataaagtacctgaacggtccatatcttggcacaatagggccacatttatctccttgaatgcgttcaaggaatttaagtggttcggctctgattttgagataagatggtctcaaaatcagtttcccagtagcacatgcagtgcatacaaaatcagaggatttggaaaatttgtcagtgatcaaatgatgaccaatagagttgccaataatttttctcatcatcccgataccggggtgcccaagtcgatcatgccaagtgtggaatgcatcaacattttgaaaaattactttatacgcaacatgtgcaatgggtttaatgtatgtatagtacaatcccgatttgagagatggaattttctcgcaaatgcatttgccatatccgttttgtttggttaagagaagaaattcttctcgattatccatatgggtttcaatgtgaaacccattttgatggatatctctataacttagtagggtacgggttgaatcaggatacaataaagcatcctcgattataatttgtgtacccattgggagtgtaataattgctcgtccggagccaactatcacagtatcgcgcccagcgatagtcaaaactttgccttctctctttttgagagtttgaaaatatttgatctccctaagtatagagtttgtggtaccactgtccacaagacataattcctctccaatcggagcgatatccttagacatctataatgaaagaagaattgcttgattaagaattctttatccaatatatatacatacatacaataattaaaacatcaaatacatagtatgacgtttacatatgttaaaagtacatactctaatgactagcaagccatacaactttacaatataagggagttcgtacttatctacttattacaaccaatactgtttggcaaacttataggatatcaatatactgtttcaagcacactgagataagagcagctgatctcc

SEQ ID NO: 56459 - DNA, 2153 bp, Oryza sativa
tattgcaaatctccaagtgggtccgttgagcagtattcgatgaacatatcgtccatcgcaaagagtggagcgacatcttctgggagaacattgaggttgctctttggttcaacaggagcctggtgagaacttgcaacctcagggagctcttcatgtgtaagattgaagtgggcttcaaatcttgggttctcagaagattttttgtctttgagggatttttggtacaagagaacaagatatttcgggatgcggcagtctttagcgacatgagtgtcagatccacacctgttgcaatgcttgtttccattgctacgaggttgtggtgccttacccttcccttttcctttctttcgacccttgaatttgcgcctgttgttgttgcgtttgcgctttccagtcagattcttaggattattcgaagaatttcccttgaatcctttcttattctcagcattattatgtacattgaagtgcacctcaggtagtggagcagagcccggggggcgctattgggcattctttaaagaaagctcatggtgtctttctgcctgagtcaatgtatgtataagcagagaatgtttctggaaattgttagcgcgatactgttgagtaagtatcctgtcctccggaagcatagttgatagagttttctctatcttctctgcctccgttggctcttgttcgcaaaacttcaacctggagcaaatgttatgaacagcatggttgtattctgccacagttttacagtcctgtaggcgtaaatgaacccactcataattagcctcaggccaaatgagagttccttttgctgatcataacgctcttttagagctttccaaaggttgagagggctcgtctctaacatgtattcatgtttgagatccttgtgaatgtagagcctcaaaagaaaaagggttgtatttaacttcctgttctcaattggcgggtccccatcattgggttcctcaattgtatttaaaatcccccgagaggcaaaatttattttgatatcgaaagcccagatgggatagttagtcccatcgagggcgagttcgtcgaactcttttgttgccatgtccctacaatcatggttaacattattaatttacagaggtaaattaataaaaacatgatattaaggttgtaatcttaatgcgaaatgtaagacttcatattttgtaatgtttcgaaaagatgtaggtaatagacctgacaatttgagttagaattcgaaattaggtggcacaatgtggataatctccaagtaattaaacagtggagtagatcccttaatagtgggcaagttatacttgctgcctaaaacacggtctccaggcaaatatattctggtgaatataccgcagccaatgtttagaactccactaccttgtgctcaaccatatttcaaataatctcatttttcaaaacatattctcggaaagtaacacatgtgggtaatcatcataagatgtagacctctgtgagatgggcgagatgctcgctgcctaggttatgaccagtgcggccaatttgtaggactccatcgggtaatcatctcaaaatgtagaccacttgatgataggcgagatactcgcggcctaagttatggtcgtgatgaccaaagtgtaggactccatcaacatgtgattaatttccaagtcaaaatgtgaagtggaacattcattaaatcctccattaatcatgttgtacataattaagagaatttgctaaatcaaagtacaaaatttatagaattttgtaaattaataaagcgagaaagtagagtgtgtcttgaaataatatgcaagaggcatgttattaagacaacaaataaatttagtgaagcagggtatttaaataaacacctatgttaagtaacatataacatcagtggtctacaggaccattacatagtaagttgtacaactgatgaactgcttgtactaaattaaataaaacacagggacttagatgaaaattgctgctaaattaaaattaaaactaaatttaaatggtaaattaggtagtgcgccgaaatctaaagaattcggcccaccaccgtgtggcacaggccggcaggctaggggggcggtgggccggcccatccggcccggcagtaaaggggcacggggtggggcgtcgggggagggggg

SEQ ID NO: 56460 - DNA, 3296 bp, Oryza sativa
cggaggcggaggaggaggcgcgacagggacgggtgggggaaccacaaccggagttgcagtcacacggcggcgagggtagtggcggcggccaccaaccctagccctgcctctgcgggatccccggagtgtcctcctcatcggtcggcgaagaagatggcggagccggcgtgcgcgctgatgtcgagggaggccaagaacggcatccatgattcaatgaaaggtaggcatcgtaccttctgtttttcctgttcgctttttctgtagatcaaaaagtgatgtttccttctttcacttcgcgatctccttcgcgagagcgaaaagtgctgataacgtattgtaaataagattgattgtagcgagagagattgagcgagagcgagagattaagggaatgaatgagcggatcctttattgataacagtgttacaatatataggagggagaaaggcggcaaccgaaggcgcgatggtttgggaaccatcgcgtccgttgctagaattgccgtgaggcgagaagaggtgtggggcacaaccaaccgtcgtgtccctgaattggttgctgctctatccaaatatatggatgagatcacccaaatatttcataacaggaggacgctccctcctggaaaaaaatagaaccctctaaaaaattgaaactgcattctttttaaacaaaaagatggttttctacaactatgaattatactactttaattttgtacctgtcgaaacatggattcggcaataataaaagggggtagcgcacgagacctaaaagtggatggatgcggagacaaaggatttagacaggttcaggccctctcaatgagaggtaataccctactcctgtttggggatttaaatccgccgggtgtgtattgatctgacgatcaggttatgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcaaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataataatccaaccaaccgagtggttttgataatcgtaatcaaccaaagtgacttgatatcgatatatagcatatgcggtgtgaatcctccaaataacatgatctgggtgatataccaactgctttgtaaaatatgatgagtgatatagcaaaatagctataaagaagcttgaatgctgtgaataaagaaatttccaaagtattgggcatacgccatgcgcacactgctttaacagatgtgcttaagtccctaaaagacacatggtttcaccacacctggaaatatatggcatatgtggtataacatccgagtaaataaactcataaaggatttaccaaccgcctagaaaatgaccacaatatataatcagcctaagccataatattggtcaataaaaatgcacacttacgtggcaaaaagcaatgatattgtatccaatcaattgcttgataaacccaaacagcaccttgactatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatcggaatgattatcccttatgggatactccaaaataaatataataattgaatcccgactggcgcaagtattcggttgatagcccttacggagaataataattggtccagtctttgagcatagaaaataaactcatgactatgaatccatgtggaatgtatccggaacaagtccaaattggagatataatcctcacgcttgagttgatgagcccctgagcatatagcttgttcttctgtcatagtcaaaattgtccattgatggtagctgacacagttggcatagagacaagacgaccaacatagagataatattgcccaccagaggtggcaaaaatattggtggtagtgaagataatgataccaatcaaaagtgatgaagttgcacagccgtggaggcgaagaaaccagtcggcaacagtcaggtcagccatcaatgaagatgaaggcgcccagcgataaagttgtgtagccatggcagcgaaataatcagtcggtgacagacaaggcagatcaaaggcgatgacgaaatccaccaatcatgaagatgaggaaaatagtcggcgacgacaaacgtaaccgacagcaatgatgataagcatcaacagatgatcaaacatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatcagcgtttgcatagtaggtcaaccgtgaaggcggaatagcaagttggcaaagtcttagtcatccattagcaacggcggaatgtcagagctgatgaagcagatgtgctggtgatgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcagcttgacataaa

SEQ ID NO: 56461 - DNA, 1401 bp, Oryza sativa
ccggtcggtgaagacgtagacgcccaacaacggcggcataaaggccagccgtgcaggcggaaacaccagtcggcggcggtcgaggcggccggtcggtgaagacgtagacgcccaacaacggcggcgtaataggccagccgtgcaggcggaaacaccagtcggcggcggcgaaggcaagccggtcggtgaagacgtagacgcccaacaacggcggcataataggccagccgtgcaggaggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgattcattacgtttaaacgctctgtccgactagtcatagcccccaagcaccgggagtcggcctaggcacttcccagacatgcatacgagtgacatgagttcgccattaatggaacaaagtttcacgaatcagaatttactactcgggtacttttgcaattattaagagcagaaaataaatttatcttatctctatgcttttgatttattccgaataatacttagcaccttgcgttactcggtccatccaatcgagcccccgggtgctaggaatcggcccaaaggcaaccatccattggcacaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccgctaatggcggcataataggtcagtcgtgtaagcggaaacaccagtcgacggcagcgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggatgcaggccggcggtgaagtcgtagacgcccaacagcggcg

SEQ ID NO: 56462 - DNA, 3129 bp, Oryza sativa
cccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggtggtgaagtcgtagacgcccaacagcggcggcataataggccagccgtgcaggcggaaacaccagtcggcggcggcgaaggccagccggtcggtgaagacatgaacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagcggtcgacggaaaggaagtgaaaacttccaaagcgaaagcgaagtcggcgactcatgaaattgattccatcgcgctcgttgataggaaactcgacgcaacccctacctggcgcgccaactgtcgaaacatggattcggcaataataaaagggggtagcgcacgagacctaaaagtggatggatgcggagacaaaggatttagacaggttcaggccctctcaatgagaggtaataccctactcctgtttggggatttaaatccgccgggtgtgtattgatctgacgatcaggttatgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtaccatcaaaaaatttcccttaactttcattccatcgatttttcctgtattctcttatgtacacgtatcatgacttttttctcttttaactttacttcctctatttctggacactattcatattaaaactttgacaactcacggtttttttaaataaagatgctataataatatcggtggcaatatacattgcacttctctaagtcgtctaaggccacacttgcttttcaaacccccatagggctcgttcggcgaattttttttatttataattttttttattaaaagttttacaaaaataatttttcattttgaaaattgacggaagtagtcgcctaccgccctctgggagggcgatttttaaaaatcgccctcccagagggcggcgaaaatgacgtggcagccggccgttcgctctcgggcgacggccgtcaacgaaatttgcaggcggcccccttgccgccctccgctagggcgattttatattgtgcggggggccgcctgcaaatgggcggcgagggggggcatggaattttgcaggcggcccctttgccgccctccgctaggtcgattttgtactatgcggggggccgcctgcaaatgggcggcgagggggcatggaattttgcaggcggcccccttgccgccctgggggagggcgattttatactgtgctctatatttttgtataaatatcaatagttatcaaatctttttatattgaaaactatacaagattaaaatctccaagactggtaaaatataattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctctacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctactggcgtgagacgaagaggccccagtaccgaagatcccggctgcaaatcctgctggacaaggaccatcagtttcgtacaagtatttaacagtagtaataaaaagtaaagtactgtgtgggcgagggatcgacgctccgtgagaggaagagctggcgaacgcgcccgaagaggtggcgaacgcccttgcggagctcgcggaagcgccggtcgtgcctgcgaacgcgctcgaaggcagacgaggtcctgcgatgaggaaacgtgcagttaaaacatggtgacatattcgtgcaaaagctga

SEQ ID NO: 56463 - DNA, 1471 bp, Oryza sativa
agcaggtacgacacgtcatgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcattactactagtacaacaatagtcggaggtactcactacaacaacattgaattgaaattacacgatagaagtatttagtccgaacactcattacatcacaacagcattttatttcctaaatcgaaagcattgttacaccatggaatcgcctgatgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaaggacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctctgtgcctttttgattttatcttccatgtactttgtcactacgttgccaaacactatgttgttatcggccatggacggaccaattttcttgtatcgatccctaaagtacgcttgcgtaccgtgaaggatgaattc

SEQ ID NO: 56464 - DNA, 971 bp, Oryza sativa
caatgatcaaactttattcttcaaccaatgaaccaaagcaacctagcatcttaattaccaactgaactataggtagttgcattacatcacatctaggctgaaactaatacgatgcttgcttcaaaacagaatatacagattatttctgaaatgctgacatgctagtgacaagcatggtatggtaacatgggagagctaatgctagtgagatatacataagatgcttgagctttctggccaaccatgcatgctaccattttgtctggttttccttcctatttttatgagctgaaagcaacagcgaagagggaggagtccgtggtaggtatgaggcatcttcagggtgagctagcagctggtttgcatggcaccaattttctcacaacaaatccccaaccaaaatgcatccaaggaagaaaagggaaaggaaataaaagtaaggaggacatgaaaattgtaccaatggttgttgattatctgatcagcctgctaacctcttctagaaatgggttcagaacctgtacttctgagagggaaaatgacaacaaattccaataattgaattggattgggttatttgttaggacaaatgcatggtgatgtttgcatctgatcagcatctgacatgcttgcactgcacgcactgacttgctctgcaaatgttggcgcagagcagcagcagatctgtgcattaacttgtggagatgtgaggagtaaaggtagtacaggcaggtgatccacatgtatgtgagtaactctgatgatctgatctctgaagcccattgcagtaatatgcagctgttctatggatcacagatccatggatccagccaactgctccatcgtgggctccattaacaagctgtttgcactttgattaccctgaactttattctatccataaaactgagattgtcttcaggaaaaaaaaaggaactaatctaattccagatactacaagacaatgaaaa

SEQ ID NO: 56465 - DNA, 1998 bp, Oryza sativa
taatgtcggttcacctgctccttgtccaactcatgatcctgcatgcttttgtcttgccgtacatatatactagtaggacacatgcatcgatcagtatttttaaatacgttctgtaacacaattaatcgtaatgcgtatatggatcagatggatctctaactaatgcaacaaatggctggcaaaactgtgcgaatttgctcaaatcagatcacctagctttcctgtaatctcctagcaagactaggatttgcattgcatcaaccatcacttatgaaagaaaatgcagggtgcagcctacatgttgccaagcttctcgacctgctgcttctactcgtataactaatggcttctctagcaagatccaatgtttcctgcaaagcaaggatgtagaactggatgtaatttgaagcctgttttggatatagttgaatcaaaggaaattgtcccttctgaaactagaaggaaattaaggtgctactgtgtcaccattattttttaagtccaagttctttaatctcctgtatcttgaattaattgtagctacaaaattaggataaacagggaaaaatgaagactggaaatctagtttgaggttttcttgagtaagcactgaattggaaaaaggactgtatttttgctcttgtatttcgctagttatggattgtatttttaataggtgcagctgtctgccaaaatgggcctaatgtgtgtattcatacaggcccagcaaacactaacacctgggatacaccccaaatcttactgcatgccactctccactgcaatattgcagaaggtttcacttcaaaacagagtatcatatcactgcacaagtacaaaacacaattactaatggtgactgctaatttggttgaaatgcatcttaattcattgatcaaatcagtcagacctgaggcttaaaaaaaatcttgtgcttctccctttgcacattttgaagcagagaataaactaacaaaagaaatgcggatttgataaggagtgtttgttaaagaaaatttacacaggcatatcatgtgttgactgtggagtgcagagcaaaatatacaataccttcaaaatgacagagcaactaatacatacatttgcagcatagaaaatatatgtcacactcacaatcatcatcattgtttctgttcatacaagtgaagtaattaggagtacaaactcggtcagtccacatatgctgacaaatcacacgaacacacacacacccacaaacaagtgcacaacagcaactcggctgcacgaggatcacccaatggatcttctcatgccgctgaagctgatgatttattcgtcgacctctaggaagcacaccacaccagaacggtgctagagatcaaagttttcacatatacatgtatgatcatctatccagaaagatgaagcatacgtagtaatccgatggatggatcggtcgaacaagcagatcgactaaccggccaaacggaaagcaagcatgtatggagaaaataacttagcagatagatgcagagctcacacaccagctggcagctgagcatccatttattaattttcacacagaacaaaagaagcagaaatgaacagaatccaagctagtaacaagcagatgacgagcgtctggatgccggccggagatgtacttactcatcatgcattagatattgttgccgttgcaaatgatatgatgaaatgagcgagcactttgaacaccagccccaaataaggacatatataatagagatagagctgaagaacttgatgagccactggatgagggaaagggaatgatacgtagatgattacagtatcaaatatgtagtgtatggacgtatatatcgatcacctgaatttaagaagaaaagaaagcacgccaagtcagacaaaattaaaaaaaaaagggaaaagctcgatcatatatatatatatatatatatgatggagtaactaaagtactgagctatataagtttctacgtatgtatgtatgtgcgcg

SEQ ID NO: 56466 - DNA, 1688 bp, Oryza sativa
atagtttttagaagctcttgattattatcatccactcggaagacatccttgaggtcaccacaacacacgatctcaagggtttccaacgcacagtatgcataggaaggactgttgtcatataagggaagcacatatatcaacctggggcagcaatttaggtgtagcactttcaaccagaatgacgaatctgcaggctcaaaatgtatctggcccgttgtgctccagtcccagatgtggcgcgcccttgctagttgggatgcccagaatgtctttaggtaccagaaaatgctgttactaccagtactaggtggagtgaatacaacgccttcaatgttagggcatctctccactctgcaccactctaggttataccatctccgtgcctcatttgaatggcttgtgatacttgcgacagacaagctgtcatgcacgtgcaggcctgaagctctttcacagatggaacctggcaaagatggcgacgacaatggtttcgtctgcatcctcttatcatcttgtaagctaatgtagtgagaggtgctgccctccgatttacatggccacatccagttgccgttcatggttgcttgtagttgcaagtgctggatcgtggagtcgacatccgcatataacttcttgtggtcagcagttggtcgtcggcttttggttgacatcaaccaacgttgttcagccctgctaatggcaatgggccttctcttgcttattgttccgcctaattcagaactatcagtagtagcagtagcaacactagcaggaggggatgagatctcgatgcatggtgcatccaagggatatttcgtatcatttagcgagcgaaggagtcttctgtccctcactgaaatataccatttaaattcaacgggtgagaatgatgatgattcaactacacctgtagcatgaccaagttcagtgctactagtgtcgatgtgcagaacctccaatgatacatcttgttttggccatagtattgcacgaagctccttgcatccaagcagtaggagctccttgagagaccagttgcctcgcattgaacgtaggtcgagggttttaatacaagtgcctgagacgtcgagttgcttgagcctctcaaacactcctctcaaaagcacactcttcaactgggtgcatcctcggaaggagatgctctctatcttggctgtgacatcaacatcattgtcattgctgctgctagagaagctaaatgactcgagtgatggcggtaggtcatgagggtcaattcgcgtcaactcaaaacaaccatccagaatgattgtcttgatgattttgcagctagacaggttcgggaataatgttactgctacttgatcttgctgcaatacttgtgactgatgttgaacttcagttattggttcggtcgcgacttggagcttgacaaggttgagtagcccaaggggcttggtgctgcttccgacaccagtactagaattgttgtcatcacggagtagatggcttatgctccaatgcttgacccccttcacatttagctccctaagctcaaccattagatcttgtgcctctactgatagcagccaataccagtctgtgtaactcaggtcaagcacccatagcttctggaaacatgctccactgctaatactagtctccttttcagtgtctccagcactagtactatttggtgatgagcctga

SEQ ID NO: 56467 - DNA, 4663 bp, Oryza sativa
aaatttagcccaaatttccagactattttgtgtattaaatccctgtccaggaccagccagggtacacaaaacgacaagtaataaacagatccaaatgtaaataaagcgtaaaatacttacagaagaggcacttaggcctcacaccaaaagagaacgacagtagcggaaaaaggcgatcctagcggggcttcagctccactccacaggcaaaactcaactggggtctgagccttggtcttctaacttcgtcttcagctcagaagcactacacttctgaaaatggggaataatagcaaggctgagtacaaccaccgtactcagcaagccacaccaacgatgcagacgtgcaaggtgacacaaggaaggcttgtggctatttgcataaaggcgattgtaaaatatttcattgagcaaaacagtaaaactgatgagtaattaaagtaacattaaatctccacttatcaacgctacaccacgttgaacaggcccaaccaacccacctgaactacagtgcattgagtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgctgacatgccaccacgacatactggaaagaggccgtgacaggacccttcgcataaccccctctaaccaagcacaccacacctcaggtttcacccccactcctcgcaaggcagcgggcagtcccctctcgtgcctaggtgaatccagaagtcgcataggccgtcgcagggcccatccaaactccatcacgcccacccttgcctggatgcgtcggctagaggaaagctacactacaagcccagccgttgcccacgctggcttgtggtaagcacgataaattcttccagggtttcccgcgaaccggtccttaattgccatgggtgcgactagcaaaaccatgcacccacagcccaccatgtaatcgcattttagttggataattacgaccatgaagcatggccagatgtctcgagcacgcagctcattctgatactaaaaaaggtctaatactgtaattatcccatcaactgagctagtggtaattaagcatggctaagcatatagttctagctaggtcacataagtaacatgagctagtcgatttattacccaatgttgacgaaggacagatatcaagtaaacatggcacaagcgagcagataggtaaaccctaatcccatgtaattagcaagacatgcaattttatttgcaaacggtaaaacatttgtaaattaggatcaaaatgctcaaggggaatgtgtgacttgccttgcttcttcaaacaatcttccgaacacttttcctcgcgaccgcggacttccgaaacgacggattctacacgcaggcacgcaaaatgaggaaaaactctaataaaaaccaaggaaatagtacataaaaactaaacaaacatgtagagctcaattttatatgaattttgcaagttgaatggctcaattcggagttcgaatcaattagatatgaattttagaagttttgagccatttaaatgaatttctagaatttttaacgatttattgcgcaattaataattaatttcttaaaggaaaaggactgtcgctgacgtcagcaagagaggggccgacgccgataggcgggtcccacacgtcaacggcacaaggggagggcgcacggtggactcagtccatcgcggcacgtgcgcgggcgcaccacgtggacggccacggcggacgagcggcagcggtggcgccggcgtggcgacacgagggcaccgacgcggggcggcgccgagcggccacgtggacggcccagattcacccggggtgaatcgggcggccacgggcgggcaggagccagctcgccgaccgaccggccaggagcggtgacgcgcggcccgatggtcactggcgacgaccaccggcgcggcagcacgcgcgggtgagcggcggagggtagcgggaaaggggaggggagctcaccgagcggcacacggccgaaggatgcggccggcggcgagatggcaacgggaggcggcgacggcggagctcggggcggacggagacgacgacgctccggtgacgagctgagctcgggaacaggcggacgagcggcagctgcgccacaggatggaaggggaactgttagggaggacggggcaacgacatggccggccggagaggaaaagaagggaggaagggctcaccggcgcacggaatagcggacgtcccgtgagtctccggcgatgggaagaggtggccgaggttcccctcgtccctgcggagccgaaggagagcgacggcgcgggttggcaacgaccggagcagcgggacgggacggctggaggcagtgaacggcggtggtagagctcgggtcgacggtggaaaggtggttgcggcgatgaaatggggaaacggagcagaggccggggtagagcttggcacggcgttgccgacgacgcaaacggcgaggtgcggcgacgactaacgcggcagcagcggccggctgaaggcggcggcggcgggggagagaggtggtgcacgaggcggcggtgttccagaggcggagaggggaaatggagtagaggccgggctgcggcacggcgccgcgaagccgacagtggtggcggattggcgcggcggtgggtggagcggcggaatcggccggacggagctcgccggaaagcggtggtgcacgggagcggcgtggggagggcgttagggaggcgcggggagctcgggaaaaatggggaaatggaagaggggaggccgaggatgcttttatagcctcaagagtcgacggggaggccggttggcggcggatttgaagggagaaaggggcgccggcgacgtggttgagtgggctcggggtggcggcggttttcgcggggagaggtgggggaacgaggaggacgtgggcggcgaggtcccacggacgagcgcgcgcgcgcggggtggaggaggtgggtggaaacggcggcgtcgtggggcggctcgggcggccatggcagcagttggagctggaggaaggggatgacaggtggggtccacgggtcccacctgtcggagagagagggagggagaggccggctggggaggcggaacggacttgagtgagagagagagccgagcgggccgagggaggacgccggcccgagagggagagaaagggggcgcgcgggccgcgggagagaatgaagacttgggccgaaaatggcccaaagaaaggaaggggggttttatttgttttctttttattttaattgattcaatgatctttgtgctattaaaactatttctcgagcttcgaaaattcgcgggaaatttcagagattattttagggcacaaagaatattacaaaatattctcggccagtgatttttaaaggaaatttttaattccctcaataattcacttgattaatttgctttaacttttatttaatttctagaaaatacattattaaatgatttttaatcccgaacgaaaatcggggcgttacagtaggttgtgctttgtctcaaaaccttcaatatatcttagaacaaaatgtcatacactcatctgccaaatatgcttcagctatacatccctcaggatgcgctttattacgcacatatgacttcaacacactcaaatatctacataaacatggaaatgagaaaaaaaagttaagaaatatatattggataacaaattcaattgtatttgtaatataaacatacctttccacaaagtacatcgatcggtaacacacaggacctcctatttcagcctctgttgctaaatgagcaactaaatgcaccataacagtaaaaaatctaggaggaaatatcatctccatacggcataatgtcattttaatttgttcatccaacttccgaagcacatctatgtataggacttttgcacttaattctctaaaataaccacatagttcaaataatacggatgtaacattgtctggaagcacacctcgcaaagcaacaggaagaagttgttggattagaatatggtagtcatgacttttaagtcctgaaatttttgcctgaccaacatttacacatcttgatatgtttcctgagtagccatccggaactttaatatcatggagaactttgcaaaattgttgcttctcatttttagacattgtataggtagcaggaggcaagtaatacttattgttagctttttttttaggatgcaatcctagccttatattcatttcttgcaggtctagtcgtgcctgtaaattatcctttgatttgccttccagtcttagaagtgtcccatatatattatcacaaacattcttctctatatgcattacatcaagattgtggcgtagtaaattggactcccaataaggcaaagaaaatagcccactaacacagttccatgtttttgacttctcaaaatcattaattgcctttattttactaagaattgcagtttcagaaaatgcaataggctctggtctatgttcttcaattccatcaaaagaaattcgattgtaacggaactcatggtctaggggtagaaaacgacgatgtcccatgaaagaatacttgcgacaagagggatcca

SEQ ID NO: 56468 - DNA, 1953 bp, Oryza sativa
ataaatgtttttttaagccttggcttaattgggaagtatcgtaaaacttttcttggggttgcccttcttctttccttctttgttaaagtagttttatcttctttgtttttccaccttgaagttccacattttgaacaaaagtcatcatttgccttgtctttcctgtaaagttgacagtttttttggacaaacatgaatcttgacataattaagtccaagctttcccattatcttcctggcctcaacaaatgttctaggtaaactcttaccatttggaattgcttgttgcaggatcgctagcaaatcatttaaagatttattactccacttgttaatggattttatgtaaaacaagactacaagaaacgaaagccttgtaagttcacacccttcccataaaggttcatgagcatctcggagtaaatcatagaacgcttttgtttcagagtctggcccactgttagaagaagttggtgcatcataatcattcactggagggctgctgcctgtgtttccaaaagcatcttgaactagctgttgcatattattatcaattctattttgtgattttatttcactgttagcagagatgaatgatgcagtttcaccatgacaaccccaaggattataaccaagtaacattccattgtacactaagggagtgtttgaagagaaggggattgaggagattgggaagatacgcaaaacgaggtgagccattagctcatgattaattgagtattaactattttaaatttcaaaaatggattaatatgattttttaaagcaactttcctattgaaattttttgcaaaaaacgcaccgtttagtagtttgaaaagcgtgcgcgcggaaaacgagacacaatctctcctatctccacctaacgaacactccctaaatgatcatacacttcatcacgccttagtaaccacttattaacacatttcttgcacggacaccggatcttatcattaggattcttttccctatatgcaaactcaagaaaaccctctattccagcaaggtactcatcacttggtctaggggaaagcagtaacttcttaatagcatttaaatccatcggttttctgtgatgggataagaaatatggttagtacatcagtgttcctaatttgacaaccacccactaaatttttttgatataattttaagttcaactcaaaattagtctgtctacagaatatatatatgatgtgaggttaaccgcacctggactcctgacgttgtgatccagtacatacggcggctatattggacatattgcggagcagcagatgggtagatcaggcatcggtgaagaggttgggcctgaaaaaagcactctggataaatgaaagtaatctgaggcaacatgaacagccacatgataaggacattacatgacaattgaaaactgaaaatacagttccacaagaacagtttgcatgtcaatcttgattaggagcagaggagataacaggacctacaaatataaattttagaacatttgtgcactacaaatatgtccctgtgattagctaactggagctctgatactctagatatacagcctttacctacgatctgaacaaataaatgccagatataataggatggaagataaaacaaaaacgatgaaatatttcgtttgcactgaaacaaacaagtaatagatagaggtgtgtctatacaggtcaaggatcgaacacctggtgtgcataaaaaacagagtgctcctaacctggcgtagtttgcacttgcagatgagaggtctttgggcacaaccaaaatagctgatgaagatgcagtagagagaacagggaagatgccagccgcccttgggcagagcatcagcaggatatggggaacgccgttcttgggagcggctcgatggagcagctctgcacggtgcggcctcggaaccggtgcagcggtgctggcggacagcgc

SEQ ID NO: 56469 - DNA, 1580 bp, Oryza sativa
acacactatttgacaacttctagcttcgaggctaaaacaccattgggtttgttcggcacgtggtaagcattttccctgggagaaacgccaccaggggggtattggatgaatcccctcccatcacccaatcccctccaccccagggatctggttcccttggtcattcggaatgcaaatggtggggaaggttaacgttcacttcagacattaactcatgccaaacaacattcaacactgatatttaaatttcatatcactgaaaataccaagaaaactaaacagatagtcttgaaatttaaaaatagcattaccgaaaatttgaaatattgtaaataaaaaactaaaatttctggagaaaataagaaattctgaagattgcctaaaaagattatgaaaattctgaataccgcatagaatgttctaaaaattgcttgcatcatatccattcagtcaccacaatcagtcacccattcacaatacatgatttactcatttaaacatcatattcatcaccacaatcagctaggataagccactgaaaactaattacattcatttcatacaaacagaaagtaagagtcccaaaaatccaaattctccgtaagtgcaagagcagaaggcattactgcaaggctatcagtagctccattacctgctgcgagtgaaaaatgagttatcgtcagtgctctgcattaggcattaatccatgctatgaatagaactatagtataaaaagtagcagaattacagggaggaaatatacatcagtagaagagcatttccttgaacaatcgacgtcagaagggaactatttgtatagaaatatatataaatataagtagatcacattagcagtatagcatcattagcaaaataggatcagtgctcaagcttatactgagttcatggcaaagcacaaagaggctgaggggggctcctgagtatttactccgtacaggaaatgacatcgatctatctatgactagacctacagagattgatcgaaatttttacacattccaagtagtagtgcatccaattcatcccaatcccatgaattagcacatagtaaaagatgcagagcagggaaaaggaaaagaatcatatcgtcatcctcttcctcccgcttccgacgattagctcttgaacacatttttgtactacacacaagaggaaataggagtattgttcatgcatacagcactcatcatgacagataatgtttctttattaaaaacaaggacttgacagctttgcataaaaaccatcaacaaatacaaacactccatgctacacccagatatagtctactgtcatagaactgaatgaagaaatgcaacccggtgactgatcaaagataacacactgcttccaaaagtacacattggacaatgtataaagctgttccctcctttgtagcaaacattattacaattatattgcaacagtgaattaggaaattttcataaaatcgagatatccaatatatttgatcataagtcaattgttaatctaataaataagagggcaatgaaattctgtaacaaggaaatttagtactaaataatactactagtctg

SEQ ID NO: 56470 - DNA, 1168 bp, Oryza sativa
gctcacctcatcacaggtatgctcccatacatcttttgcatttgtactaatatgttatgtttgagtatatatgttgcgttttagttttagttccatatattttagcacatctgtagcacacagcacatatgtgtagatccagagcatagaatataaagtatgaattgagacatagacagtagtgttaattgtaagatgtagtttagtttgatctggagaatgtaacgtacttttagaaatttagagaacaatattgtagagaatgtaacttagggcgtagtacagaaatgcgaggttaacgcagttattgttttcatcaggtacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagatatttgtgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagaggaaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgtagagagagtttagggtggtcaagtcaacaaattatgtgtatgaagtgaggtgcatgaagaaagattgtccgtggcgtgtctatgcatataagggtaaatggaatgattattggaaagt

SEQ ID NO: 56471 - DNA, 3052 bp, Oryza sativa
ctatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcatatacatataacattacaaaaatattttcctttcttacacactaaaataaattacatattattaaaaaaaataacttattacaaataaatggagaacgcgaccctgtcgaactgcgccagttcggcggatatcctatcgaacaggggcagttcgacagctctgcctgtcgaacgggggctgttcgtaataaatggagaacacgaccctgtcgaactgcgccagttcgacggatatcctgtcgaacaggggcagttcgacagccctgcctgtcgaacgggggctgttcgacaggtcctgtcgaacggcagccttccgatctcctcgccagtcgcgctctggccgttcgataggcgccctatcgaactgcacccgttcgacggggacctactttcgcgattttccccggttgaccactacttttgcgattttccataaaaataatattaattctcaaaaaaattcatacgtacgtgtatttctgagatactagatgcatgagatgatcatatctcatatcgatcggaacacaaattaaaaattcaatggaacattacaaaatctagcatagcagcacaaccctcttgatcgagaatcgttcgtaatatacggggatgatctgaccgagctactgcacaattattacgtactaactcccaattatatatattgcgcggttaattagacttaataataaactaatgaatccaaatcaagttattgcattcgatcgatatatgcttgctgattctgcatttatggtagcatcatatatatacatacataccatggcctcatgcatctccttcctagtagccagtgtgatcgatgtacatacatacgactgtcgatcagtatcaattaatgagatcactagcatgcttgcttgataaggtagtatcatatttggatcgagagagtagtgatcgaggagttctacactagtaacactacacaggccggtgcagactgcagagtagtggtcgtgcagtgcagtggatgagtcagtcctgcacggccgggcatgcttaattgttccaagtttccaactaataatgcaatgcaaaagctaacatcggcagcaaagcatgtatattcccttgatttatatataggggccgatctagctgctatagggagactagttaattagtggggcttaattaagatcgattagctaggagacttaaggagaatgaatcctcagtacgtgagagtgagagcgcaggagagggttggaaaacttactggttaggatccaatggggggtgtgcgtagtcggccatcgccggtgcggccagtgctgccgctgccaacaccagcagcacaaccggcaggcgtggggtggttgccatcgtgcagttgtgctctgctcggcttgtaggtgggtgctggaatagatataccgtgcaactctgcccccctttatatagtggtggcctggtgggtggcttgcttcatcgtgcaagccatacgcatgtgatccatttagaatatatataaagggaagaatatttacaaagagggagagagatagaatttacaaagttattacatcactctgtctatccatgatttccatataggcctttctacttcttttactctaaacatatgtagagtaaaatccaccctgaacctttgtttccaagagtttagattaagttgaacaccatcaaaaaattgtgcatttcttgtcgtccaaatgttccaattaagctgcaattgccaccgcttcaataaagaaagatttctggaaatatgctttagcatacataatcatattcatgaaactgaggtccattctccaatgtattccaaggtaaacccagcaactctttgcaaaggagcaggagaaaaaaagatgggtcgtgtcttcaagggctgcatcactgcacattacacattctggttcaccatgtactgtgaaatgtcttctctgtagcatttctctagtgtttaatctatccatcataagtagccacataaacattttcagtttcatagtacatttactcttccaaattaacgtactaggcaaattaaggaaaaataaccaactgctgctccatcaagctgtaagagatgtgatggagatggctatatatgcatcctccgatcccttatatgtagaaggattgcatcggcagagcttgcattgggtcgttgctagctttttgagccgatcactgtcttgatcgaggctgcaataagccagctagctagctgatatatataggatgggtgggttgcaataagccagctagctagctaactgattgggtgggtttgttgcacctgaaactttcccgggatatatatactcatctgtatgtgcaggtcgatcactgcattaattgcatctatatcgctcaatatggaagagcgcgtcctttttgcatcaacgcgttggggtacggtggtccacggctactgtgcatgcacctccgtcgctctctttcgcgcgtttcttttttgtgttcaccaatgcaagcttgtgcatgcggcagtgtcctgtctcgatcttgtgcaacggccggacctgaggcgtttcctgctcgagtttatttggatcagaggcaacaggctcgatcagctccacccacattccgacgctgcttgtggtcagatcggatggaggagcctcttcggctagactgcacgaaactctcgatcatgtcccacgcctcctccatgacatggaccaagtcgatcgaacgcgaccgagcactgatcgaggaaactagctagctagcaagtacggcgtgcgaagaaacggcagccgagttagctagctagctacgtaccactacgccagatcctcacacctctgacgggatacctgtgacaggcaaacgatttggtcactagtgaccattacctctgac

SEQ ID NO: 56472 - DNA, 2521 bp, Oryza sativa
gtcacaggtgaggggataccagtgacgggccactgaatagaagcccgtcaaaggtatgaccaatacctttgacgggctttttttatctaacccgtttgaggtgtgttgggtctataaataccccccaaactgccaactgctttccatcccgaccattttactgttcacaaatcggttgggagggcaagggggcgattttttgctaaaattcaaggtaaaaaacacattattctccattcattctcaacatatcgatcatcatttatttttctttgtatgttgttgatttcagatggatcgtagatggatatactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgttggaccaagcatggagagcaagaggcgcctgatgtcgcagctgaagaagtgttggatcaggatgtagagaacaccgccgcagctcgagaaggcatgttcgtaccttctgctttaggtggagagaccatagatttggacactcaatgtctatctacaatgttgcatgacattgaagacgcagaggacaatgacagagattatgagaagtttagtaagttggtggaagattgccagatgccgttgtatgatggatgcaagtcgaagcacagcaggttgtcatgcgtgttggaactcatgaagcttaaggctagtaatggctggtcggacaagagttttacagaactccttgaactgttaaaggatctgttgccagaggggaacaatttacctcagacgacatatgaagcgaagcaagtattatgtccgttgggcatggaggtcagaagaatttatgcatgtccgagcgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaatgacagtgggatgacaactgttgaccttaacaaggttggatactcggacgaaccttttgtccttgccaatgatgtaacgcaagtctttttcgtgaaggacatatctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacacatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttaggcccggttcttaaccctaaccgggtttaaaaagaattttgaaatagcgggaaaagatatttactcccggttgttgagaacaacttctcaacaaccgggagtaaagatcttttctttactcccggttgt

SEQ ID NO: 56473 - DNA, 2157 bp, Oryza sativa
gccgcatcatcctctcctcctccctctccgccgccatctccgctgccatctctgctgccatctccgccatctccgccgccgccggtcgtcctctccgccgctccgtccatcgacttccccgacctccccgaccccgacctccccgacgccgggatccccgaccaccgccgaccgcctcgaccccttcgccactgcctctccgccgccgccaccaggatccaggacgactacggcctgcgccgccgtctccaagtacgccgcttctccaagtatgccgccaccctcccccattcctcctttttttcgatggatgaattgcattgtttagatgaatgaaatgtgatttgttgtttcgattattggtgctgctgtatagatgaattaaatgtgatttgttgtctgtcgatgttttggatgaatgtaggggctagattttatatacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggatttaagtgccatttggagggggggtgactggcactgtgatgtttctgtttttcagagggcatggctagcaattcctgaggctagccaatatttagcatttatttttttctggaattaactcatcagtgacggttcggaagaaacatccgtcacaggtaacctcacctgtgacggactcgcaaacgtcggaccgtcacaggtgacccacctgtgacgggcctttactttcgggcccatcacaggtgggtcaccctgtgacggctactatataccggagatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacagccggccacccgtcaaaggtgactggacttaccagtgaccactgatcattgaccaagcccaaaaccgtcaaaggtgagggtttgggcccgtcacaggtgaccttgaccagtgtagtgtacgtaccttgcattgtcttgttaggtgaataagtaggtgttttttgttctcactgcactcggatcgatcatggagaccaaccggcagcgatcttcagtccgttggatgaagatggatggttgggattgggatcgcgcgaggaggcgcggatcgatgacgtggcatgaggccattttaccaatgaaaaaattcaaatcgaattttatcataataaatgaactcatgtgaaaaagttgtcaaaaataaagttgtagaactcattgagatctaccatttttattttggtcatttttccatccgagtttgattaaactataaaaaatttgaattttaaaatatatgaaattcaaataattttttgggtagtaaatgttttcaaatgaaaaaactatcaacaacaaagttgtaaaacgcatcaagatctacaacttttggtttggtcattttactatatgactttgtttcaacagtttgaatttgaatttcaaatgatgactacttcaaacaacattttcaactaataaatgatttcaactgaaaaagtcatcaataacaaagtggtataactcatcaaaatctataacttttattttggtcacttcttcatctaacaaagtgatttgtaacattgttcataaaatgtacatatctcttatatagttctataaactataagagatatatgtaaattttatgaaaatgttactatcacattgtcagataaagaactgaccaaaatataagttatagatcttgatgagttatacaactttattgttgatgactttttcagttgaaatcatttactacttcaaaatattatttaactgtcatgagttaaaatttaactcataggagtattttaactcattagtgaatctactgttggatggggagggaatggacggttaagattgagatcgcgggaggaggcgtggatcgatgacgtggcattaggcgcggatcggtgatttggcggttggcaggaattaccttggcggctatttcgaaccgccaagaatattattaccttggcg

SEQ ID NO: 56474 - DNA, 14938 bp, Oryza sativa
ccgccaataaaatcgtatggccgccaaggatattctgttttgcttggcggctagtttgaaccgctaagaaaatcttgtgactttagataagaaaatcaactggccaccaatataatcttggcggctgttttgtgaccgctaagaaaatcaactggccaccaagaatattccgctttcttgtagagactttagataagtggtaagattggaaaaagcagggcccaacagaaaaactacaaaactacagaagaagagtaattttatgatcctcgaggaggtaccacgaggtatcaaaaatttagtgtaaaatttggtacgtagtatttaggtaccaagaggtaccaaatcttctattatatactaaaagtccattaaacttcctaaaaacgctctcaaactgtcacgtagtttcctcaaaacgctcttatgtcatcacgtggcacatcgagggagttgagaactccctaggggcccgcacgtgcagcgcatgggttagttccataacgtgaactaacgaagattagttccatatataatcgtgtttggagacaagattcgaaattaagcaaaatctaatcacatatggcatgcaagattaggcacgtgcagcgcatggatttgtcatgaataaacgaagattagttccataattgtgtacacaaggcaatatttcaaatctatctcatagcaaaatttaaatcacatatgacaagattaatttcatgagtcaagattacatatacatacatatatacatatatacatatacacacaccggcttgcatacatatatgtacagctcgccagcaacaccttttaatcctccgcaacacacaattttggtggctacatcctcccatcctctacaacacgcaatttgaacacaggtgatctttgtaataagaggtctgcggcaccagcccagcagctgatgcccaatctaactaatcaagggaaatagagaggacatgaccagaagaggaagggatagagagagagagaccagggcggccacctgctgagctgggagataactcccaggaggatgttgaggtgaggacggaatataggagggggacatggatatggcgctgcaagctgcaacagtcattattaggccatgttcggttaatatctatgagagagggattggaggggatttgttccacacctattatggtatggaattattccccctcaatcccctctaatcttcttcaattcccctcctaaccgaacaaggcattagggagagggggtcggggaactacaaaagagtccagtactccaaagtaaagcgtgtggtgtaagatcattagccttagcttttggattgctatcatggacaaattaagttcatttaatgtagtataagcacaacacatgggttggccataagtgacacgtacaacatctccagacgttatcatcgttattactagccaatgtttttgatcaattcctcatggttttgtttcatgcgcgtgggatcaaggcaatgaaatcactaatggttaactgcagttttttcactaataaatgattatttcatctagatgtcttaataaattgtaattaacattcctgtgtttttctgtgcttcatctaaatatatgctcttttcaatcttttgttttacagacgctcctaataaatcaccagatgacacgctacaaacactctacattatcacatgatttaaatccgtgagcccattatcttagatcctttaaaactaaaccattcaattgctaaacttcttcgtgtacgtacaacggtgtataagaaaaaaaaaacttattcctaatctaatgcacgtgtacatatatacgacacaatttctatgtgtgtggaccttttgtattgacaattgttatgcataagaagtttttcaaccataaattttttcaccgagagacaaagtcataatataaaaaatcgtaataacaacaaaaaatgatattttaaataagaggcccgcgcaactgcgcgggctaccttactagtttactaaaaaaaagtagtgcctcgtgacacctctttaaggaccgtaaaattgctcctgtagtatacattgatctgtaagtccaaatttgtgagttttggtcgaaatatatatgattcatcaattcaaaattactaacttttcgtactctggttaatttctgtacagaaatatcttgatcgatctgtaccgtttctcttctcttcttcctatactggcctactgcatgtatatgcattcacgaactcgcaacttctgtgccacatgccacgtgatatgctggatggtagtatctgctgcgctacgatgcacgtacgcaacggctgaaccacctaatcgagcttttttttttataataaatcggtatttaggtgcgccaatttcattgagtatactgggagggaaaaactgtataggaagaagagcgttacaaaagaaaaagaaaaggaaactagaaagtattttctaaaaaaactaaggattgatatgtgcaaggcattttgcttctactagggcccaagttttggtctcctcctttattttcgtaatgagagatattgtcaagagctctatccatatctctcatattgtcagtagtagcatagtgcaaacacctttcctaggtatcctagggtaggttgccaacgctgtacaccaggtatgtgacgtacatggaataattgagagaaaaaaagtgagtaaaatggctcaaataaaagtttaaaaaattatcttgtttgttttgtgctaaagctaatttgagaaagagtgataaatgcaataggtatatatgtatagtgtttatttttcaacctatgtgcttgtgaatatattgcattataaatcatttgaaatcatgaatccttattgctaattcgagcttaattataatatctttgattcatgtttataatatagtgcatgtttgttaactagttaatgaatttatctctcttgtcttgcaatacatgatcatgaattgttttaggtacacttcaaagctctcgaaagaaatataaaatataaaatataaaatggttattccaagtggcgatcatgacatcattgcatatgtgcttcattggttattattctcttttgcattcttgatgaaatcattgttaaaggaggagaaatatacaaaatgcatgcttcttgaaagagggagaattgaattgtttcaattttaaaaatagtcgattttgtgctttgattgcaaattgatgggagaaattctttcttttaaaaagggggagagtttttctttttcacttttgagatttttgttttcatttttcaaaaacacaaaattgcattttgaagatgttgccaatgtgttcatcaagggggagaacgtgaaatcattatcatggttaatatttgtgatgaacaattggctatgcaaatgatttaatcaaagaattagtttgaaaagatgtgtggatgttagtgtgagtgcgtgtgactaatgtgggtcaggttgtgatatttgtgcccagaaatgtttgctttatctgattgtgtgcaggtgacttgaggtcagccttggtcaatggtgaggaccgggattatgttcagggaaaaacagaggtctagtgcggtcgggataccatgtgagaagatgactaaagtcaggattcttggaggtcaacttcggtcaacggtggggatcgggactagactcagggaggagttgagatccagacggtcaaggataccgggtgacgaagttggatacaagatggcatacggtggatgaatactgtatggatgagatcttcgcaatgggaagggttgaggctagaaggatatcgacttttgagagagaaaaattagggtttacttcgaggtttcaatcctagttcgtgagttgagaggggagtgttttaggtacactttgtaaacatatattgatgcaataaagttgatatactttcaagtgtttcgtcgatacgtgtttttctggatcctgacggttggaccggaggcaagtctgcagtctaaccactggcggtcacacccgcggcagggagacggttcaaccggcgacaaggcggcggttagaccggctgcgtgcgagtggttcgaccggcggcaatagaactacgtcgagatttccatcgatttgagggtaacttttattttcggtaaaagcttttggggttttggttttccttgccattcacccccctcctgataggcttggttattcgcgttcgatcctacaaactgcaacgaaccgagggagctaacgagatacaaggttttcacgagtcctatataattagctcggcttctagtctagtggcatttgatgaccctgtggttgacctgcgtggtgttcgtccccggtcggtacagcctcagcgggcacgtcgcgtccaccctcctcgtccggccggcgtgcaccggccggaacctcacctcgccggtgatcttcagctccagcgacgacacctcctcccccgcgcgcgcccatctccttcaccagctccgtcaacgccgcgccgccgagatgagccgccacgccctcgtcggtcacgccgaacctgtccgtctcggccgcctccaccctctgcccggcgtccgcgagatggacggcgtggaggagctcctccctggtggcgaggcggagctcggcggcgagcggccgggtgtactcggcgcggacggccatgttggggttgtgcacggcgacggtgagcgagatgccgtaggccaggtcggtgccgttggcgccggcgaggtcgaggcgtgtcagggacgcgtcctccaccgtgacgccgacgttgaagacgacgccgtacgagaggatcagcagcgcggcgaccagtaagagcaggagggtgcaacaggacgcgcacatcacgcagctccccggcccgcccgccattgttgcgatgacgccaagaaattacctacgtacctacgtgatcgatggatcgatccaccaatgagaacttcgccggaatcaccagcgtttatatatcggtggtagtgctgcttcttattatagttggccataaggcccgaggcccgaaggcccggcccacggcatgcctttttggcccggcccaagcacggcacggcccgacttgggttgggcccatgccggcccggcccgaccgtcgggccgtgcctgggcctccctaccagcacgctgggctggcctggcacggtcgggccggcccggcacgatgggctggcaggccagacccggtacacaaagtatagggactgaaaatagacatataaatgtcaatgtctaaagaataggaaccttaaatagacttattttagctatttatataccacagcacaaagaagagggaggtaaaatagactttttttagctatacaatgtcacagcccaataggagggagaaaatttagacttattctgaggaaaagcacgatggcccatcgtgtcttcgggccggcccggcacggcccgaagcgtgttgggccgtgcctgggctgtgagtgcggcacgtgggctggcacggcacggcccggtgcgtcggtcgggccgtgccggcccgacaagcctcggcctaggcacggccgggcctgggccgtgccatgccgggcggcccacatggccatctatacttcttagcttgatcgatgatcagattcggaccagaactgttttcttttccttttcgttttccttttcttttccaaattcgagtttttctttttcagttttgctaaaaaaaacaaaatttgtacaaacttatttaagtaaaatattttcaaatgtaaatttatatatagtactccctctgtcacattataagcgtagtaatgaatttacgtgtccaattttgatcgtctgtcttatttgaaaactttttgaaaataaccaaaataataagtcacgcataaagtagtcatgttttatcatctaataacaacaaaaatactaatcatgaaaaaaatttcaaataagacggataattaaaattggactcataaattcatggccgcgcttataatgggatggaggaagtattatagtattaattataatgcaactacactatataataattgtaactacagcgtagcgtaactgtatgatggctaaagccctgagcagcttgggccgaaccaacacattctggcacaacataagtgggccacatggagcttaatataatcccgtgcaggcccagcacaactagttgagacaagagagatcgtacgaccaccacctccgatcccctctcccgctctcactccatcttagcggtgctgggggggggagatatcgctaccacgaccactagtagaagcggtgatgatcgctaccacgctgattgaggattaggtgtgtatgtcgtagctcgaccacttgtagagatagtcggaggatcgtaatcacgctggtaaagaaccaggtatgtaatcatatctcgaccatttgtagaagtggtgggatcactatcacgctgatcgaggactaggtgtgtagtcgtacctcgaccactcttagagatgcttgagtcggttactaggtgtgcatcttatgtgatcagcatgacttcacatatattttttaaccaaattataagtatattggatgtccgttcacaatcatacaatcatgatggacaatcaagccgtaaacgatcgcgaggagattgttccgtgaaattacctacgtgaggaccgatggatcgatcaaccaatgcgaacttggccgaaatcaccagcatttatatatcggtgctagtgttgcatgcttagattggtcgatcgatgatccgactcggacaagaattggtttttctcctttttttttttgggagtttattaatgacaagaacttgatttatactagaaaaaatatccgtctatgcaacaagaaaaactaatgttataacaataattatagtttattttaaaaaagagaaaacatattcttcacttattggataacaacttacaaattcaaattgtttggcattttcatgtattcctaaactgtatggttgattcccactagccaacatgatttaaaccatcgaggttttggattttgtcaccctcttccgataggaaactatttctcctgattacttttagaatatttcacaaaaaaaatgaatttagaaaaagaatagatgtgaccaaattttgtttaagattttaaattaattcaaaccaaaattactgcaatttccaaaatatcgatcctatctgtgtctgagataggaataggcaaaccgatagcacgcacacaagcacacaacatcggtggtctcgtaacctaattctgtcttagctccttggatggagcatagccgatggacctacgtgtacgtgaactgatcacggtcaagtagtagtaaaaaaaaaaaaatcaaagtgagggagagacgaacatatgtgtgttctcttagcttttcacggttgcatgcaatgggccctccggtttgacagctctgagcttcgatgcgtcaatggtccatagaccatgtctatggcagcacgaaccattgcatccttaattccttatcgatctctccagtggcagagtgctccatattcacgaattcttttgagaatcaatattatccttatggaaaatcgcaaaagtaggggtcaacccggggaaaatcgcgacagtaggtccctggcgacgggtgcagttcgatagggcgcctatcgaacggccagagcgcgactggcgaggagatcggaaggctgccgttcgacaggacctgtcgaacagcccccgttcgacaggcagggctgtcgaactgcccctgttcgacaggatatccgtcgaactggcgcagttcgacagggtcgtgttctccatttattacgaacagcccccgttcgacaggcagagctgtcgaactgcccctgttcgataggatatccgccgaactggcgcagttcgacagggtcgcgttctccatttatttgtaataagttattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatagataagtcaaggacgatcagtgcccttcgcacgcttgctaggtcctcccttcttcctacgcctaatctgctcagtgggatatgtcaaattatcaggggggtgcctatctctagctacctgctgtggtgtcacgtctggccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacattgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctagggtgtgctgaaaggaaggacgaccgtgagatgtgtgggccgcttcgtacccgcgacgtgaagaggatggaccactccgatccacgctggaatgtcagggtagtggtggtgatggccgtcagcccgacgtctgcaccacatctgccgcgctccgacaggagacacgacgtagtagtgcggcacggaagttgcgaaggatgctcgccacgtcgtcaggcctgacgactggaggtctcgcctctcttctttgcagcagggtgtcggactccacgtgaacgtgctcaacaaattccgcctgttccacaaataatcaaggcaattaaaattatttaaccagttgcacatttattaagagtatttaacaagatgcatatttgttagaaataatgaaccagttgcacatcatttataaatactgaactagttccacatttatgtaagaaaaggaactagttgaaccaattgcacatttattagacatactgaactacttgctaactttttaaaaatattgaactagttgcttaaattccacaaataaacacataccattgagttgtaagctgatctaggctgaggggtaaaagtgtcagtaatcgctgcctggtgggggacggtgctatctccttgtggaggaaaacacctccatcgtgtaacactgcggtactaatgaaggtaagctccataataactcccatcgtctggaggtgtctgaagtgccaagttatcagctgcgtgctcccactcttgtaccgtcagctgaactgtggtcacaataactagctcgtaggaaagcccgagcccctttctggagtacctgcacaacaataaattcacacatcagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgttcaccatgaggtgacaagtcgtcatccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactacggctgtaacaagtagtagttttcattagtcatataaggaaagtttgtgaactagtattcataatgataacatcaacgaatttaacgaaaaatacctcacggtgtgtccacaaggatcccatagtgggacgatcgtcgatgtcatcaacaccagacctatacatctctcgcaaactgtagtttgcgtacgagtcaagctgaggcctaccaatgtcgaagcgctcgtgcgcccacaacataagtagcaatgggcatccagggagtgaactttgcttgctgttcctcacgcaagcatcacacagtccggcatatgtcgccgcaagtaccgccgacccccaactgtactgtggaatctccgcgataggtaactctgcaatctgctccgcaaagtggatgaagtgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggaccgtgcccatctgtgagatcctccagtgcaacaggcagcacaccaccaaaactggccagaaggtcatccgcccatccagcattcaccattgttgggccaactgctggcccagctatcggcagccccaacaaataagacacatcctgcagagtgggcaccatctctccaactgtgaggtggaaagtgtgggtctcaggcctccatctatccacaagagcactcagaagcgccgcgtcaatgtagattcgttcggaccttgcacgtgaaggctcgaccaaccgtgcaaacgtcaacaacccagctgctctcagcctacaacatgacagggcacaagttattaatacatgaaaatataaacaccttgtattagaaaaaacaatatattttcacacaccttgaaacccaacgaggatcaatacgccaatattgatccggtccttgcatctttagcacattgcagaaagttcctgtactaagacgtcgcgatcgatggttcctatcgatctccttgtctatcagctgcccatcatattgatcagccatacctgcggatcgaaaaccatattagtacaatgcacgtatggtaacagtacagtaaatgtatgcaacataattcaagtaacaaatttgcatgccatttcaatttaaaattacagtaccagcacacatagatacagataagaacagttcagtacatttcaatttaaaattacaagcccacgacacatatattatgatattacaagtgcagtgcagttcgaaatttaaattacaattccaatacaaatacatgacgatattaaaagtgcagtgcagttcaaaatgaaaattacaaggccattacaaatagattcgggtaataaaagtgcaagaaagttcaaattaaaattacagatgcactaaacataaattgaacgataacgatcttcaaagtagggagtccaccaaggataatagcgaactaaggattatttttcttcttcgacttcccctttggaacgcgacgaacatcagcgcctgtggcatcttgccctacattgtacatgttgcaatctttacgggaatggttctccccgcaaagaatgcaagctttcttacgacgagaacgatctttcacttcagcttcatccataaggttcttgatcctgcgcgactggcgacgacccttagtatcaactaataaatttgagtcaggaacccaattggcttgccctggaggaggacgagtgaaatcgcacacggcacgccaaccacgcaattcaccacgccaagttgcctcccacgattcctttctaaagtagggagaaacaaaaatgtttccatcaacacccccttttgcggaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctctaggatagcaacaagtggtagaggtcgtgtattcttcataacccagttatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagttcctccggctcctcctgtctggcaactataggttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcaccatctgctatataaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaaacaacaggaacgacatggctatccgcgtcgactccgatcgcggttagaattgttcctctgtacttgcctgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctctgtcacgccccgaactagtcccgaccggaactagcccgtgacgctccaaattaacctgttaatcgataccagtcccaggaaacagtgctggtatcacagggagatagaatatcacagcaacagaggtctctttattatagagtagaggtacagtcatgttgggctgcggacagatcccgagctcacaactgcattacaaaagggaaacggaagcaggacatggaccaaacaacacaggcgtgacttgggaactaggcagaaaccctaaaactcatcgtagccggcttgctcctgaaagaactccgcatcagcaggatccgcttcatcttcttcagcaactggggggagaattatttatatagagcaagggtgagtacgggagtactcagcaagccatgggaattaagtgtttaatgcaggcttcaaagaaaggctgatgtttttgcaattgattttatttgaactcttttctaaaaacaactaagtgagtgcttctcaaacgacacggatgagacagtgcgtctcgtccggtcggagtttgtgcaatgtatcagtctttaggattgaagcaaggttggcacccggccaacagcttttcaaacggccacccgggcctagctgatcccatcagctgcagatttttttcaaacatcgaaccccttttcacaacagcaatttcacaatcagtagtcaaacaaaactacgctaggaatcacctcacatccgcccatgaccgtgggcacggctgttcgaacaatttgttaacctctgcagagggggtacactttacccacacgacattactaacccggatcacccagcccgtggggatcagccacgtcgggagacctccaagctttcatgacaaggcatttccaagccgacacaggtttaccatatgccgacgagaggggtcccagaccaacaacaggttaggtcccagaccatactgtgccaggaagcccaggggtcctccccgacaccaccccgacgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgtcccccggtccgcggttttggaaattcatttagttcgcaagcaccgacccaggtgtcgggttttccaagtcttttgtaaacccaagttttacccaagttgttattcagatttaagtttgaaggcgtccgtcgatactcgcacagggtgcacgaatattgagacgcaactaggtggttacaaggggacatgatgtaacaattaacaagggaaggatcaaatgcaacaaattaggtaagtccgccaatctgccttgcagacgggacaaacagattaagtgcgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggtgaaaataaagccctattaatgacctctaagcgtgccattagatagtctaaagatttgaggaattt

SEQ ID NO: 56475 - DNA, 767 bp, Oryza sativa
cacaacatatcaataatatgtactaactaagaactaatttaaccgtaaaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaactttactgctggagggcgtcgccaacccttttctcccgaccggcgcctcctcggcctcctctccggcctgctatcccctcccctcgctccctccggcgctcacggcgacgatgtggcgactctcggcggcggctggcgatgtggtcctcaaacaaatcgaactcgcggccttggtggacggggctttaaaccggcctgtcgaacgcccattgttcgacagggtcggtggagggccccgtcgaacgcccccggttcgacaggcctcgcggcgccgggtggtgggccctgtcgaactccctccgttcgacaggtgagcgtgtcgaacgccagccgttcgacagggctttgtcggctgcccgtcgttcgataggtgccctatcgaattgcatccgttcgacagggacctactttcgcgattttccccggttggccaccacttttgcgattttccataaaaataatattaattctcaaaaaaattccgtacgtactactagctcgatcgtccgattcatgcatcctgtgtaaaataaataattagagaatccactggatggatcg

SEQ ID NO: 56476 - DNA, 10858 bp, Oryza sativa
atgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacagttttccaattgactggctctcaatcatttgcagctttggagtctttgcccactgtaattgtgcacaaaatacaggttagacccatgccgaccagaagtcatccagctgtgcactgatcgagcaaaccaaagaccaaagaaacaggggtagtctaacgcgcaaacgcgtgaattcacacgcttcaattctagtaatagttaaaaaaaagttatgtttagcaactttcattagatatgattaaaaaagaccgtcatgattcaagaaactttccacagaagatttgaaaataatttacaggaaagactaaagaatactcggaaaacaacttccaactattccatgttgagaaaaagaatctctctacttgccactaacgactgacttgtccttttacaatccagttgcaatcatgtacaagttgcagtatcactgccttttctcctgtgatggctgatggaactgtcgcgtttaatataatccagttgcagtatcaagtaggagtacaagttgcagtacattaaatgtacaagattcatactatgaacatcaatttggatgtcataaagaacttaaggactagctatttacaaacaataacgtcaagttggatcttggatgttataaaagactcagttaccatggctactccctatgtccctcccattctttagccaacgctcgatgccatctcaccgggacaagagctcgccgccggcgacaagctcgtgtccagcaatggcaggttcgccctcggcttcttccaaaccgacagtaacaagtcctcctccaatagcactccgaacatttacctaggcatctggttcaacaccgtccccaaattcacccctgtatgggttgccaacggcgaaaaccctgtcgcggatctcgcgtcgtgcaagctcctagtttccagcgatggcaacctcgccatcgttgcaacgacccatgccaagaactcctccatggtctggtccagcaaagccaacatcccaaccaacaccacccatgctgttctcctggacgatggaaaccttgtcctgcgtagcactagcacaaccaatgcatcatccaccattctctggcaaagctttgatcacccgacagacactgttctgcagggtggaaagatcggctggaacaacgccaccggtgtgaaccgccgtcttgtctccaggaagaacaccgttgatcaagctcctggcatgtattccttcgagttgctcggacacaacggccctacctccatggtctccacgttcaactcctcgaatccgtattggtccagcggagactggaacggccggtacttcagcaacataccggagacggtaggacagacatggctatcactgaattttacaagcaatgagcaagagaagtatatcgagtatgcaattgcagatcccacggtgctatcacgtaccatactggatgtctccggccagctgaaggcgcttgtgtggttcgaggggtcgcgggattggcaaaccatcttcacggcacccaaatcgcagtgcgatgtctacgctttctgtggacctttcacggtctgcaacgacatcacattcccctcctgcacctgcatgaagggcttctcagtacaatcacctgaagattgggagctagatgaccgaacaggtggatgtgtgagaaatactccgctgctctgcaacagcaataaaactgcagcaggcacggcagataagttctatcctatgacttctgttcagcttcctgataaagcccagagcataggagcagctactagtgcagatgaatgtgcagctgcctgcctcagtagctgctcatgtactgcgtattcctacggtgaaggtggctgctctgtttggcatgacaagctgctcaatgtacgacaacaaggtaatggtgttctctaccttcgcctttctgcaaaagaagtactggaaagtaggagaaacaatagatggggggtgatccttggtgcttcaattggtgccagcactgctgctttgggtttgatctttctgctgatgatttggatcagaaaagggaagagatataacctcacaatggataatgttcagggaggcatgggaatcattgcatttagatacgttgatctccagcatgcaactaaaaatttttcggagaagttgggggccggcagttttggttctgtatttaaggggtcgctaagtgactcgactatcatagcagtgaaaaggcttgatggtgctcgccaaggagagaagcaattcagagctgaagtgagttccatagggataatccagcatgtaaacttggttaaactgattgggttttgctgcgaaggtgacaggaggttacttgtttatgaacacatgccaaagagttctcttgatgcccatctcttcccaagcagtggtgcagttttgagttggactattaggtaccaaatagccctcggagttgcaagaggactagcttatttgcattctagttgccgagactgcattatacactgtgatatcaaaccagagaacatacttcttgattcatctttcactcctaaagttgcagactttggaatggcaaagtttctcggaagggatttcagtcatgtcgtaactacaatgagaggaaccataggatatcttgctcctgagtggataagcggaacagctatcacatcaaaagtggacgtttacagctatggaatggttttgttagaaatcatttcaggaagcaggaactccagtaaacaatcttcgcgtgatggcgtgcatgaagcttgtttccccgtgcaagttgcacgcaatcttctgaacagagacattgacagtctggtggatgcaaacttgcatggtgaagtgaaactggagcaggttgaaagagtttgcaaagtcgcatgttggtgtattcaagacaatgagtttgatcgacccacaatgagtgaggtactacagtttctcgagggtctatctgaagttgagacacctccaatgccaagattgcttcatactcttgcaggaggtttagattcgaaaataatgtaatcactagttttgatcgttgttcgttcacctaggtagttctacacgtcacatttctcatctgccgtttatatcgtaagcttccttgccgcttcattatgccacccttgtaatgattgtaaccattattcccactcccagcagattgttaaacttacgtgttacatcctaataaatcagggggaaacttgacctttggtctgaagttcaaatacttgacccgaaatttcagatcaggaatgctagacatcatatgacagattttaggggagaaatcacgtgaatttccgaccttctctacctacgattcatgctccaagatcttctccagctccggcaactctagcaagctcgtgagtagtttgctttcggggttggtgtcaagtggtggcaaaggtggacggaggggtttcgtagcttagaggaacgaccgggacagtggcagcacgatggtgggccattggccgtgggggtgacaagtgagatggctatggcgccaccttggccacgggagaggaggtgacgggctggtgttggtggcgggggaagcttgtcattggagtggttaggaggtagtgggaggtggtgattgatctggtagtaggagctgccgaagacggaggaggatggtggcaccgaagctagggagtgtaaataagaaatgagatgaaatggggctgagaggagggggcttcgtggtctggcaagcctcaatggcgttggaggtgatgcccacgagggagagggtggtggggtgggtaggcgacatcggtatgggaggcatcgagatgcacgtgttgcacctggacgtcgacaccaacacggttggccgcgcccttggccgtcaatgccgacgcggatggcaacgcgtggccactatcgccgccgcccgttccttggccgtcgacgctaacgtggatggtggcacatggccgccgccatccgcgcctagccactgctggaggaagacggctcggccgccggtggagagtgatggctgggtgggtgaggaaatgaggatagggtagagggtggggaaattaaggtttggctttgtatatgataggctagatcggctttttgggcttgcaatattagtattaatagtctaatatacaccctcggggctctgcgggtcatccgcgggtggctgccatcccccgcccccgcccatggccggggcaccgacccggactctccacaggtcaaaatcagcacccgtccccgaccccgtaggggcggccccacgggggaaattgccacccctatggatggttatattttgatccaacagttaaaatttcataatatggaacccctagaacattctagtttatatatagacaatgtcattttagatattcatgagaacgtaaatgtcatctggaaatcctggagccaggatggagtcaggatggagtcaagatgtagaacttatgttaaattgataaaattggtgtttataacatttttatatctgtatgtagtatttaatctatgacatgtcagtttgaaattgaattaactatggtaaaagaatcttacaaaatgttgtactccctctaagctgataatattagtcgctttgaacaagggtaaagtcaaactttaaaatctttgactataaataatttctaaaatatttatcttaaaaatatgaaaaccatatgtgtagattagtattaaaaagtacttcaataaaatcatactccctccttcccaaattgattatcatataatggaatccaaaattttctcaaattgatcatcatataactgtatggacacggatttaatcggaatacaattaatacatcatgggagaatgtgtgcatggtagggtgtaattggcatggtgttttaatcgatgcatgcattgtgggagaatgtgtgcataatgtcttgattgatacgatttaaattatccttggtcttggtgcataaacacatatgatgatcattttgggatggagggagtatatttgttgatatttctatatatatactttttggagactgtgtccttgtccaaaacgacaagtattatcaaccccaagggagtattccaaatgagacctagatgataatagttagtgcacgtgcaaggcacatcgacatataaagaattgagtaaatattcttatattcttattttttttatacaataatggtgagaaacactggttgatggaaaatattttgaatcccaacgtttgcaaaaatgagaaccgttgcaaatactatcaattgagtccataggtaacaagaagaaaatttaaagttctacaacctaaactaatattttattacaatgaaattataaatgcaaaacttgtaaacaatttctagttccaacattagtccatgttagttgccagatcagttcccctcaggagattaggtattgtattacaatccagttttgaccattctaatcctaaggtaaccttgaagaaatcgtgaattttgttttggtaggttttctcgaacatatggatacatataggttatatgatgcattcaatacactactaatttatttatttcaaacataacaaatgaaatgtgtgcacgtgcattcaagaggagcatacatcccactgtttgttcacaacggaacactagtgcctgtatcgactatactgaccatacttatctaaaaattaggtatagatggttttaaagcatttagtagataacatatatataattcagatgagtctatagatatggatatactcgtcaaatggtcaaccttcaaaaacgttgcaacaaaaaaggatgtttctatttcaccttagcattttccgctagtgatctatttggtctccaagcattagaaaaaaattgatactatgtctacaaagtgcaatgagattgttggttaaaatagagattattaaaatggctaaagtatgtagttttgaagcatcattggtaccagatatccatcaatcttttatctatcactctcattggtcaagcaagactgaagtcacgaagccctacataagcataattctctttgttcctatgcgctagaaaagaatcaattggtacgttctatatcaggggttactgaacaaaatataacccctaatataaatgtaacccttgacaagaagaattatgcatatgtagggcctaaggacttcggtttggcttggccaatgagagtgagagatatagtgttgatgaatatctggtaccattgatgtttaaacactactcataatttggcaattttaataatttctatttaaaccaaccatgtcattacactttgcagccataatatcgatttttcttctaatgcttggggactaaagagatcactaccgagaaatgttaatgcaagctgaaatagaaaggtccattattgttgcaaggtttttggaagttgaccatgtgacgagtacgtacatgtctataggcgcatagatatgtaaattatatgttatctaataaatgctttaaaaccatcttattcctgatttttagaaagtttgtactccttacaatcattagtgtactgttgtggccaaatagtggaaactatgcttatcatgaaggtatgtgcagccatttcatttcttttatttgaaataaataagttaatgtgtatccagatgttcaagacaacctactaaacaccattgctattcatgatttcttcaaaattggtctcaggattaggatggtcaaaacatgactattttacgaagattgatggaataaaatgtttacaagttctccatttagttacattataataaaatactccctccaattttttttttaacattggttagatcaacatacattagcaaacatgggtagtaataatttaggtcgtggaaccttaatttttgttgttacctttgaactcaactgatatatttgtaacagttctcatttttgcacaaatcgagactcaaaatatctgttgtgaattgatgtttctcaccattgttagtgtaaagaataacaatttaagagtatttactccattctacaaataacaatttaagagtatttactccattctacatatgttgacgtgccttgcacattcacgttaattactccctccgggtaatcatatattcgtatatgacatttacaaaacttgagaacaaaaatagtttgattgctttgtccgaagcgccatgtacttatgactaaagggagtagtttcaatatatagtacggttaactcttattcggtttaatttctacgccaactttaatcataattttttattagaatataacacactaatatctaagaaaaaaacattctgtaaaggtacttataaagaaatatctatctatatgatttttatgttttcaaacttaaagaggtattatattgacggtcaaggttcaaaaagattgatagaataaaattaatcaacaatatcatagatgtgaatacggaggggagtaggagtaccttctttttccttccccctgcgatgggagattggatctttgctccagaatccaaatcctccacgacagtggtgctggtgcgtgagagattgggtcgtgcgtcttaccaggcgcccaacgacgagagctacggccgcgccgccgcgcgacaagcataccacaccgacgaggtccccccctccgccgcgaacgccgatctcagcacgccgccatcgacgaggtcacgctccaggtctagggctccgcatcggcttaccagtttgccgtcgcctgcaacacggctgacggcgctacgaggacgaggcaatgggggaacacgggcggcggaaccgagagatggagcttgggcctcatgttgcctgttgggccttgggttcagggccgctcggcccaaaatctccgggagatcagcgaggggccgtgcaggcctccaccagctcggagtatcgtatcgtgtaggaataagtctatttaccatctctcatcttcgtgtcgagtttaattgacatcccaaaaccaccagatatcttcaccaatcaccactcatcttgacaaaacaattcaaatcagagtgatttcgttgacgtgaaattctagtcagaaaaaaaaaataaaaagcatgtgaggcccatatgtaagtggaatacatattcgaaaatttcctatcggatccctccgatatgatattatttcagccgaaatttttaaaggagtaaaggaagaagatgtatgccatttacaagagtctcacatgttttttattttttttctgactaggatgccacatcaacaaaaccatcatccatattactatggaacttgatttggatagtttcgttaaggtgggggtggagtttttgttactgtggtttaaggatgtcaattaaactcgatataaagatgatactagaaggtaagtggacttattcctatcgtgtccgagcccacgtaaagtggaagcccgctcctgggaggccctgaagcgcagctgcttatctgcatctaggcgtctcatctagtggtcacctgagtagcaagttcgtgctccctccgtccataacgaaaaaaaaaactcaaatactagagaagaatctaatattaaataattagaaggggtgaggtttcgaatccagatcatctagcccaccaccttgtggagctaaccggaaaacccctaggtgtttctccctccgtccataacgcacattggactagtgatatctaatctaattttagtttgtcatattttataacggaggagtactctatttcgtcgtacatatctaaagttttggaaaagatttggttcaatatttaaaattttgacagttaattgtgtattataatatgtttataaaatacataagtttatagtattatggaagtatttctaaagaaaatttatgcatatcattttttttcttattttaaactaagcattgatttggtcaaatatttaaaacttagcaatcaaatatgatcaaaaacttatttggaacatcaaaaaatatttatgatcagagtactcaaagctaaacctttagggtgttctacgtccgtaatagtatctatgctacttaaaatatcagtagttatggtgtccattctgccacattggccctttacttttgagtatcacaatctatattattataagaccctccagcgaattatcttccgtatcttccgttttactgctggttctccctaaatttcaaagccacctacttgtctaataaagaaaatcatacgagtactacttagactaaatatatgcttaattgacttaataagttagaaactcaatttgttttatgttgaaatgcacgggctcttggctagttaggatagaaggcatcatttgcctctgggatatttcagggtggcgtcgtacaattggtaagagtgtgaagatcttgcatcacggttgaatatatttttcaccaagttaattcggcggatgcgcttgcctaaacaccatgcactagaaaaaccatttgtgtagccagtccgtaacacatttatacatgcgtttagccaaccactgcagcttaaggcctataggaatcaatgatttatataagcggattccacagctgcatgtaaaaatagtttttcacatgtggtttatgaccctaagacaaaaaaagaaacgcgaatattagagaaggaagcacactaccttgtgaaactagccgaaaaatccatgggcgtttctcttatgaccctaagacggctttaaccatcttcataatggtttttctttttgaccgcttgagataaataaagccaagaacatgcaaaaataattttagtagcgatgtttttctcacttttattaagtttattcgtaaaccttatggtaaaaaatatttaatttattcttacaatcaagtaaatagttcacagcaataatatgatgaataatggcaatatgagattgacacctccccgctatgaattattcatgcggggggctaggaatcatactgacgaaacgtgctcaactcccagagcacaaaatccagtgaataacagaaggtcaagcacttcaagtactgctaaactttttcttcaaacttttaacttttccatcacatcaaaactttcctacacacataaactttcaacttttccatcacatcgttccaatttcaacttccaatttcagcgtgaacttaaacacagcctaaagtgctatatatggatgatgtacagaagttgtgcacatatcttatattgcttggcaagatttgctccggtctaacaaaaagtatttcgaggtaccgatatctcaagataccgaatcgttttcaatcgttggagttaaaaacaattttaaagagtgaggtaccgatatcgtaagatatttttttttctcaccagagcaaatctcattgctcggcatacttgctgccactggcttctgcctttgccacaaaggcactgcttcgcaataatggcaaagataggaaaagctatatggtgaattggtgattggtgagtggtgactcgtgcattaatatggaggtaatacgcatctgtggcatatatgtctcgcatttgtggcatatatgcctcatatgttgtgttccctgatagttcacatggagcacagagctatagtctagtgccttttagcccacatatataatgtttacatgatcactaaaa

SEQ ID NO: 56477 - DNA, 6256 bp, Oryza sativa
ccaggaattccaattttgatttaattcctgttgcaacgcatgggtattctactagtagtataaaatttgaatcctataaatttttatgtcttggaacaaagatagtactagattatcatgaacacgtgttttaaactgcttagatgatgtcatttttttaaaaaaaactttctaaagtttttttaaatcaaataagtctattttttaagttggtaacagtaacatatattactaatcaaggactaattagtaagcttgtcagacacacagctatttggctgatcagccatctcaaaagcggccttaaaagaaaacattaggttggagcccactcgctagctagtaaatacatatactccgttttataatgtaattaaggtgttttaattttgttctaaactaaattcctctaacttgggactaaatttatataagaatagttaaaacaaagatcactagtatggccatctctagcattgcaacaccatcaagacctagggtgagaagtataatatatgtacgactgtcatttgtcacacatagtagacatgccgtggatgtttggcaattcatagcaaaagatcttacatcaccgtcgaaacattatgtaattaattgggttaattggatcatgctattataaatttgtgtattaaaaatgacattacaattcatctgttcatagccatgccaggctacaaacagatgaattgtaacaatatttttctgaaaaggcaaatttgcaatgacatgaatccaattaatcttaattaattactatttccttttggctactataaatgaaagaagaactgaatagtgatcgcccacagttgctcaccatggctcttctcatttttgtagtactactattcgccttaagcatcccagcaagttctgccacgatcgacaccatctcaattggcacggcgttggccaaaaacgataagcttgtctcagaaaatcgcaggtacgcacttggcttctttgagacacaaagaaaagcatctcagaaaactagcaagtggtacttaggaatttggttcaaccaggttcccaagctaaatcctgcatgggttgcaaatagggataagccaattgatgatcccacatcagtggaactaacaatcttccatgatggaaatcttgccatcttaaaccagtcaacaaagtccatcgtttggtctacacaagctaatatcactgccaacaacaccgttgctacgctattgaatagtggaaatctcatcctaacaaacttgtcaaactcattagaagttttctggcagagctttgactaccccacagatacattttttcctggggcaaagcttggatgggacaaggtcacaggccttaaccgtcagattatttcttggaaaaactcaattgacccagctaccggttcctattgcaaagagttagacccttctggtgttgatcagtacttgcttttgccattgaattcctccacaccgtattggtctaccggtgcatggaacggcgattacttctcctcaatcctggagatgaaaagccatactatttttaattcatcatttgttgataatgatcaagagaagtactttagatatgatttgctagatgaaaggactgttagtcgtcagatattagacatcggaggtcaggaaaagatgttcctttggcttcaggactcaaaagattggacactgatctatgcccaacctaaagctccgtgtgatgtctatgcaatttgtgggcctttcacagtctgcatcgataatgagcttccacattgcaactgtataaagggcttcaccgtaacatcactcgaggattgggaactggaagatcgaacagatggatgctcaagaaatactccaatagactgcattaacaacaaaaccacaacacattcaactgatatgttctattctatgccatgcgttagattgcccccaaatgcccataatgtggaaagtgtaaaaagttcaagtgagtgcatgcaagtttgcttaactaattgctcttgcactgcttattcattcatcaatggtggatgctctatttggcacaatgaattgcttaacataagaaaagatcaatgtagtgaaaatagcaatacggatggagaagctctttacctacggctagctacaaaagaattttatagtgcaggcgttgatagtagaggaatggttattggacttgctatttttgcaagttttgctttattatgtttgctaccactaatcctactactggtgagacggagtaaaactaagttctcaggtgacagattgaaagattcccagttttgcaatggaattatttcatttgaatacattgatttgcaacgtgcaactacaaatttcatggagagacttggaggaggtagctttggttctgtatttagggggtctctaagtgattccacaacaatagcagtgaaaaggcttgaccatgcatgccaaattccacaaggagataagcagtttagggctgaagtgagctcaattggaaccattcaacacatcaatttagttaaattgatcggcttctgttgtgagggtggcagaagattgcttgtttatgagcacatgtcaaatcgttctctcgatctccaattatttcagagcaatactacaatatcctggaatactaggtatcaaatagccattggaattgctagaggattgtcttacttacacgaaagctgtcaagattgtatcatacattgtgatattaaaccagaaaacatccttctagatgatttattcattccaaaaattgctgattttggtatggcaaagcttttgggaagggattttagccgagttttgacaacggtgagaggaactgcaggttaccttgcacctgaatggattagtggtgttcctataacaccaaaagtcgatgtttatagctatgggatggtcttgctagaaataatatcaggaagaaggaactcatatacctcatctccttgtgttggtgaccatgatgattattttccagtgcttgtggtccgtaagcttcttgatggagatatatgtggtttggttgattatagattacatggtgacatcaacataaaagaggccgaaacagcttgcaaggttgcgtgttggtgcattcaggataatgagtttaatcgaccaacaatggatgaagtggttcatattctcgagggtctagttgaaattgacatacccccgatgccgaggctacttgaagcaattgtagctggaagctcaaatccaacatgtacctcatctagttttttcggatcaattcgagaatccttgtaaatatttatagttccttttttcctacaaatatacatacacgtatatatattaggaaatggcatgaacccaacctctacatccaaccatatgtacccagccaaactacaaatatatatgtatgcatgagtgacggactgatgctatgtgcagctattattgttgacatttctgctacgactcatgctatgtgcaactattattattgacttttctgctaggactagggatttgtaacctgtcatcattcttcttttccaatgaagttttttaccacctattgttgatgtaatctacaattttgttgtccataattcaatagaaatttaggtggatagatctaacaaatctatgatcttaggatatgctatgtgattcatgcgacaagatcaatggaaaggtcgttgtcttgcgtcctcgtggccagcgtttgaactctggtctcaatgctggacctcactgttctgctaatgattaaatgctagtcattactctctgcgtctcaaaataaatgaatctatgataatatgtgacatcatcatcatcatcatcatcatcatcatcatcatcatcatcatcaatgaagaatgtttatttgtttcctgattgagccacgtatactgtaaaatatgagccattggatctggaaagaacgacttaaaagtatggagggaaaaagaagagtcaggacacttccattagaaggatctatagaaggcatgtggcatgcaagagtaaaaaagacccaacttgtataaatttgacaaaaaaatattattgaaaatcgagagttaaagctagaaaaataagagtttgcaaaaaaaatatgtcaccacattttttatttaattgccatcacttttctctatatgattggtttcttctatatgtaagtatgcttttatctctcccgtctcattttccaagtagataataaattacttttaattctaattcttttatgcattgtgtattagaaaaaaaatacaatgtaagcatcaaaatttacaatgtaattacagtttaagttttaaaatttacaatgtgagcgcatgtaatttacagtgtaaaaacgatttgactaatgttgtgaaaacatagtgccgtaaatatagctactccaagaaaaaaattaggaagaagataaaaatagtggaaaagagaggaaaacccacatgtgtcccgtttccttgtcaccactcaccacatgtccgcctgtcacaccatcattgctagggaggaggagatggtggcacaagtcgagttgggatgaagtgcgggcgtagatggagaaataaaaaatgagcaaacaagagaaaagaactgaggagaagccattgcacgccaactttgaaatatttaactatttgccacttgtataaggattcgtcactgaaccatatgtcataaacacatgaggacccacatattatagactgtgagtgtcaaatccttaattgccatatcttaaaagtgaaaaaaagttaaatgccccagtaacgtctggtggtgccgcctcttctcgttcgcgttgccacgttccatgctctctttcaagaatgtctaaaacaacaagttcctcaaaagtttgttagaagttattatattttaaatatttgcctaaaggattttttaaataaaaaaggtcatttgggcagatatttaaaatataatacatgctactaatatacataatttagaaccttccagtattatatttatagtaaatattacacattaggcatgttaattatttataatcacgaaaatattgtttgttacagataaaaaattgactacacttcctaccaaatcaatattcttcgagaacctatttacattatacaaccatatagcatttaatagacaggggctagagccgcgcgaacgcgcggctctactggctagttacatagtataactaatccggacaagtccatgtctagattggttgtactgtgtaatacattgatggagaagtgctttttattcccggttcataacccccaaccgggactatgaatccggaactaaatagatattttttcttttgtttttctctttttcattgtttttagcattgaatattgatttcacaccatcccctaatcatgccaagaaatcctaaatccaaatcatcacatatcacagaacatctccaaatcctcaaatagatcatctccaaatacatcacaaactcttaaaacaattacatcacaagttctaaaaaatacatcacagattcacatcacacacaaatcaaatacatcagaggataaatcataaattgtgaaaaaaaaagaaaagccggccggccactgctgcctcccctcctcccctcctcccctccgcgccggccggccgccgccgccgccaccgccaccgcgccgctgcgccggccgctggccggcccaccctcttcttcgctgtgtggaaggaaaaaaggaaagagaaggctaggagttagagataaggaaagagataagaagttagagaggaaaaaagagatagagggaggagtttgttgtgtggacgggaaaagaggatcggtactaggattatatagtgtgttttgatttttattcctggttagtaacatcaatcggaactaaaaataggtttttagtcccgaatggtgttaataaccgggactaatgatcctagggccctgacacggcctgacatggaatcaaaagatgaattttagtcccggttggagttaccaaccgggacaaaagatgatttttagtcccggttggtccaacaaccgggactaaagatcttcctcttataaacctggactattgtggatttgggtcgaccgaccaaagatagtttctctaccaatgataatatatcgatcctatgttgatttattttgggatgaagagagtacgtagtaataatatgttatttctcctttaatattttttatgctaaatttctccattgtgtcccaagaatga

SEQ ID NO: 56478 - DNA, 7345 bp, Oryza sativa
ctttgcgagacgaatcttttaagcctaattgctctatgatttgacaatgtggtgctacagtaaacatgtgataatgatggattaattaggcttaataaattcgtctcgcggtttactaacggatactataattatttttctattagtggccgaacacacatgcgataccctacataatacccgatgttacgcgtcagaactatacacccctatacacccctgatctaaacacccccataatcatgtatgacagttacaaaacctgagaacaaaaatagtttgattgctttgtatgaagctcgatgtacttatgagtagattagtagtttcagtatggggcagatcgtttgtgctggtttgcagccggctatatatggttgcgattgtgctgtatgtacagtgcaagcagtaaaacttatattgagcttagtcctgttgctgctgctgcacaactctcttctgatcagcccctatattaccggtaatgtacctggacactgtaagttttggtcccgtttgcttcttaaaatgggacatcttctttttaatataaaacgtcggcaacagcctgaccgttcgaaaaaaaaaatatattaccggtaatgttaactcttaattattcaattttttgcgcacgactttaaccataattttctattagaaatagcaataatacctaacaaaaacttactttacgtaaaagtacttgttatattgatttttatgtttttcaaacttaaaaatattatatatattgaagttcaaaatggattgatagaaaattaatcaacaataccatagatgtaaatactgagggagttggctgcgatgggagattggatcgtacgtgctccagaatcctccaggacaatggtgcgtgcgagattggatcgtgcgcggcctagcttaagagcaagcttaataagtttaatactccaatcaaataacaaatttatacaatagttgcttactatactattaatacatatggtcccacctgacatacacacaccgtgtcttggagtccgcgctgcagctggctacagatctatagcccgcttctcttctctcttatcttttatctcattaaattatatttatagctggctaatagtatactattgtagccgctctaacaggctaacggacgagcgctacggccgcgccgccgcgcgacaagccggccaccacacccgcgacgaggttccccctccgcctccgcgcgccgatttccagcacgccgccatcgacgatgtggccgccgggtgcgtcgatcggctggtcgaagtacaccgaagcaatggggaagttccggggccacgaggccttacggcgcgcgtgcacacgagtggatcaaatggcccgctcaaccgccgtcacaacaaaacagggggcaaaaaaaaaaaaaaaaacctccatcctcatcgtcaaattttagcatctgcattacatcgcaaggatcacaagctgactgggcgaggtggcccatggatgaacaaatgaataacagaaacatgtccttttgcagacaaaaaaggaactagttggggccaaaacaagatgtaataagggagaatcatcagtcatgtagtggtaaaattcaaaccctgatacgtacgaatattacgcatatgtaggtgggtttttatcataattttagtgagatcatggatgtgtctcgctggtttagcatgtgttatggggcgtattcgtgtgtgcgtatgactctcccgtgtaatctcaaaacaagaaaagaaaaacaagaggcacaacacgttttgatggcacagatgaatatagggtagtgttacaatatatacttcttttaaagagtatagtattggtagcggtgaccggtgagtaataaatcttccaccacctcacaccaccaacatttttttttaaaaaaaagagagaaaagaatgatgtgggcctagattgtcaactactctcactattttttttcgataattacacggtacaacgcagacattcacaacgcacgcgcactcaccccgatgagcatcttcgaagactgggccggcaaatcttttgagattgacgaagtcaccacatgcgcctcgctgtcgacgggtacgtcgcctaccactgaaagcacaaagccgttaaatcctgcaaaattcgctcccatgtggagtcgaacccaggacctcaggtgctactgaggcacttgtaaccaccatgctttatttaagagtaaagtgtacggacggtccttaaacttgtagggatgtgtcatctttgtccctaaactctcaaaatgcacatccaagtctcagaacttgtcatactgtgtcatctaggtctcaaatcaccaaaaccccttaggatcctacgtggcgttgatgtggcataccacacagacatgacatggcattattttggactgacaaatatgacccatttaaaatttttcctttttctttttttcttctctttttttccctttcttctcctttctctgtgacctgagcagaagaaaggaaaaaaagaagaatgagaagaaaacgaaaaagaaaaaaaaagaaaagaagaaaaaaaagaaaaggacatgtcacgcccatgtggcatgccacatcagcgccacatagatcatagaggggatgtgtcgatttgggacttagatgatacactttgacaagttctggcaccttgatatacattttgagagtttatggacctatatgatacaacactacaagtttaaggaccgcaaatgcactttactctttatttaactccatactttttataggaagataaaaagactacatgttaaccctaatgttaacattcatatgcaaaattcatatgaagtgcttcatgtaaattggcacttttgagttaaccctttgagcaaattaattggcatcctcccatccttggagaggtcatcatacgctgatacgcatcagtggcatactgatactggcatgtctcacagatcgtgctccttgctagtcgacatgctcagaactagtctactgcattttggccactcaatattgttacacatcactaaaaactaccgagtcacctgttaacaactactaacaagttggaagcttcaaaactgactagtcgaatgggtactttactttacacgacttaccagaggcagagattcaaacaataggtacgtgtttgctgaatatttacttaagatcggtgtcaaatagccatcacttttggatttgtacatccataagggatgtagagaccggattgatatatattatctttatactacctccatattttaatgtatgacaccgttgattttttgtccaacgtttaaccattcgtcttattcaaaaaatttatgcaattatcatttattttattatgacttgattcatcatcaaatatcctttaagcatgacataaatatctttatattttcacaaaaattttgaataaaacgaatggtcaaacattggtaagaagtcaataacgtcatacattaaaatacgtagggagtataagaaaaagccatcactttcttgtataaagactttggctcaataatcaccgctgcagcccgccatggtttaaggtcattgtccatcaattttagaaattcatgcatgtaaaatttcagtgggtatgagtacatgtgcccgtacaaaatgagtacatttcccgtaatacgggaggtctctactttctcagataatttattggcgttcgtataggtgtgcactcatgggtgtgtgtgtgaatggtctgactgtggtgtatcttccattataggccgtgtttagtttcaaagtttttcttcaaacttctaacttttctatcacatcgaaactttcttacacacataaacttataacttttccatcacatcgttccaattttaaccaaacttttaattttgacgtgaactaaacacagccataatatctttttagaggaaaactgacaggctcatgtaaggtatggttgtcatctattaattcatccattcagccatttagaagaaaagaacaggcggtgcctctctgatgtggccgtctctagatggttgtttgcattgctgcgccatcgaaatctagctgaaaaaagtattgtaggtacgattgtcattcgtcacacatggttgccatgccgtggatgtttcgcaattcataacaaaagatcttgcatcaccaacgagacatgtatcaactgtgccatttttccctccaatattacataagcattccctccgtttcaggttataagacgttttaactttggtcaaaatcaaacaactctaaatttgactaactttgtagacaaaatagtaatattttacaacaccagcaaagtttcattaaatctataattgaacaaattttcataatatattgtcttaggttaaaaatattactattttttctacaaaattagtcaaacttagagtagtttgactttgaccaaagtcaaaatgtcttataacctgaaacggagggattactatatatgtttctacttctctatatatgcctcagttccctactataaatgaaatcagaactgaccagtgatcacatatactacagttggccctcatcatggctctcctcatttatgtagtgctcctgttctccctatgcatctcagcaaatgctgccatgacggacaccatctcaatgggcaacgcattgggtagaaaggacaagctcgtctcgaaaaatggcaggtatgcacttggcttctttgagacagaaagagtagaagtatcccagaaaagtagcaagtggtacttaggaatttggttcaatcaggttccgaagataactcctgcttgggttgcaaatagggataatccaatcaatgatcccacctcattagagctaacaatcttccatgatggaaatcttgtcatcttaaatcggtcagccaagaccatcatttggtctagccaagctaatatcactaacaataacaccagtgctatgctcttgagtagtggaaatctcatcctaacaaacccctcaaactcttcagaagttttatggcagagctttgactaccccactgatacactttttcccagggccaagcttggatgggacaaggttaccggcctaaaccgtcgtattatctcatggaagaactcaaaggacctagctgctggtgtatattgtaaagagttagaccctagtggtgttgatcagtccttgcttacaccattgaattccttcacaccgtattggtctagtggcccatggaatggggattactttgctgcggtcccagagatggcaagccatactgtttttaattcaacatttgttcacaatgaccaagagaggtactttacatatactttggtagatgaaaggactgttagtcgtcatatagtggacgttggaggtcaagccaagacgttcctttggtatgaggatttgcaagattgggtaatgaactatgcccaacctaaatctcaatgtgatgtctatgcagtttgtgggccttacacaatttgcatcgacaacgagcttccaaattgcaattgtataaagggcttcacaataacatcacatgaggattgggaactagaagatcgaacgggtggatgctcaagaaatactccgatagactgcactaacaataaaaacacaactcattcttcagataagttctattctatgacatgcgttaaactgccccaaaacgaacagaacatagaaaatgttaaaagttcaagtgagtgtgaccaggtttgcttgaataattgctcttgcactgcttattccttcagcaatggtggatgctctatttggcacaacgaattacttaacataagaaaaagtcaatgtagtgacagtagcaatacagatggagaagcccttcacatacgtcttgccgcagaagaattgtatagtaaaaaagccaataaaagagtaatggttattggagtggttatttctgcaagttttgctttattaggtttgctaccactgatcctgttattgctgagacggaggagtaaaacaaagttctttggtgacactttgaaagattctcagttttgcaatgggattattgcatttggatacattaatttgcaacgcgcaactaaaaatttctcagagaagctcgggggaggtaactttggttttgtattcaaggggtctctaagtgattccacaactatagcagtgaaaaggcttgaccatgcatgccaaggagagaagcaatttaggtccgaagtgagctcaattggaatcatccaacacatcaatctagttaaactaatcggtttctgttgtgaggctggcacgaggttgcttgtttatgagcacatgccaaatcgttctcttgatctccaattatttcagagcaaaactacaataacttggaacattaggtaccaaatagccattggaattgctagaggactagcctatttacatgaaaactgccaagattgtatcatacattgtgatattaaactagaaaacatccttctcgatgcttcattcattccattaattgcagattttgggatggccaagcttttgggaagggattttagccgagttttgactatggtgagaggcaccgcaggtttccttgcacctaaatggattagtggtgttcctattacactaaaagttgatgtttacagctatgggatggtcttgctagaaataatatcaggaaggaggaactcacgtacctcatgttcttgtggcggtgatcatgatgtttattttccggtgcttgtagcccgtaagcttcttgatggagatatgggtggtttggttgattatagattagatggtgagatcgacataaaggaggctgaaatagcttgcaaggtagcgtgttggtgcattcaagacaatgagtttaatcgaccaacaatgggaggtgtggttcagattctcgagggtctagttgaaatcaacatgcccccaatgccaaggctccttgaagcaattgctgctggaagctcaaatctgacatgttccttagcttcttttgtatgaaatatttcagctcaagaatccctttaaatacgtatagttccttttgatacaaatatatgtattgagtgacagacatattgtttgcaactattatattgttctaggactacaaggggatttggaattcctaccatcttccttgtctctctctctctctctcaattgagttgtttatcacctacttttgatatattctaccattttgctatccattatttagtagaaatttgggtgggcagatctaacaaacatctgatcaggatctgctccatgattcatgcaatagtgagatcaatggcaaggtcattacgttgcgcccttgtggccacgtttgaacc

SEQ ID NO: 56479 - DNA, 8389 bp, Oryza sativa
tctttaatctgcatgataaaatatgtgtgattgaacaatacggaccatttgtttgctagatattgtccttaagatatgatgaaagaaaagtgtataaatggaacactgtagatttctgacagatgtatgggctgataaaatatccccaagagtaaatagtccgaacttatatagaatccagcttggacacaatgtaaggagctttttaatgatggcgattggtgagtggaagttagagtttaggaggaacccaagtgaggctgacaaaaatgatttgatagagttgctagatgtaaggcatgatggggagagtgtaaggtgatatggacaactctggggaataaaaaagatctatacaattaacaatgatccctgcacaggcagattaccttaggaggtgtaattggctctgaaatgaatctgatttggttgagtagaattcccatgaagattaaacaattctttgtacctaacaataatgggcagaatcccttgtgcggctcaactggttaaaaataaactgaaagggagggacataattaagcttctaaactttatcataaacctgaaactgttaatcatatcatcttttaatatcgtttagctgttttttttccttattagagatttttttgttcgaattgcgtgttttgtaaaatgcagaaattttagagtttggtgtaattaaaattttgaaggctttgcttggtttgaaggggattgagggggaattcttaagaagaagaagaagagggaggaggaggagttagaggatgcaatgtaagttttataccctgcaaataatttaaaatcaaactcaattgcatttgcagatttaaaacatatatactttatgtacaaagttataatgagttttgtctctctgtatatttcagagaccgttgagtttaattttcagttcagtaatagcatgacaccccctgttacataatgcttttagagtttgtgtcgaatatatctaagtagtcgattataaattaggacttggatttgtaataggtgttaataaaatagtaaggctataaaaacaaaattttgagttcgacttgtcctaggctcaatttaagcttgattcgagctctagactagccgagcttgggctcctgtcaagcctaataatatataatttttattatttactttatatactaatagatcaaatatgctgccatttatatgtatccacacgataaaatagtttatattaatatcatatatttatctttattctttttcttctattcacaaatataactaaatagaaattaattacttttatttagagattatattcttaaaatatatgttaactaagcttgatggtcgagctcgaaccgagttcgtctggaagcttaaaggttacacaggcttagctcgagcctaggtaggtgagctcgctcgagctcgtctcgttaacatctctagataatagtaaagtcagactattatcttaggttatgttaaattataatcgcgtactttatcatagatgatggatgtctgaccagtggcctaacggtcgatggttgtgcccaaaattcgcatcaaaagcttggatgctaagtattcactacttactggactcaagttacatgtgatcgatcgttccaaacagaaaggaaatggtttccaacgctgcattgcacctgaggaccaaacaaagtcagggttttgttcgatcggattccctccattcaaatcacttccaaattccgttaccctttgcatttccactctccaaccaaaacgcctccaatagtcatctgtccatcagtgtcactgatcaggcagccaatccacacgatgcaccaccaattaatacgccagccctgcaccattttatgaccaggaattaatgggacctggaaactggaagcaacatgagactgactgttttaagttctaaggccctgaatggatcattcagtccctagactaaaattagtctctagactaaaaactttagtcccctactgtttagatacaggaactaaagacatgtggaccgagacagagaagagagaggctatcactttagttcttataagtacctccaagagaaactaatgaattatagtcccaatatacacttttagtcttttttttttgtcacatctgtttaaattcttagggactaaaagggactaatgaattagtcccatgaaccaaacagagcatgacacaccaggttctcgttcgtgccgttgccgctacagcactgctagctcgcaataacgctgaagttcagttcaagattctgtggtaacttaaacttgttgattttttttctttttgtctggaccatcaggatctttgcatcactatacccagggtcattttcccagtcaaagccactgtaattccacacaaagtctccatgccgtggatattttgcaaagcataacaaaagatcttattacatcactgtccagatatgttatcactgttaccattttgccctccaacattatgcaagcgtatcctttgttaacttattatcccctatgggcctcattaacctactataaaatgcaagaagaagtgaagagcagtgatcacctatcctacagtttcactatgtctctcctcattttcatagtactattgttctccctatgcatcccagcaagttctgccacgacggacaccatctcagctggccaaacgttggccaaagatgacaagctcgtctcgaaaaatggcaggtatgcatttggcttcttcaagacagatacaaaagcgtctggaaaaactaacaagtggtacttaggaatatggttcaatcaggttcccacgctaactcctgcatgggttgcaaatagggataagccaattgatgatcccacattattggagctaacgatctttcgtgatggaaatctcgccatcttaaaccgctcaactaatgccatcctttggtctacccgagctaacatcacaacaaataacaccatcgttattctcttgagtagtggaaatctcatcctaacaaacccctcaaactcttcagaagttttctaggagagctttgactaccccacagatacatttttccccggggcaaagcttggatggaacaagatcactggcctaaaccgtcgtattatttctaagaaaaacttagtagacccagctactggtatgtattgcgaagagttagaccctactggtgttaatcaggtctttcttgcactagtgaattcctccacgccatattggtctagtggagcatggaatggcgagtacttatcctcaatcccaaagatggcaagccataattttttcattccatcatttgtgaacaatgaccaagagaagtactttacatataatttggcaaatgaaaatattgttagccgtcaaatattggatgtcggaggtcaatcaaagacgtttctttggcttgagggatcaaaagattgggtaatggtcaatgcccaacctaaagctcaatgtgatgtctattcaatttgtgggcctttcacagtttgcaccgataacgagcttccaaattgcaattgtataaagggcttcaccataacatcgctcgaggattgggtactggaagatcgaacaggtggatgctcaagaaatactccaatagactgcatcagcaacaaaaccataacccgctcatcagataagttctattctatgccttgtgttagattgcccccaaacgcccagaatgtaggaagtgttgacagttcaagtgagtgtgcacaagtttgcttgaataattgctcctgcactgcttactccttcagcaatggtggatgctctgtttggcacaatgaattgcttaacataagaaaaaatcaatgtactggcagtagcaatacagatggagaaacctttcacattcgtcttgctgcacaagaattgtatagtcaagaggtaaataaaagaggaatggttattggtgttctttctgcatgttttgctttatttggtttgctgctagttatcctactactcgtgaaatggaggaataaaacaaagctatcaggtggcacaaggaaggattatcagttctgcaatgggatcattccatttggatacattgatttgcaacgtgcaactaacaatttcacagagaagcttgggggaggtagctttggttccgtattcaaagggtttctaagtgattacacaattgtagcagtgaaaaggcttgaccatgcatgccaaggagagaagcaatttagggccgaagtgagctcaattggaatcatccaacacatcaatttagttaaactaattggtttctgttgtgagggtggcaggaggttgcttgtttatgaacacatgccaaatcgttctcttgatcaccaactatttcagactaatactacacttacctggaatattaggtatgaaatagccatcggaattgctagaggattggcctacttacatgaaaattgtcaagactgtatcatacactgtgatattaaaccagagaacatccttctcgatcattcattcagtccaaaaattgcagattttgggatggcaaagcttttgggaagggattttagccgagttttaactacaacgagaggaactgcgggttaccttgcacctgaatggattagtggtgttcctattacaacaaaagtcgatgtttacagctatgggatggtgttgctagaaataatatcaggaaagaggaactcatatgcctcatgtccttgtggtggtgaccatgacgtttatttcccggtgcttgtggcgtgtaagcttcttgacggagatatgggtggtttggttgattacaaattacatggtggcatcgacaagaaggaagttgaaaaggctttcaaggttgcatgttggtgcattcaagacgatgagtttagtcgaccaacaatgggaggagtggttcaaattctcgagggcctagttgaagtcgacatgcctccaatgccaaggcgacttcaagcaatagctggaagctcaaattcaacatgctccctgtattctcttccagcaaatatttaagttcgagaatccttgtaaattaaaaggaactttgtaattcctgacatctttcttctttttaagttgtcttgttaacatagtaatttttttacagtcttgctatctgtcgttcaggattcagcaaagtacaaaactagcacaatgttcacctgaaaattaaggaataattaactatttgccactcttacgagtggttctaaaagatttaccactggacccacatgtcatagacacatgaaggcccacatgtcatagacacatgaaggcccacatgtcatagataacgagtggcaaattcttaattgacacatcttaaaagtggcaaataattaaatgtcccaaaaattaactccatgtgcaatttctgatctcttcagtcttcagaataacagtcacacatgaatggctttattcgtgagtttactgatcgctggtcgacggcgtctgagataaagcttgtgttggcccggatggtcgattcatcacttttactctgaacaagtttgaaagccagatcgactgttagttcatcattttgttctttctctctctctctcttttttaacaaaccggcacgagacgatgcccgtttcaattaatatagaaggaagaaaggtttgcatcccctaggggctgaaaaaaaaaggtaactatagctatacaaatgccgattgtagctcaagcaaacgctttgcccctgctgaaagcccatgtttaatgtttttgccacttccttgattttattgaccagacgatgtactggggactccttggagcaggtacaatagcaggctataagccggctataaccatatatcgagaagaaaaaagaagagagagaagaaatcaggctacagatttgtagccggctgcaacacggactctaagatattatgtgtgtatgagaggtgggaccaggtattaatggtgtaatatatttttatagttaactattgtatgaatgaactattagattgattatagatgtttgggagacagtagtggctatactattgaccttgctcttatgcatcctcattcattcagctcttaaagtggctgaaatctgtatcgccagtcaacaagtgatatggtgtagcaattctgaatttgccaacgactttgtgcgcttagcaggctgttacaacttacagctagtagcaaccaccatttcaggctttcagctggctttgccacgcctctcgctatccatttgttcagaagtcataaacctgtatatcaaagagcctgtccaagatcgtcgagatcggtcagacagcaacgctgtcgcgtttggttctggccttccggtgaatgatcgaattattatgtgccaatttcacaaggaacatttgtttaatggccatgctaatcatgattatattttaaaggttaaacagacgacgatttctctccggatatcactgccacagtgccactggacgccaactttgtctccagctatttgaccaggttatctctgagctccacagtccaaaacatcggaaatgataagatattaataaacatctcaaatgatatagaagtccaggaagacatgattaattttagtttccaaagttgaaaacaaacagatgttgagcacagacttggatcattcgccactacggtacaatttgcgagctttcagatgtcatttgtgccacagtcaaattactaccatttaccaacaacttgatccaaattcaacccgatcgatcattgacagaaatcacccataccttgagattctttaattcgccggccgatacagatgctaaacataaatttggatcattcatcactagcgctacaaatttctggttttcagaaagtcatttatgccactattgaagtactccctccgtttcatttatgaatgaatctatacacatacatatatatctagattcattaacatctatatgaatgtggacaatgctagaaagtcttataatatgaaacggaggaagtatcatttaccaacaactgagtccaaattacaacccggtcgattgaccatttgacagaaatcagccgtactttcggattctttaattcgccagccgactaattggtcacaaagccctaagagtcggttatatgtctgtatcatgatgtaatttttttactgccatatatgctaggtcaggccaatgactccatccttctttctgccttcaaatatgttaccatctgccaagtcccaacgaccatgcaagcttactcactttccctcttgcagtgtgttctctcgtatccacacgcgcaagccgcagttggcatcctctgtcatcctttttttttagataaaattgattaaacccggcctctacatccaaactggatgtacacagccaaggcatcctctgtcatctacctcacccaagtacctttgcagctgtgctagctagttcttgatttgttcaccatggctcttcccatcactgtcctgttcctcctcttcacactgcacattcctgcatcctgcaaggtgacagacaccatctcagctggggagacactcgccggcaatgacatacttgtctccagcaacggcaagtttgcgcttggcttcttcccaaccagcagtaagtcctcccacaatgcttcaaactggtacctggggatatggttcaaccaggtgccaaagctcactccagcatgggttgccaatggagatgagcctgtcactggccccacttcgccggaggccacaatctccggtgacggaaaccttgtcatcttagatcaggccacaaagtccatcttctggtcaacccaagctgacatcacagcaaacacaacaatggtcaagctattggataatggcaaccttgtcctgcagaacacctcaaattcttcggttgtcttgtggcaaagctttgactacccaacaaatacccatctcgccggtgcgaagctaggccggaacaaggtcactggcttaaaccgccgtcttgtttccaggaaaaactctgtagacccagcttctggcatgtacagttacgagttaactgacaacaatggttctaccaggttcatccttgcagctctcaactcctctataccatattggtctagtggagaatggaacggacattactttggttccataccagagatgacaggtcaacgcttaattgattttacttttgtcaacaatgatgaagaagtgtacttcacatataccttactagataacgcaacgatcatgcgttttatgctggacatctctggtcagaccaagatatttttgtgggtggagcatgtgcaagattgggtaccaacctacaccaacccaaagcagtgtgatgtgtatggcatttgtggagctttcacagtctgcgaagagagcaagctt

SEQ ID NO: 56480 - DNA, 6100 bp, Oryza sativa
  unsure (1)..(6100): unsure at all n locations
tgagaaatactccattagactgtggtataaacagaaacaccagtatgcaagacaggttccaccctatgccgtgtgttggattacccagtaatggccaaatcatagaagatgttacaagtgcaggtggatgtgcacaaatttgcctgagcaactgcacttgcacagcatattactatggtaatactggatgctctgtttggaatgatgaattgattaatgtgaaacagctacaatgtggtgatattgctaatactgatggagcaattctttaccttcgccttgctgccaaagaggtgcaaagtataaaaagcagtggacgatcaatattcattggcgttgccatcactgcaagtgttgcttcctttgctttggcactcttcttgatagcgaagatcccaaggaacaagagttggctgcttggtcacagaagaaagaattttcatagtggtagtggagttattgcatttagatatgctgatctgcaacatgcaacaaaaaacttttcagataagctaggggcaggtggttttggctcagtattcaaagggcttcttaatgagtctactgtcatagcagtaaaaaggcttgatggtgctcgtcaaggagagaagcaattcagagctgaagtaggatcaattggaatcatccaacacatcaatttagttaaactaattggtttctgttgtgagggtgatagaagattgcttgtctatgaacacatgccaaacctctctcttgatacccatttatttcacaatgacgctacagtcttgaaatggagcataaggtatcaaattgctcttggagttgctagaggactagcttaccttcatgatagttgccaggattgcattatacactgtgacattaaaccagagaacatacttcttgatgcatcatttgttccaaaaatcgcagattttgggatggcaaagtttctgggaagggagtttactcaagttctcactacaatgcgaggaactatagggtatcttgcacctgagtggattagtggtacagttattacatcaaaggttgatgtctacagctatggaatggttttgctggaaatcatctcaggaacgaggaactcaagcaaagaatttgcaactcgtgatgactatgaatatttccctctgttagtggcacataagctgctggatggtaatgctgggagtttggtggaccaaaatttacatggcgatgttgatttggagcaggtagaaagagctttcagggttgcatgctggtgtattcaagataatgagcttgatcgacctacaatgagtgaagttgttcaatatctcgaaggtcttcttgaagttggcatacccccagtgccacgactacttcaagctattgcaggcaacccatattcaaagtgagcactaagcagaatttttcttatacaaacatcttaaattgagaacttatcataatcccagaaatatatgtgcggctgagaggcatgataagagcatgatatttttccatgacatcattttgtataatatcataaaagaatatgacacatcaacattccatgccagcactcctaactgcatcttttttttttgttatatgtgcaggtagttgatgggtacctgaaccaagcttcagaagaggcaggccaactgtaagatacaatagagcaccgtgcacctcattcttgacacgaaagtagctctgatgtaatcctggggcttcccttcagtagttgcctggagtctaatctgtcaaaataaaagcagtgatgatttgataatccaagtctcctgcagaaaccaaagtcctctgctaatctgtggcacagctttgagcacctgataagtaaatttctcgccggtacaaagattatttagaacaagcttgccggtataaactgctgtctaattgtgttgttcccagtaagaatttgtcaaccttgtacctggaatatatcatgagtaaggtcatcctcaaacaactgaaatctccccagccacacttggttttttactgaaccaagacacactgcttgaacaagaagggatcgatcaatagctcaatttgatgttagccatgttatgtcaatagcaccaaactgtacatttagcaacaatggaagaggatagcactttaaatataccttatgagacgagataacagctgtgcatcatttacaggattcttcttgtgaaatggagattaagacctcacgagactgcataataatgtattatatgccaaccccaaaaatatttgtgagatgtcttctggtcctccaacaaacagcagcggcaatcagaatcagtcttcggtatttggaacatatcaccccccaaaataatctaatttcgtcgtaactctgatcagccaaaaaatacttgcatcaacgttatgtaactgtagacttgaaaattgaaatgtacaaactgctaagtgagagatgaactctaaatccccattaacctttgtctcctcaagcgcgcgccaatttctaccggaaccctagtccattccaagcgaaacgaggatcaaacaattcgtctcgctttggcgacgctcgcgggggcacctgcgaaaggatccccaaatcgtagaggaacagataccagtgtatgtaggggcgacgaagaaaacccataccttgccacggagaggctccgtcccatttctcggcgtctccgccggcggcgccggtggcggcgaccggcgaggtcggcggcggcggctggccgccgacaaggaggcgaagagagagaggagagtcagagagattctaggccaccagcacaggccggcccatcacccccatgcgagcgagcttttctgcgcgaattcgcccacaaaaaaagtccacattacgtcccttagctatgggtccgagtttcatccgcgtccctcaaccgcgaaaccgggatacacattgtcccccaagctataaaaaccagtgtaaatcaacacgagcccctcaatgatttgggtgtcgattccatcttagggcacccacaatggttatctataagctctctacaagagatccatgtcagcatattttcctacttggaagagattaaatgaagagagagagcaaagctatctactaacatgaagatagtctatagagaaaaacgaggcaatggattagagagctatagatacccatgtagacataccattgaagtggtttactattaatctagtctattgttgaggtgtacatattttatagatagcaccttaccattgcgggtgctcttatgtgatacattgacatagttttcatccgatgtggcgtgtacttataatcttcatcctatccctatcagttcatccataacctctaaatgaattaactttaatcctcttgttttttcgcctagtccccctctctctcagctcaaataatcacatgacgagaggacgacgagaagaagaaacagagaagaatgccttttttttccttactagcaaaagtgcccgtgcgttgcaacgggtgaaaaaattctaatgataatatacgtttttcatgaataatcatgtcaatgacaatgtttgtattttaatgagcggcttgtttttttataaatggtgttttttttcttgcgcgattttctcaaaccattcagaaatggcacatttctttctaaaagtttttttatcatttttcttttgcttttttacttacaatgaaaaccatatttttctctcttttgtgccttttttttctagtgtgttcttttgtctttttttacaattattttctcacgcattttttttcttgttttttcttcaaatgttctttttttgcttttttccaatacaggacttacgggaaatagaacttttgttgttgttgtttttctttttatgcacctttctgcttttgttctctctctttttattatttttaccaaaaacgaccacaagtatcttgttgtaagattatagggactcaaatgtaaatataaaaattacagggactcaaatacaaaagtacaaacccaaaaaataaaataatataaaaatggaatgctctcgacatgtaggtttcgtttttgtaaacagatcttcaatccggcacattattttatttcaccaagatttgagagataacacggtacagattgaaactgagaggaggggtggcgggtatctcggactcaaaaggactggcgccttttatttttcgggggaatcggatctatagtcggatttttttcgtttttgagagagaaccggataggagtcggacttttttattattattttttcgctatttttttcaagatttttttcgtccttttttttggcacgtacggaatcggattattttttcgctttttttttatcggacggttacggtttttttatcgctcgtctagttttttcgccggtttcttttcgcccttttttgcagggaatcggaatttttttgccctttttttatcggacaattacggttttttcgcctggtttttttctcgctcgcccttttttttttgccggttttttgacggacgatggaagcatctcttattttttaagtagtagagataaatccaatacaaataattatgaaaaattctaaaaaaaacaatgtagggtatattgacatgtattgttctgccagaaatcgaattcaattttgacctacacattaaggaactaaaataagaaaaattcaaatgtgaacaacgcgttactattctatgctgaatttatcttttatatcctacctccatcccaaaataagtgcagccatgaatatccgtgccgaacgtttgaccgtccgtcttatttgaaaaatttgaaaatatttagtcacacataaagtactattcatgttttatcatctaatagaaataaaaatactaatcataaaaaatttttaaataagacgaacggtcaaacgttgaacgtaaatagtgtaaaactgcacttattttgggacggagggagtatatcttacgtgtgagttgagtttgtacccaagattttatatagtggtgtgtgtacaaatcttctgaatcaagtaccgactgtttgttctgaatcatttttggatgagtctgtttgttccttactcctgaaaagttaggattaaattttagattaaagtggcatgcttttcaaactactaaacggtgcattttatgcgaaaactttctatatgaaagttgttctaaaatatcagattaatccattttcaagtttgtaataattaaaactcaattaatcacacgttattaccacctcgtgttacgtgaaacacttcatcttcatcttcatcttcagtagattcaaacaccaccatcactctatgcttatatagtgtccttctgaactattcttctctttaccttagaaatataaataaggtagattagttgtatgaattgatcaataaatttgagctaatttattcgtaatcccccttttcaattcggttttcgtgtggggcaagttttgacaagcttttctctaacttcattcttcttctagaatttgatctaaccgttagattttagggtgtgtttacttcacaccaaaattggaagtttaattgaaattggaatgatgcgacggaaaagttgaaagtttgtgtgtgtaggaaagttttgatgtgatgaaaaagttgaaaatttgaagaaaaagttaggagctaaaccagaccttagtgtggaatttttgttagctctatagtgaagtctggtttctacaagcaaagtttgtcatagttctatcggttactttcaattaatctaggtttcagtaaacatatgttttcgttcagattaaagtttgttagatcccctcaattttatccattgcttttatgtctcttgacaaaaaaaaaataaaccaggcttattcttcaagatttctattatatggatttgaattgccgacgttcagtccgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56481 - DNA, 1074 bp, Oryza sativa
gattccttcggaaagtgttttacttcaaaaggaaaatctgaaaaaaaaaattgcaatatctgccaatcaaagagaaaaattaccaaacacatgaatttcatggctccactgcaagcctacaaataaaatgaaatatagggtggttgattcccaaatcatccgcatacccatcgacatgcagactgacagaaacgtattgcctagctaccatcttcagatactagcatcaaacaacccacgaaacagacaaacaaatcccacagtttgccaagaacagattgtattccatcaatgcgaacccaattcaagcgagtgattacaggataacacagatccatgggttaattaacacttctagatctaacaagccatgaactcgaacaataacggcatcaagccctctcgcccctgatgcggcgggcgagctggatgtccttgggcatgatggtgacgcgcttggcgtggatggcgcagaggttggtgtcctcgaagaggccgacgaggtaggcctcggcggcctcctgcagcgcggcgacggcggacgactggaaccggaggtccgtcttgaagtcctgcgcgatctcccgcaccagccgctggaacgggagcttccggatcagcagctccgtgctcttctggtacttgcggatctcccggagtgccaccgtgcccggccggaagcggtgcggcttcttcacgccgccggtcgccggcgccgacttccgcgccgccttcgtcgccagctgcttccgaggcgccttcccgccggtcgacttcctcgccgtctgcttcgtgcgcgccatggatgatggattgatggatctctctctcgatctctttgctgcgaaattcgaatggattttttgaattgaggcgtggggatttcgggttgggggcgcgggggtatttgtagttggcggaaggcgcgggatcgcgaaaaattttgggatttttggggggtggggtttggagcgtcggattaggtggacggctgggatgagtctaacgatggccgcgatccgcgggtggggggaagggcgcgacgctattggctgggacgggatgggggaggat

SEQ ID NO: 56482 - DNA, 13164 bp, Oryza sativa
  unsure (1)..(13164): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgacgtcttgtgtcaggctccgtcgcggtagtttaggttaggttacttgttggtgtggtgtcgtagttgtggttttcgcttagtttttcctaattacctgagcattgtaaggtttggtcctattttcttcttaaaatagaatatcttcttcttaatataaaacgtcggcaacagcctgaccgtttgaaaaaaaaagaccatgtgcagagatagcatcctttcagtgtataccatctctctcgtcaaagcatggacattgcttgtagggcaatgcacattggacacagcactgtatttggatgccatctcatcactatcgtggaacataagtaatgtgccaaagctacagcaaagtctaattgaacagatgctgagccataataatgagatccccggcttgatcagcggtggattcatgaaggcgtaggtggataggtgtggcacgtaaatatcagagcaattattgcgagcttgtgatgtgtccaatggagcaatgctgaaggtgtgaatgatatctcaagcttacattttcctagatttggtgtcacatgactaattcgagctaaggatttttttttttttaaaaaaaaagtagaaattcttgccgattttaagatatggaggattggaggttacatatttttttgcaattgcaacaaatcatcgctgcagctaataagggagactccaccgacagatacggttaacctggatgcagacggatttgcaacgcatccatgagatttattttgtttaagtattgttcgcacgtctagcaattccagtgtttgtcctgtccatgtatcattaaagacattaaagacgagaattagcgcatcgatctcgatttctgggggagaccaaaattttgcctgattttctgctgtttggcagagggaagaagacaatatgtctcaccttttcaggagtgtttctttccttggtgcaccccgtattttgctaaagatgttcactatttaatcaggcagatgatatttgtttcatcaagccgtttagtagtactagatgactagaagtgattgcttctgaaatgaggaggtgactattagggactactagcttgtagccaaatgaagggtgtccgagtttaaagacgtcaatggaaaatagaacacctctgtttatttctagcaactaaaaatgcactaattgattagatgctttaatgcttatattaagattcaggcctatgtgataaaatggaggaagatcccatggaacagaggagagaatttgatactatcgtcaatcactcaatctaggagcctggtccatctggaaaaggcgtaacgatcgagtgttaaactgacgacagtgaaacttttttttttttggcggggttttgattacggcagtgaaacttggtcgatattacaaagacaatgggcgaaagaagcatagcggttggcgaacgttgcagttccgtagctacttctgtagccagtgatagccctaggttgccttatatgttgcaagaatcaaactagtgcaacaagttcctttccccctgctttttttttcctgttccgttgtaattagcaatctttactttcttaatacaacaaagatgcgtaagttttttttcgtattcctgaaaagaaaatgtagttcttatatgaagttgcatgaaaatatatgaatatatagatgaagccacaaaatgaagtgtcttaaactcttctatatcattgagtttgtcatatttcaacaatttactattgactttatctttttctacaatataccagcgactttatcaattattctacaatacattattgggctgggcttatttttcaataatatctaaaatacccttatagacatataaggttaacaattgatttataccattggaagttttaaaaaatatataaaaacttgtatgtggcatccttgcatagtacaaaagtttgtatataagttttaattttttttttcatttctattttttaaaataacttatttgttggtatataaaatattttttgtgttgttgtttttaatgtaaattatttttcatatgcaacataagatatttttctattatcttttgtgtaagctatttttctctgatataccatacaaaaatatttttttttctaagaaaagaccaaaaaaattgaaaattatgtacatacttctttgttgtgtgaggaggccatgtaaaaaaaattcatattttttcgatactttcttatgagataaattaaatattaaccatttatgtctataaggatattttgggtattttttagaaagaggcctatcccaatagcgtattgtagagcaattgataaaatcatgggtatatattgtagaaagagaaaatatcagtggcaaattgttgaactgggataaacttagtggcatagaatagattctctgttagggaaaagactaatacgtaagaacgatacaaccagttatccatgggagtgtgcacaaacacaaaacacaaacattttagtgatatattgcttgcgtcctcgagatgattgttacttgccagatacattttagtgatatattacttgttccgtgtttagttgttttggaaaaaaaaattgacgtatacgaacacacatttaaaatattaaatatagactaataacaaaacaaattacagattccgcctgtaaactacgagacgaatctattaagcttaattaatccatcattagcaaatgtttactgtagcaccatattgtcaaatcatgatgtaattaggctcaaaagattcgtctcgtaatttacatgcaaatcgtgcaattggttttttcgtccatatttaatgtttcatgtatgtgtccaaacatttgatttgacggaaaagttagaaatttgaagggaagtaaacacagccttgcatgatcgttctatacacccgcggagctgagttctttcccacttttcccaactcacctttctcgttttccatgcgtacgcatttcaaactgctaaacaatgtgttttttgcaaaaaaaaaattctttatgaaagttgttttaaaaaaatcatattaatccattttttttaaaaaaaagtttagttaatacataattaatcatgcaataatacgtgggccgttttgcgtgccgggtggagggtttccaaccttttatctcgaacacagcctaactaagctagtgttctagcctcaaaaggagtatctaaaataagtgcagagtaaatcgtatgtatcctttcccgcccagctaatacaccgttttggtgatttgaccttggagtcacatgacgaactgtaagcgagcttaataggtgcactttaattttcagctattccaatagtgctacaattcacatagatcacacaattaacgccaagatacccacaccatggacccatcacatctataatagcgaagtgaaataaccttgtcgatcaccacatgtgaaaatgccaagcacactgctgcgaggaaatcgacatactcgttgggtttcatgcattatattctgagtgattataaaaacgtgctggcagcccagtaacagtagtagccgagagcaccatttttgttttctcctcgatcaatgaacgtctttcatcaccgacacaaaacacacagccgccatcgatcctcacgtgcctctaccacacagattgccagattggtgcttgattgttaagtattattattactgcgtgataacgtgcgtaccacaaggttaattaggctaagagcaaagataataatagcgctcacttcctactattaatgtatcttaaagccaacatatataatggattagctataaggctagctataactttcttcttctctctatctctcacctatgcatttaatgtatttaattagaagcttgtgttaagctaacttttacattagagccaacatccttgatttttttttatcgctattcttcacgtaagctcactattatacttgctctaatagagtagtactgctaaggctaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccacctaaatacgacctgctccaccgggggccatccctggtaaacagctagagagtactaagctatgtacagtgatcctgacctacacgtacgtcaaacgtttcagaccaccacggcgccccgactggaccagcagcgaacacaatgtgaccagcggcgaaaccccctccccctcccccacatgcacgccaatcccctcaccgccaccaccatgccgtgtcacatgcccgcttccccgggctaccatccaagcctccaccgtgtatataatgcggtgccatgggtagagccattccacacacactgacctgcaagctcgctgggcagcttacacaggggagtgaagtagagggagtgtgagagagagtgagtgagaatgggtggcaaggccgctctcctgatggccctggtggccatcagcgtcgtcctggaggccagggcggacgccggtggctacggcggcgggtacacgccgacgccgacgccggtgaaaccggcgccgaagccggagaagccgcccaaggagcacaagccgccgcaccaccacgagcccaagccggagaagccacccaaggagcacaagccaccggcctacacgccgcccaagccgacgcccaccccacccacgtacaccccgacacccaagcctacgccaccgccatacacgcccaagccgacgccgccggctcacacccctactcccccgacgtacacgccgacccccactccacccaagccgacgcctcccacctacaagccacagcccaagccgacgcctgcgccttacactcccactcccacaccgncaacatacaagccgcagcccaagccgaccccgccacccacgtacaagccgcagcctaagccgactcccactccctacactccacccacgtacaagccacaaccgaagccgactcccactcccactccctacactcccacgcccaagccgaacccgccgccaacctacaagccacagcccaagccgactcccacgccgacgccgtacaagccgcagcccaagccgactccttctccctacacccccaagccaactccgacgccgccgacctacacaccgacgccaacgccgccgtaccacaagccgccgccgtcctacacccccggcccgccgccgccctactagttgtgttccgccactctccgtcacgttccgaccaaaggtatagtacgcccaacacttcagacgctcacggttcagtttgcacatttacttattttcggaaagatttttgagtccgaacaaatttaaatataactaatatttttacaataaaaatttcagcatagattcacttatcaacataaaattttatattgcttattaattaacctgcatgcatggacgaacggatatcttgaataagtctcttaaaagcgggtgcttaatggcgtactctgtttgttttctgtctttgcaggaggtgaccgaccgaccagagttgtgcgagaggccaaagaggctcttccttccgtgaagattgctgtgcatgccgagctgcgctgcctttaattacctatagctaattaattagctagggccaatgttgcgaggagaataatgcatgcttgagtgccaatgttgctagctcgctccctctctagatgtgatgtgtatcatgtgttgtgtgttgctcgaatttgtactgtctagcgtacgtcgatcccgtggtgatttgtggagtatggtattgttgtgttacggtataaccaaaaataacagcggaaatggaagtaaaagctgttttcgatcgtcccagcatttcttctttcctctattcctgttctttcgcaccgtgcaaccacgagaaattgatgattgcatgcatgtcagagaagactctaaactttactagtacaaattgtactgataattaaactccacacagtgacatatagagatttcacttgaaataaatagtacttcctccgttttcgtataacacccgtttcaaagatatttgatactgtttgatcattcgtcttattcaaaaaatttaagtaattatttattcttttcatatcatttgatttattgttaaatatatttttatatacacatagttttatatattttataaatatttttaataagacgaacggtcgtgctgctactgcgtcaaatattttaaaacggagggagtactcccccagaacgagccacaagggtacgactatcacaattggtgacgccattataaaaatgcaatagtctctgcatttgcaggtgcagcagcatgcatgcatgcctgagcagccgtgagctgtcacgcgttgctacagtctcactcgccgcacagcacacaggtacagcgaccgcctctgcatttgcaggaggacgcccatacggctgtgacatcaaagctagcctgcgctccaaaacttcaggaccagaaacaatgtctgtttgcatctccattttcgacgcaggcgcacacgtcggtccgatagactttggagtgcaacaagaactcgaaagacataagcagagtgtaatcaagcatatggtttagtgctgagtttttcatttcatatagcaagggcatgtttatttcgcgaaataaaatttttttttgtcacatcgaatatttgactgtatatcggaagaggttttcaaacacgaatgaaaaaactaattttataactcgcctgaaaaccacgagacgaatcttttgagcctaattaagacgtcattagcacatgtagattactgtagcacttatggctaatcatggactaattagactcaaaagaatcgtcgcgcgatttcctccctaactgtgtaattagtttttcttttaatctatatttaatgcttcatgcatgtatcaaaagatttaatgtgatgtttttgggaaaaacttttggagaaataaagggacctaacaatagcaacgttaagtgatggaacatgatgaacaacgagaagaaaatccactgtgtcactcttgcgcagtggcggatttagaaagaaatagtagttgggtctaaacaaattaaatagagttacaatgtccccacccatctatatataataaaaaaatttagcggtatcttcgtgggggctctcatagttttcacgccagtagtggaggctcgagaccccgccgcccccgtgctagatctgagagtgagaaatatatatgcactcgcaagcaaactgagaagcttgcaaggacgtgtactctacacgatcaatcctcctttgcagtagcaaactgagaagcttgcaagaacaacggattgcaagctgggcgatgaattggtggaaggtggtgtgtggtcacagtgatgttcgaaatctgaagcaatgaattcgacgaagggggagagaaagcgtgcaaggacattggtcggtagaataaattggcttgcagtaaaagaagatcacgtgatggcgcatggccgcatgggagaacttatggtcttttgattccaaaggtttcaagcgctttgttgtgaaaagctgaaaaggtgaggagaacaaagaaaatttagatctggtttagtttccaattttttcttcaaacttttaactttttcatcgcatcaaaattttcctacgcacacaaactttcaatttttccgtcacattgtttcaatttcaatcaaacttctaattttagcgtaaactaaggccgggtttagttacaaatttttttcttcaaacttccaactttttcatcatatcaaaactttcctacacacacaaactttcaacttttccatcacatcatttcaatttcaataaaaattctaattttgacgtgagctaaacatacccttaaaaagatagtcgtcatattacttcaaggagaatatactacagtagtatatataggagtagttttattttagataatgagtatataggagtagtaaattatggaaatggtaagatataaccatgttcagtgttctacttttcagtagcctctcacagggtacacaaaaacaaggaaccaccaacattgtacttgagatggttaatactctaaaatctagataaaacttgggaacaaagagaggcactaacattttctttttgttcttttgataaaactggtgcgtagccattgcacatgaagctcgttttattactactactactactgctactactcaacttgattatagaacttgaatataatgttgggttgttgtgattatctcccgcggtaataatttttttccactgaacgaggcagcgcaagccagaatgcacatgttcatgagataagtgtcagaggggatggatttagtatttggaaaatagcttatgccgatctgaaaactactcagattttcgctcagtggtggtgcacgtcgctggtctttttttcccatttcctcggttcgtggctagcagcctcttgccctcttctagttcacacgaaactggttagtgcactatttttcaatgtatcctccacatgggtttgtcgatggatgtcagatatccctggaataaacttcagagaaaaagttatttttgcctcccccatacctcctctttggcatggaaaggcacacacgggcaaaataagaggggtgaaaaaggaatgcacagatgccaaaaatccaggtttatgtcgcggtgatgtttactagttgtacatgttgaattacaggtgcattttaatttttcaactggtttggagcataaaatcttacaaaactttcaatcaattaatataacccttttttgaatgaaataaaaagaaagacaaagatattagaaaaaaaatataaatctaaaaacaacagttgtaaaatctaattttaatatactgtaaccaagtacaatgtaaccaagtataattactatgtaactaactgtaactacaagtcgagtctacatgaatacgaatgttgatataaaaccttacggacgaaaaaccgaaacccaaaaaatctatagtaagtgaaatagcaactttatactaagtcaaaaacaagatacattaaaaaaaacaaagacagcgtgctagtagaaaaatcattgtactagtatatcatacttcctctgttaaaaaaactaatctatatattctagtacgagagatgtgatatattagctcatttcttttcttagactgagggtgtaggtaaaaacattgattatgggctactgcatttccattgagcaagggccaaggggaagaggagggaaccttgtgcccgggtgcgtgaggacatgagaataacctatagggtaggtttcagtaatggcggtcttaaccggcctgaaaatttttatcaattcctgcctggagatagatctaatcccatttgaaaaatccaaggacgggttagtggtacagtagttaagtttactggcgcagtttctacctcgtgaagttgtcatcactcatcagctgcccaggcaatgcaatgcagaacagctggctgaaggtatgatgttgatcctttcctccaaaaagaagaaaaaaaaatgaaagctctagtacaacaaataactacggagtactatcatcattgacccacagtgtggaactcagtatggatcagaaggatccagagaagccaaaaaaacaacaaatgctacgagggctccacatcacattgaccacttgaagcggcctctctctctctcacacacacatgttgaagcccaactaatgctcactacgaacagagcaatggttagtggcagtaattaaagtgcagtaacagtatgtcagtatcgctatgcatcgtatcaaacagcttcacctccgtgggctctgagacgcgggtagccgagcacggccgccacgagccaaaactggagcgaaacacagctgccgaacacgaacgcaaacttgtaatcagcgccaatttcttcgatcttctttacgaacgcgtaaaaaaaacacacaccaatatgctatagaaaaaagttttagttacacaacacaatcaaccagaacaacttatatcagagaaagggagagaaaaaaaacttaaacttagaaactagggtggctaaacacgaactacaaacagcgaaaatgagccgagccacagctgcccaatttcttcagtcaccagcgtcactcacgtccacggaccacggtccgccgctgatgatgataatgcccggcattgcaggggagatcgggcagctgcaagcagcagcaggaggaggaggatgatgagccgggcccagggtttgaccaaccacgcatcgagcaaactggccgagtgccgacaccgcgcgcgggaccggactacgtggtctctcgtctatccagagcgcggaaccagccggccgatgcgacgcagtgaccgggcggggcggcgattaaagaaggtttcagagtactaaattataatcgcagataaaattatgggtgcgatgcggagaatgaagcgagctgagctgatcgacgatctcacacgatcgggttaggtggccacggcgcccaatcagattagatgggtcatatggacgtacgctgcaacttggggatggccggcccccttttcccctgtccttcacctccctctctatacttgcagtttcctgttcgggttttaatgttcctcgtgttcttttacgtgcgtgcgtctaggttcatccagggcaatcgattcgaaaatcaatcattgatgacccgacaagagctaattatcagatcgatcgatgatggatgatgggcatggatggccggatgggagatggttatctatcaccagtgactacgtgcagcgcggtggtgtggcactgtggggtactctacaattcgacgtgtttgggccttatttagattctaacttttcttttcaaactttcaactttttcgtcacatcgaatttttctatacacacaaactttcaacttttccgtaacatcgttctaatttcttcaaactttcatttttaacatggaactaaacatagtcttggtccggtaaattgtgaagatgtgctaaagtctctgcttgatttgctcgaatggatctcgatgggcaaactagtttttgtgttaggaacggcctaagctaaggaatcaatctaaagctaagagcctaacacgcatgctgttccatggatctattattggggaaaacaaaaatgtttcagatctcactgtcatgagaagaccagatccatccatctaaagcaccaagcgtacctacctttttaggttgaccttaccagcggattaacgccgtcgatcgatgccggtttggcctaacccatatcctgtgtagctcacatgcctcaaagcgtagccgcttaataatgcagtttttatcttttccgtgatggacagtacgaaacaatagaaaatgttctctgaagagaaccaacctgtcgagttggctatcatcatgcctcctgaattttgaagtgtttatcaggatcagaaagaattgcagctgtgcttcatcaggcctcaggtaaagaaccagcaatatcttgtccaaatcaatgctgttacagtaagtccaaaatccagcaattcaaggtagacctgccataacatcaaaatgtactcacaaaatgatcacagtaacggaatttcatttttgagtgaaataactataaactaaatgaagaagatgtgatttcattagagcctgtagtgcaaggctaggaaagagccaaccaatcaagacaggcctgtaatgcagggctaggcaagagccagacaatcaagactgctgatgattacattccaaaatgacagtattacagaagtcaaatgtaaaactttcgttggatgccaaaccatcatgtcgcagttccagcctcctctgccgctagtgtctaggggtctagattgatttctgccaaaccgacgaaattcatttgtacccatactttccgtccagataattgtccagtccaaagacacggacgttgttgaagcccactagtatctcctgtggactgtggttcggtccaaacacaccgcagccgcaaagatcaatgcgtccttaaggtccaaactagcccattaaagtgtcagttcaactaaattcagctaacgacgagaggacgcatcaaatcgaatagatcagtcaagatatcccatgatactctgtacttcactacttgtgtacagatatacagccgaaagtgaaatagtagtaggcactccgctaccagtgttaacactataatgcaaggtctgatttgagtgttcagtaacaatctatctatagcaggtactttgttccacatcttaatagcagtcatttagatgtacttttgaatggagcatatagaattcaaagttaggttgagtgtgttatctagccattttatgttaaaaataggttggaaacttgaaattcgaagtgccaggataccaaagtcaggttgaaactcgaaagaccaaactactagtaccagccaagtccaagtaccaacagcgtgaaatttggagctccttgcaacacggcccagtcctccaaagtccaaagctcaagataatgggtttggtaacatcgaacaaacgggagattcaaacgcgccactataaaaaggcgccaaatggaggagatcactcgaagcaagccgagcactgcagtgaagcgatcgagccaaagat

SEQ ID NO: 56483 - DNA, 21974 bp, Oryza sativa
gaatctttgatatgcaaggccaagataaacaccttagctaattaagtaaactcgaggtgaaatgaaactgttaggcaaataatcaaaagcccaggagcaactttctgagggcgttcgtgctttttgtaacattttctatcttccaaaatttaacgagaaagttactgagtaaagtatgtggttgctttgaaatcatggagctgacgtaatgttgttgcttcgttgttttgtggaatgcaagttgccatgttctgtgctggtggctgtgaattgtgacacatgaaccatgctttattcatgctcataagtcatcactattacttgtatgccatttactatgtattttcactgatgtatgttgtaatatacatgtatgcaacagtttattggaaaaaacagcggcaggcaaacgttgagataagttcaaacatcttaaaatgggtatgcatctgatgacagtaaatttctatatttataagtaaattaattaggtcataattgcatccttacaaatcttcatatatacgaagggctacagaaccatattggaccaaattgtgtagaataccttgctattaacagataaattaattactgtaatactaacttataggagccccagcagactcaccagtttaggcttgttaagtggggcaaagtgtcacgaactcagatttgagtcggaacgaactttctcctgtgactcgaattggaagggaaaggaagctggcttgaggaagaagaagaacagagacacgagaaagcagaggagcaggagggagattagaattgagtttgaggtttcagtttgaatacaatatttcatatctcgctctctcgcacctgccgactatatagcaatgcgccatctagtctctctcactgacagtggcccagcctttcgctactgggtccactcactcgacgggaagcgtgtgttgggccgcttcatcctttggatcgatcttgctgctgggccgctgttgccgtctcaggttgaacgccttgctcagatgccgccgtgacatcccctcctccttgagtggcaacttgtccccaagttgttgtagttggaaagcgacgacgtagctcctgctcattctcccaggtgacggcggcaggttcaccgccagaccacttgatcaacacttgttccaccatcttggatcctttgtgaacaaatcgacgatccaggacttgaagtggtaccggagacgcctctgttgtcggacgaagaacaggaagcctgggagacgctgtttcacttggtgccaaagcttgcttcaattgggatacgtgcaccactagatgaataaggctggaggagggtaacaccaagcgataggccacttcccccactcgctccaaaacctgaaagggaccataaaaacggaaagagagtttgcgatttactcgactgttgtacgaagggctgcagcttcatatacacccaatctcccacagcaaaaactcgttcagaacgacgattatcagcctgaaatttcatccgagtctgtgcacgcagaagatgctcccaaatcagagtttgcattttctctcgctcatgaagcaatcagcaagctcagtagactgacaagctgtagtagctgtcaacccaaaataccgaggtttgtggccatagagaacctcaaaaggagttgatcccaaagcggaatgaaaggatgtattgtaccagtattctgctaaggcgagccatttactccaatgagatggacaagcgtgcacaaaacaacgaagaaaagtttccaagcactggttcacatgttcagtttgcccgtcagttggcggataataagaggaactcatccttaattgagttaccgtggagcgaagtcgaggccaagcaaacaattgtttaactctgtgataagtaacatgaatgcctgaatgcccacccactgcagtagtatgaaggtttgctaaaattttctgttgcacagctgtattggtaccaatccatatacgatccttgaaatataacacaccatttctcagagaaaaattgggtacagcactagcactgatgcataaggtctgaaccttgctacacgcgtcaggatcaagtgagtaaccagacaccacttcctgaatccaatcaggcacagcaacagacaaggcagacaattccaaagtggcagaagaagggtacctggacagagcatctgctgcaccattatcagtgcccttcttataaatgattttgtaccgcaatcccagtaatttagtgagagccttgtgttgccagggagtggtcagacgctgatcatctaggaaagagagactgcgatggtccgttcgaatgaaaaattcagcgtgttggagataagggcgccaatgttcaacagccagcataatggccaagctcttcttttcataagttgacaagccctgatggcgaggtccaagagccttactgagaaacgcgattggatgctgatgttgcataagaacagcaccaatgcctttatcggaagcatccgtctcgacaataaatggttcagaaaaatttggcatggccaagacaggagcagtaatcaaggcttgttttaatgcttgaaaggctgcctccgtttcagatgtccaaatgtacaactgaccctttcgcagcagattagtaagtggtttacttaagatgccatagtgacaaacaaatttgcgataatacccagttaaccccaaaaagctacgcaattctttgactgaaccaggcaccggccaattctggaccactcgaatcttgtcgtcatccgtcgacacaccattaggagtgatgatatgccccagataggaaagacgttgttgagcaaaagaacacttactctgtttcaccttgagctgatgcttgaccagaatttggaacagttgtcgcaggtggttcacatgatcttccaaagttgcactgtaaatgaggatgtcatcgacaaataccagcacacatctgcgaagtaaaggagataagatgctgttcattccaccctgaaaggtggcaggtgcactggtcaagccgaatggtatcacacgaaactcataatggccactatgtgttttaaaggcagttttatgctcatctgacatcttcatacgaatttgatgatagcctgccctaagatcgagtttggtgaaccactgtgccctcgacaactcatccaacagctcatctataattggcagtgggtacttattcttcacagtgatagcatttagatggcggtagtccacacaaaaccgccatgtcccatcttttttcttaaccaatagcacaggagaagaaaatgggctggaactaggttgaattatacccttgtccaacatttccctaacttgctgttcaatctcgtctttttgagccggtgtataccgataggggcgcacattgacaggcactgcaccagggataagagggattgtatgatcaaaagattgagttggaggtaaacccattggttcatcaaagacagaagcaaattcttgaagaacatgttgaatcttgacaggaatttgttctgaagattctttgtcatccaaagaacatagctgaacaaaatgagcaactgctctcctgtcatcgaactctttcagttgttgagtggatatcatttggcactgttgcaattctggcacaattccttgaagagtgacagattttccctgccaacagataaccaaggacttttgtacccaatctactgacattggactgcactgcattaaccaatccattccaagaattgcatcataattggttaaggccagaatcttaaaggtggtgtagaatacatgcccttgagtcgtccaaacacaatcaggtaactcagctgtacaagacaaaacagctccattggccatctttacctgtgttgtagcaagaactaactgtacccctgacaactgatctgccaccttggaactgagaaaactagttgtgctgcctgaatccaccagtattagtacctccttaccctagatataacccgaaatcctcattgaacccacatgttctgccccttgtattgcctgaactgatacaaccattaccacttgttcttcagacgtaatcaattcagccgattcagaaaaggaactctctccaattgcatctaaaacagagaataattcctgaactgcgtatagctggacaagagtttgcgcatctatgagtcggagaccacttttcagcacaaatgtaacataacccctgagctcgcctttgcgcctttagagcaaccatcttgttagaacccccaactggccgaccaccatcaattccctttttgtcatcgacctttccaactgcagatagaactcctttgcctggtggtagaggaagtggcaaagccccttttaatactgaattagagcgaatgtgcattcctcctttagagtccttcacaccagactccggtggagcttccagcacttcctcctgcaaagacacaatagccagagcagactccaaatcgtggagacgttgtaacaatactgcatttctaatctctcgacgcaatccttcagtaaagcgatgcactagatactttttgctaatgacaggatcataggacaacaattggttcatcaactcatcaaatttctcatagtattcccaaactgttctcgactgtctaattgtatccatttgcctaatcaacacatcatgctgatccctatcaaacttagtggaaactgctatgcaaaaatcatcccaaacaggaaaccgcacatgagccctagacgaacgtaaccaggatgctgctcttccatagaaatagatggtggctacacgaacccacaaccctggataagtattgttcacatcaaaatagtgctcgcatctcatcctccaatcctgagggtccgtaccatcgaattttgggaaatctagtttaggaactctatgattatactgtctaccgccttgttcaaaaccaaactccccaacctctgaatcagatttgaaattctccaacgaatgcaaaggaactgaaggagattcaaacgtacccttgtccggagttgggatcagagtggttaccactccagatgccctcctccggaaattctgttgagcgccgtggccatgggcccaattgcttccgccttccgccgcgacttgatgtgaagaggtcgtcggcgtaggcagcaacagcgccttcctttcctcgtccgtcgacggaacccgaggggaaagcgtcgtcggtgaagcttgcttcggtttgccgaggagatccagctgttgacgaagtttgccaacctcgtcgtgcaaatcctgaatcgccgattccacttgaggccgccatcctccgactcctgcatccagcttcgccacggttgctgcgtctccgcttgcttgtcgttcaacgacttcagcgaatcctggatgtcgccgagaattttgccgaagtcgaggttctgcttctccatggcctcaacctgcgattgcaaatgggacgtgtaccttggcttctccaggatcgatgctctgataccaaatgtcacgaactcagatttgagtcacaacgaactttctcctgtgactcgaattggaagggaaaagaagctggcttgaggaagaagaagaacagagacacgagaagcagaggagcaggagggagattggaattgagtttgaggtttcagtttgaatacaatatttcatatcccgctctctcgcacctgccaactatatagcaatgctccatctagtctctctcactgacagtggcccagcctttcgctactgggtccactcactcaacgggaagcgtgtgttgggccgcttcatccttttggttcgatcttgctgctgggccgctgttgccgtctcaggttgaatgccttgctcagatgccgccgtgacacaaaggaaacatggaaaaacaaagctatcatcttgcaacactgcaacttgaaaatagctaggaaaaggaatagcagatacaactcacccagtatcagattgcagcaacactgcaacagaaaactgcataaggttcaccaggccaaatctgcaacagaaatttgctcggctcattaatcctattaaaaaaagcatacaaaagccctagaaatggagaatcttatgtgcaacatatcatatacgatgaacttaggcataggctgttgcagatatacaaactccatgataacaagcataaacaatattttgaaccaaatcaaccagtgactgatcgactgctatacattaacaacgacttttgtttaagttgcatgaacgatatgttgaggtgatgtgaggtcattgatcgatctcgcagttgtgcatcgtgaaccaaaggtactatctccatgtttatgactagtacatctgtacgcgcagagtaattgcaatacaatccatcatccatggcatggttgcatgaattttaaagagtcatacaaaccctatatagaggcagattgaatgccctaaaatgtcacagtttatcagctcatctcatcccgggtagcaaattcagaagtcctcaccacctattcatatgcaaaattgatggcagacagtgaaaattcatacccggcgctgcaagcatgaactctacatgcatgatgcagcaagagagcgaaatcccagaaaaaaaaaacgcaccagagagcaatacaacgcatgcagtcagcagtctcgtctacacaattcaaaatccggccctgtttattttgtactactaccgatcgggcacggatcagcacaaatcgtagcgattccacgcccaaattggaggtccaaaccctaacacccagagatttaggaaattgccccccaaattcaaaacaaagtctctatgtataatcccaagctgcaaccatcaaaccatgaacaaacccaaaatgtacctaagcgatcaggccaaccaggccaggggccagtgcctctccgatccgcgcgtcgtcaggtacagccggagcccggaggacatcacgccgcggcggcgccttctccctcgcgagataattttttttttaagacttttgtctcgggaagaaacttctagaggtttctagaagatactggagttggagaggtggggggcgatctggctgttgaggaaggcaggaaagccatctgtttttttttttcctttcacttccttcctgggctttatttacaactatcggcttcgtgaggcccaagggggaagaagaagctttcaaatatgggccggaatctggcaaggccctggcccaacaaagagagcagagtccaatacagaaccagccgattcgcctcctcctgcacaagctgaagctgcaacgcaaccgccgcctccgccgctggcgcgctggtcggcggcgatggcgggcggcgctggggggccggaggatcttgggaagccggagctctctcccctgaggctgtagcccgttgctgtagccgcggtagtgctgtagtggggaattggagggggggcaaaagggagatcgtgctgggatgggggcgagcctgcacgcgtcgtgcttctcgcggcgcaggagcccgaagacgagggcgaggtcgtcggagagtgcgaggctgccatggccggcgtccttgcgaggttaagcgcctgcccctctaggcctctaacttcgcatcctctttcttcctccctatgttgcagaatcctcttacgaaaatgttggtgggtgttccaggaaatatcaacaggaacattctttgcagatggagatggaattggtaaaaccttctttactattcagaatgttttcctgttagcactggcttgagcattcttacatatctatgttctgttctgttacatcttatataggtgaagtttgatagtttgacactttattcgttgccattttgatcatttgtattgtagtgtacatgcaggtgataattggggatgcatttttatgtcggaatggaagaattgagtagttgtttgcaaccttcagtacaatctactggtgagtagtttgtcttgtttgagtctgacagtccgtacgagactatgtcaagatcaataaaagcatgcaatctattcatatgcataattagctagatgactttgtacctttgcaggtaatttgtttcattacagatgatgcagttttgggactgatgatgaatgataagttagctagctagcaaacattagaagctaattttaaagttgctgaacttccgtagtaactaaactctgaaatacactatctaaagtatgtgacactgcctgataaaatgttaaggaagtgtaagcatttcttgatacaaatgctctctcttatttgctgatgatctaatctaatatttattttgctccatataattcatgctcatgttagtgaaggtataaattgcgagcactttcaccattaggcattaagtgctttagcctgtgttgctttacttttcctgtgaatattatccacacctgattatttaaatcataccctttttgataagcatggatgtagtctataaattctataagataaagcttaagttcagttttgttctgatagtacagattagataaagatggcatcgattcttatctctgtctatcgttttttctttcctgtctagtatccatcttcaatgtcttttagcaaggaggaacgaagaaaagaaacatattgtatattttaccttttatttttgcttatcttggttctaccatcaatgcttgcactattttgtctttaccaatggaaaagcgaagcactgcacatgtgtaagttaaaggaactcttttggcttacttctgcaatttcttaagtcttaacatgatataatggcttgatattgttgagttgccagttttgtaatagtagtttgagtcatatataagtatgcattcatttttggaaaaaaaaatatggaaagatgagagggtgagaagtgagataggacgtgggatttctcttttgatgaagaatctagcaaagtgaagctgacaagcatagcacagatcaacggtgcttttcctctttgctttgacaaataccaaataaggctaacaccgatggtagcttcaaaacaagaagatcatgtaaattcatccttgttatcaacaaattgcatgcattatcactgagaaaatatctgatgctgtctgccgaattgccaatattgtcaatttggggaattaccctataatacataaaagactttgatatgtaatacttgctgctgatgctaaggttctgagttgaaaactgcaacaagcaaataaaatacattttacttccattttttttctgcatgggttactttgtctcattttgctgtgtggatactaaagtatatctcttgcttgtaacttaagattggttatatagactaggactccaaagcataaagtgatgagttaagataacattaataagagagcttggtacagtcatatcacgtacacatagatgtccacagctgcatcactgaggaagtgttagtgcaatggttagaccaagaagtgcttgaggcaaaatgtgcaaacaattttgtgtatatcaggaatcgagtattcccaacctttggcacatacatgctcttgatattttacatgaaactcatatgatagcttcttttttacagaagaataagttgaaactaaaaaaaaccttccagtgattaccttcatggtgtatacaagctattgcctgaaaattttggttgatcctaactctcttcaatgtttttttctcttttggggcactatctcatctaaaatccctgcgattcaagtacctctctcaggcattcgatccttcgccatttgcgtgctcatctaactatatacagacacaaactcacagccctttagtccactggtggtatatgtatttgacaccaaaatgttgttagttctcattatcgaccaaatttaggaaatgtgatttttatcatttatatttaatcatctcaaggggtactttgaatgactacttaagtaatttttttgttattacacattgatgagacatcaaactatgctgacttggataccagagtggcagttggactgctataggcaaattgaaattagcatgcagctctggggaggaaacatcactcacggtttatgtaatgccttaagatcacacattgacttatttttgtgccagaattgaatatgaaatgcagctgtcttggacacctgagtgggctttgaggttgtatatgtcaatactgcatgaaagaaacatgcagatttgtggacaaaggagcactcatggtttttataatgcttcaagataacaagtttaacttatttcgtgttagaattgcttttttttgtcggctaaataggtgctttaccagtaggattggtgttgatggcccaagcagctctaaggcgacaagtcagcccccaattcgctagctagctggttctggcgcacacaaagtggaggggatcaaaacaggcaatagccaataaataatttgtttgtgagtgctctaagaatatgtagctgctccatttgctttgtgtttaagcttaaatgattcatctttcagtacttggtgcagtctccttgttcctacagttatatagttgaacttcaagttgcagaatctacataatttatatcaagtttgcaattgattccctttggatctgttaattttaatgatgaaatttgatgataaatccagtaaatttaaattgacaaacttatctgggattttttttctgcatttaggggtactgtttccataaattaacaagaaagggcaccaacgttattttgttttttcgccgggaaggccgaaggaggccatccgagtatattaaaaaggaataaagttacaagaaaaaactcgacagaggctgtcgaggtcggaggtgcatcgaaatgcacaaccaaagccacatgctaatcacacaagcacaacccactgagagaaaaacctagcaccgagacgacccccgctatgcgtggccgatcgccgccgggccaacgacaacaccacaaagacgggactctaaaagtgatgcccctaaggaggtcacgacatcaaggatgccgccatcgcccatctaaggagatgtggttttcacctagagaaaactcgccaagggagaaaggtatccttgccagcgccctcaagggggttacgacgcccaaaagcgtagccgctgccagcccgatgaatcatcaggcgaggctttcacccggaaacccttcaaccttgcttgaggttcgtcgcccatcaactcaggaaccacctcacaagcagatcagcacgaggcctccaccacactgcgccggcgcccctccacctgccgaccaccacacttgctgcatagagctgccgccaccctaggaactggcccagacttcctccgtcctgccacccgtcgacctccttgccagctttagccgaaggataacccggaattggacggcgtcgtgtcggcggtctgagctcccctcgctaaccggctgccgcctcaatccaacatagaaactccccacagagaaggggaggagctccaggaagggcgagggtgcaggctggcagcgaggaagacgacccactgccgccagctcccttagcactgccatcactcccttcactccctgcctcagggcctacgagccgccatgcccaccccaacgccaccaccgctgcaccagaaggccagaccgccgccgtccgaccgcccatgctgcgccgcgccgaccacgggccacgatctggccgcgccctccgggaggaccgccgccgccgccgccatccatccgcccaggccgccgcccggatgcagttggccccgccctccatgagggctgtcgccgctgcgccaatccccggccgccgccccgtgctggaccacggtgtcccacggccacccgcgccgagccgcgacacgcgcgccgcctctgagccccggccgtcacgccggggataggtgtaacaccctgaaaattcgacgacaaaaatctaaactctaaaaatgcggattttcaaaaactttttaaataaattgcatcatgccgattttattcgattattttattggagtttgggttcggagtttataaatcgcgaataatggataattggttaggaataaaccctaaaaagtaaatggacaaagtaagtaattaaagtgcaacttaaaataagatttggtgaggatagaaatgagtaaaatattattacgaccatatttatatccatcaaatttaaaagcaatggaatgagaattaactctaattaagttcaagtaaattacaataataatatataaaacatggaataaattaatctagaatgaatccatggattggaatggcacaaatattgagtatacttcatttatgcaaaatttgggaattaaagaatcaaatttaaataataaatgggccaaaatcgggttaattagaaaacggcactgttcattgcacctaaagtgttcgacgaggtcccctagccctagcccctcctttgccgcgttgccctcgcgccccgcgcgccgcacgccgctccacctcccctctgccgacgccgtcgccatcaccgcgcctggccgcccctaaccccgcgccgccgtcgccgtcgtttccgtcgcgtcgccgcgccgccgtccatcgccttgcgccgcgcaccgccgctaccgccgtgccgttgcgcgtcgctcgccgccatcccgtcgcgccgtcccatcgcgccgcgcgccgtcacgtcgccactgccgagccgtcgccgtcgtcgcctcgcgccccgtgccgcgccgctcccccgagccccgtgccgccgctactaccgcgccgcgccgcccgttccatcgtcgcgcgccgtcgccgttcggccgtcgcgtcgccgctgccgcgccatcgccatcgcacgtcgcatcacctgccgcgccgcgcccccgagccccgtgccgccgctgctgccgcgccgctgccgctcctcgcgccccgcgccctgccgcgccgcgtcgtcgtcacatcgccgcgtcgagccccgcgccgcgccaccccgacgacgccatgaggccgccgcccctctcccctcttccccattatctctctcccccctcccttatataagcccccctactcccactcttccccttcatcctcacctcctctcctgtacccacgccaccacgccgccgcgccgtcgcatagagccgccgcgccgccgccacgaagccgccgcgccgcgctgcaccttgcgccgacgtcaccaccgtcgccgtcgccgccgtcgccgccaccgccgtcggtaagccgctgcctccaccacttgctcggccgccgtcgccgccccgggtagcagagagccgagagagagagagagagagagagggagaaaccgagggagagaaagaagaaggaaggatgagagaaaccgggagggagagggagaaggaaaaagaaaagaaaagggagagagagaaggaaaaagaaaagaaaagagagagagagaaagaaaagaaaaagaaaaagaaaggaaggaaaaagaaaaagaagggaagaaaaagaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgatttacggtagaaattcggatttaatcactaggaattttagacgtatattatatttagtcgtttagtcctagactaaaatttaattgtataatattataagataattttaggattccgtccgatatttagcttgcgatagaaatttccaacctattatatggatataatgctcgggtagattaaattaaaaacttatgataacaaaatatttatacccgcaaaatagtttaggatataaaaatcgaaattgggtttgccctagttcgcgaatagtaaagttaatataaaagaatcgacttaagcgttcgacttccatttggatttatttggatttttatttgaattctaaccgaattcaaatcaattttcacacgtaactatagagcccgagggagttgcggatccaagtgaaggccaagacccgcaagactttgagcaaggcaagtcatcactatttctttaacatgttgatcccaattgtaaaattgttttgtttacaaataaaattgcatgcaatgatgaacatcctacttgtgattatgccatgccttgattattgtttgccccttattccttcgtaaccatgtttacgtatgagtccctagtcaattatgacaattgcttagaaatgctattctagaatcatgcatactcatatttatcaaatgatgcttgggcaattacttttgggaaggtaattgagatgcggcatgtggagacatgagcgccacattgccatgatgttgatgacatgatttgtgaaaggagaaataaaattaaacaattgttttcgactggggtggacgaaggatttgggtggtatctgggaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccgagaggcgtgccctacatcggtgtcgccattggtaggactgccatgagtgtgtgtgagagagaacttaacttgaaccataatttaatatgtgtgagacttctcttttccgggagcgccagaactcctcacactgctagaaacatggacacctagagtgcatgaggatttaagttcatggagcggatactgccaatgcgaggttatcgaaaagctttgccgtgacgcgtctcatgtgttgggacgaggctcatgtgttgagcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaatatggacgtcctcagaaaaccataacgactcaatggcgggaagctatccttgggatcacaatggatggtggacagaaccatcattatttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttggtactcacccttgcaaatataatcagaagcgggagatgaagcttcggaggatccctatgcctactactaggagggagatgaagacgatggcgctcagtaggtcttagttacggtcgttgcctgtggcaatggcgtgccactgccttaactccactgccttacctacttctgtttttggaatgtattccggaccgctcggtccgatgatttaagactgtgcctgcgggcttatgatgtaataattcgtactagactctcgtgtatgtgcacttgatatttcagctatgagttcgtgtgtaccagactacttgatccagggaaatggtactgtttacacgattgattcctgttataaaaacgggggtccacaatagggcggccagatccggccaccgccggatccgcccgccgtccgccaggccgcgccgcgccgccaccccgcgctggcccgcgacgccccgcggccgaccgcgcgctgccggcgagccctggccgtcgcgcctcccgatccggacgtggggcggccaaatccggccaaagaagtgccagatccgccgccaccccaagctgccccgccgtcgtcgcctctggtcgtggtggtagacgtcgtcagcccaactccgtcctcctcgcaccaaggaaagggttgctgcagtggaaggcctcgccgccgccttcccggctcgccgttgacgagctccggcggcggcgaggtgaagggagaggaggggggtggcggcgcgggcggctagggtttcgccccccgagccgcccgcgcgagagcgacgcgggggagagaggaagagctcatctgtttccaacgttattttgttgctgggctggccaaagattaggccgactaaatttctttaagattaagagtttgtacaactgtacaagtgttaaatatttcgacaagaagctgttgaaattgaatggagtttgccgagaggcaccctcccaaaagcaaaagagattacacctctgttgttataacgttatgcatgaaggtattcctgtttctcctttgcatatatagttaactagtttattcacttcctttcttcaaagtagacaagattgtactaagaaggagcaaggggagtcacatagtttctcctttgtgcctttgtctatattttgtgtgttacatggaattgtgtttgactaggtccagctaagtcacgcaccaactattaaaggtcaaatttgtaggtccttgccagaatgtttacagtcgtccatgatgacctttgagctgtcttatttctgaaacacacaaatccatgttccagcttaatctctattcttgcgtatgttctttatagtattattaggcagacaatagatggtgctgcttgtggccccccgatccccagaaaacccactgagatgcagcccacttgccacaagcaaagaagcttccaattgtgcaccttctggcctttgccaaaagcatttgtctcaactggttgtcaggaccaatgggatagcccgtcgtactaaaccaaataaataaatgaaaccatattatttgttgtgtcgaagagtctataaatacttcatcacaaaccagcttatggttctatcttaggaagaacagggcagacccacgcaacaaggtgagcccaagatcttcagttgcaggattccgaagaaggcttttgtccatacaccaagggtagagatgtactcaagaaggatactgctgcacaccccattctctgggcaaccctctggccctagtcagccggtgtctggagccaccatcgttgaaggtggttctcccgggagcaactttgatgcaaacatcgtcatgatcctagctgttcttctctgtgcactgatctgtgcgcttgggctcaactcaattgtccggtgcgcgctaaggtgttcaagccggatggtggtggatcctgagccgagtcgggtcacgcggctggctcagagcgggctgaggaggaaggccctccgatccatgcctatccttctctactcaactgggttgaagctcaatactgtgagtcctatgtgtgcaatctgcctctccgactttgaggacggggagcatgtcagggtcctcccaaagtgcaaccatgggttccatgtcagatgcattgaccggtggctcttggcgcggtcgacgtgcccaacatgccggcagtccctgtttggggcaccacagaaggcctctggctgctccgagtccgagggaagccaggccgagccagcgccagctcgccctgtgctggcgccacttagacctgaaggtttggttactccatatgatttttagagccttccattgcttctagttgttgcatcaagcataagggagtgtggtgaaatagaactaggttgtgaacgtgtgatttttaggtgttactgccaaactggcttgtactgctgtacattgtgtggtagatctgtagtaaaaaaaaattgctgtacagattgatttggaattctattagtgtgttaatacctgatgttgctcgagaatgaggcgtggatagaaaaaaaaaggtgctattggcttctgtgaatcacattttctatgccattttgtagggaagaaataggagtgaagatttcagatctaatcatatggcagtgctgcaccaacaatcaaccattatgttggttggaaatcaagcattagttgctaaggttcaagtcagtgggacaagcatattctcctgcaattatcgagagatcagggctttgttatctgaatgcattgtggtcatctatgtcccagaattgacaggtgggtccacggccgactatgccctgtgcactttggctattttgtgctgtctgctccaaaagcttgaaaggtaagtggccaatccacacacaatcttttctgcagcttcctggaaagctaatgcctttaaagaatctgctagcttagcaactgtgtggttcatatgaatttgaaagaaaaataacaaggagatcacttaactgtgcacactgaaaacgaaaactgcttggatgcccactgaatgggaagataaactctttttctgaacttgcagtggttatgagaatgttgtagcagtgttacatatagcttgataacagtttcactatacacaagggcccactcagaatatatgttatgtgataatgttgtcgcaatgttacatactccttccgtcttataatataagagattttgaaaggatatgacacattctactactacgaatctgaacaggatatgtcatatccttccaaaatcccttatattatgggatggagagagtactaatttggtaacagtttcactatacttaagggcccactagaagatatgctatgatgagaatgttgtagcagtgagtagaatttgataatagttattttatttgttctaaggccccaccaagaagatacgttacgagtatttgaaaaggatgttagcactgttgttgccccttacaagaaaggagggccaatggttgatagagttcatctgaatgccttttttttttggaacgatatcatccgaatccgattgcttttaagaacagtttgtagcgtatgaagtctgaactactcatgttgaagctggcaatgatattgtctgccaattttgcgaacactaataatcaaaatcttcttcagccttgtatttgacatagacatgtttttcttttggatatatcaaaacgaaggaaaatactgttatcaactattcaaagaaaattacgagtcctttgtgtactttggggaaggaaagaaaatagaggtctacgaaacaactattttcttctatattttctatataccaatttccacgcaatggattcttccttcaataaagaagttatgaaagcgacattttttttctgcaatgaaattaagaataatcttataatagtcagtatgaattacaattcaatgcgtctgacctttgacattttagatctcaaatcaaccaccatcaaatataaaaaagttatgaaaatgacatatttcctacagtgaaattaagttgagatgccactagtgataagaggtgtgtggtttcaactctgaagtcatgtgttcaatccctaagttttttttcttaaaaattgtttgaagggacatctctcccttcaaatctagtttttttaacagtgaaattaagaagtcttacaatattcagcatgaatcacaatcttaaatgcttctgatcttcgacatttagatctcaaatcaaccaccatttctcgggcggagctagagtgagatggagggggtgccacttgtttaatttactctgttttatatcaagtttaagctaatgcgggtgtctaatttatagtgaaaatatgccagataaagctatattttttttgaccgggttccttggcaccctccttaatactctagctccacccctgatttctcccactataacaagatatcatatttcttcgagaggcgttgcctatcattaacccaaaatggagccgcaaaggggatgataagcctagtccacaagtggcaagttaaagggaatatggccattggggggggggggggggggcatatcatgtactagtaaagctatatgatctccatctatctggttgatatgactgcagcatcatcttgcaacctcaaatgctctctcagtggggagggttcatttcagcccctgattcctttgaaagcccctcggactgattgaccaagcataaggtgaaaacacagcagggggggatcatccaatgagcggctgcgtgactcttgttcgttcgggtgggtgtagttggagtatgatacggcagccgcgacggaggccaaaccttagcggaaaagcatgatgagcacgccggtcacctctcaattatcatcgctgatcacctcttataagatcctttccggagctttgacgcctgatgtccgttgctccacgccttgacatggttcaccacagcttttgaacaatgtgaataattcctgtgtctcataaagagtgcacttttcagtttttatacgacgtttgactcttcatcttatttattttttattactatttttattgttattagatgataaaacatgaaaaatactttatacgctactttttttcttaatttttttttcataaatttttcaaataagatggacggtcaaacgttggaaataaaaacccaaaaatgcgttcttgcagatggactgatgtgcgtgatcttgcagatgaagctacaagggcagtagagtgtacatggtttgtaccacacttaggccctgtttagttcgcaggacgaaaagttttggcgtgtcacatcggatatacggacacatatttgaagtattaaacatagactaataacaaaacaaattacagattccgtctgtaaactgcgagacgaatttattaagcctaattaatccgttattagcaaatgttactgtagcaccacattgtcaaatcatgaagcaattaggcttaaaagattcgtctcgcaattttacacgtaatctacgtgattagttttttttttctatatttaatactccatgcatgtgttcaaacattcgatgtgacagtgtgaaaagtttttgcgtgggacctaaacagagccttaggttgtgttagtttgtgttggttgggaacatatccctccgccacggaaaatgaaatagctcattagcgcatgactcattaactattaactaaaactaacttgaatggattaacatgatttttaaagcaacctatatattttttttaaacacacaccgtttaacagtttgaaaagcgtacacagcctttatgtatggaatgaaacccatctgtgcatcttttcctattattccgttgcaaccgatataattgtataaagttatagaatatgcgttaaatatacaacatgaaaaaaaattgcacaatctcttatgcggaactatggccacgttgattatggattttagaatttcgtttgcacacttcccaagttcttaaacaatatatttcatgcaaaagaacattctacataaattttttttggagtgcttttcaacaataacgtttcaatatttctttcgtttataccattaaatagcaatacaaaaattaaattatccatcaacttacaactatctcaaaccgggcatatgaaccctatgactaatgtgatttggtcccaaagtttgccctcctagtcgtttggtggcttcaattgaattgacatgtaaccttatcctatcaaaacttacggatttgaccctaccaacaatcttacaggcatcttcatcgtttgttcttcagcttatcaactccgactaaaaactattctaagttgatattgttgtttttcttcgtagcttattttccagcgttgccatttaagtattaaaaaccatatacaaaaatctttatgcacagattaatcttaaatggtttataagaattacagcttatcatcagttgcaaaccggtggtactgcttgagaaaaccaaagtctcttaatcctgtgcagaatgagtgtgttcacaagca

SEQ ID NO: 56484 - DNA, 11106 bp, Oryza sativa
ccgccgaggcctacctcgtcggcctcttcgaggacaccaacctctgcgccatccacgccaagcgcgtcaccatcatgcccaaggacatccagctcgcccgccgcatcaggggcgagagggcttgatgccgttattgttcgagttcatggcttgttagatctagaagtgttaattaacccatggatctgtgttatcctgtaatcactcgcttgaattgggttcgcattgatggaatacaatctgttcttggcaaactgtgggatttgtttgtctgtttcgtgggttgtttgatgctagtatctgaagatggtagctaggcaatacgtttctgtcagtctgcatgtcgatgggtatgcggatgatttgggaatcaaccaccctatatttcattttatttgtaggcttgcagtggagccatgaaatttcatgtgtttggtaatttttctctttgattgtcagatattgcaattttttttttcagattttccttttgaagtaaaacactatacgaaagaatcctacagtgtcatattaataaatatataatatttacaaagtacaatttacaccaaaggtgattacaagttctctagccattgtttaacttttgggaaataagattgtttcgccctttggataaccacggcaaattcttgtcttaaagagaaactgatctgaagaagagaatttatgtttctgaagattctattgttcctccagatccagatactccatgccattgttatgactatctccatatactcaattttttcagattgaatgcagaaaaaggaaaatgctttatactaccagtgtgttttgggtcaattcgatcgacacattcactgttaccaaatctgatactaactgataagcactgaggactgatatgttatgggcttttggatcaattcttgggcttgttcttccgcgaagggccaactggccatgtctgaactcacaatccaaaaggaagacaattattaggagtatcaattatcataaccatccaaaaaaagatcatacgagggaagacttgcagaaggtttcagagcaatgatcactgtccgtcaccaactacccttcatcaaattgtttcataaaaacaaagactagcagtggactggtaccaggttacagctttgggattgtcggcaaagccagttcatacttcgccatgcggctccgaccatgtactgcaatcacacaaacagcgagaaaaaagaatatgagcattaaacaaaggctaatgcaggtgtgagcctgcgccccacaattgctttcatctgcacgactgactttaatttccctccagtaatcaaatcagtgggaatatttacaaccagtactccatatctatctatacacgtacagtagttgatgaactaagatgaccatatataggttcagtcctagttcatgctcacactctctgctctgttgagttacccaatttgaatagagtaaacttatctctacagtaaaggattcagatatctcaaactgtagatgtaaaaacaaaatgatttgaagaactaagaatgaagaaacttttaagaggcacaggggtatggcctcctgaggctctaaaaggttcaggcaaggaccatgtgaagttacaaccgatgccacattttctagtaggcagtcaggatccctggaccagcattccattcattgcactcatgaccaatcggcaatcgccatgcgagtccggggtaaatgattgatcaatattccagcacaagaataatatttgtcggattctcgatcacctttgctctagacaacaacttcatccctttcccaatgaaaaaaaaagaagaagatcactgtacactagacaacaaaaatatgtcatgccttttccaataaaaaaagaacccatgccatcctgctcaattccctgataacatttgctacccctttttctcatgtgctcctcaccatttcctaacacctatttaagtgccccaagtggcaagaaacttaagtatccattccaacattgtggcagctccctctgaaatcccctcttccaatcatatccaccagctcacagtttgtgatccactatgactatcctccttgtcattcttgggcttcatctctgcagcctacacctccctgcaatctctgctgcagcagacacgctctctcccggccaatcgatcgccggcgacgacaggctcgtctccagcaacggcaagttcgcgctcggcttcttcaacaccggcagtaagtcctctggaaatgacactctcagctactggtacctaggcatatggttcaacaaagtcccaaacaaaacccatgtttggatagcaaacaggggtagcccggtcacagatgcaacctcatcacatctcacaatctcccccgatggcaacctcgccatcgtaagccgagccgatagctccatcgtttggtctagccaagccaacatcacaagcaacaacaccgttgccgtgctcttggacaccggaaaccttgtactacaaagctcctcaaactcatcacacattttgtgggagagtttcgaccatccgaccgatgttttcctccccagtgcgaagattggtctcaacaagatcaccggcctaaaccgccgtatcttttcgagaagggatctagtagaccaatccccaagtgtgtactctatggagtttggacccaagggtggttaccagttggtatggaactcatcggtagaatactggtctagcggcgaatggaacggccggtacttcagcaggataccggagatggtagtcaagtcaccccattataccccattcattttccaaatcgaatatgtgaacaatgatcaagaggtgtacttcacataccgcatacacgatgaaaccataccactgtacaccgtgctagaagtaactgggcaaagaaaggccttggcctggttaaatgacacacagggttggcaagcagtcttcacccatccaaatgatcagtgtgaagttgctgctacctgtgggcctttcacaatctgcaatgacaacacatttccatcttgtagctgcatggaaggcttctccatagaatcacctgacagctgggaactaggagacagaacaggtgggtgcaggaggaacattccattagattgtgttagcagcagaagtgacatcttcaacgctgtaccggccactagattgccctacaatgcccatgccgtagaatccgtcacgactgcgggcgaatgcgagagtatttgccttggcaagtgctcttgcacggcatattcatttggtaattacaatggttgctccatatggcatggtaaattggttaatgtgaaacaacaaactgatgacagcacctctgctaatggagaaacacttcacattcgccttgctgctagagagcttcaagctagaaaaagcaataaagggttagttgtaggggttgttgtatctgcaagcctctctgctttgggtatcttaacacttgtcttgctactgatcatgatcaggaggcacagaaagaagttgcactgtcaagcattgaacagcatttatgctggtactggagttataccattcagatatagtgatttgcaacgtgcaactaaaaatttttcggagcaaattggggcaggtggttttggttctgtgttcaaggggttgttaaacgggtcaaccgctatagcagtgaaaaggcttgtctcctattgtcaagtggagaagcaattcagggctgaggtgagttccattggagtcattcatcacaccaatttggtcaaactgattggtttctcttgcaagggtgatgagaggttgcttgtttacgaatacatgtcgaatggctcccttgatactcatttattcagaagcaataacagtgtaaccctgaattggagtactagatatcagatagctcttggagttgctcgaggactggcttacttgcacgagagttgtcgagattgcatcatacattgcgatatcaagccacaaaacatacttctcgatgatttgttcgttccaaaaattgctgactttggaatggcaaagcttctaggaagggattttagtcgggttatgactacagcaagaggaactattggatatctagcacctgaatggtttagcggagtggctgtcacgccaaaagttgatgtgtatgcttatggaatggtactcttggaaattatatctggaaagatgaactcgcatagagagtctaatagttatgctgatcacatcgtttgtttccctcttgaagttgcacataagcttcttgagggggatgttctaagcttggttgatggcaaattaaatggcgatgtcaatgtcgaggaggctgaaagagcttgcaagcttgcatgttggtgcattcaagagaatgaacttgaccggccgacaatgggtaaggtggtccaaattcttgaaggtctactcgaacttgatttgcccccgatgccaaggctacttcagtctatagtacagagctcatggaaaacagagacccaacactgatttgtaatgccaaaagaagtgctaggataaaataatgtctttccatggcttttttgtggcatatgttggtatgaagagagttttagcttgtaatgccttgtgtgctatgttgatgattttggacatgttgtgccataagatgttatatgctccgtttataaacacgcagttacaagtgtacacaatttgctttatttgttttgctatatataatgatgcgcatgaatgatgtgaaatatttttcggtcgacccggcaaataaatgatgtgaaatacatatttactctaggcctctagcttaataaaaaatattccgcagcaaacacagagccataagccttatcagccttgcatggagacaatgctagtttcagggacctttcagaattctggtattgtactaggaaatattactctcttgagtcataaatatactctgtttgtactaggaaactttcagagcatgtcatttgattttttttagcttttctcaagaaagaatgttgtaggttttaaaaatactactttgaccacaattttatactccctccgacccaaaataagtgcagttttacactattcatgaccaatatttgaccgttcgtcttatttgaaaattttaaatgagtattattttttttattattagatgataaaacatgaatagtactttatgtgtgactaattttttttattttttttcataattttcaaataagacggacagtgatcaaacgtttggacacagatattcacggctgtacttatttgggacggatgtagtaccatattacaaaagtttgtaattaaaatattgcaagtttatagtataatcttctaaggtaaatctacctataacattttttatgtttttaaactaagcactttttaaaaataaaagtttgcaatgttgatctaatcaatgataggcgatgtacccgtcgacaacaacaaggtgcccgtgatgacttcgtcaatctcagatatgctggcttagtttttcggagatacacatagagatagagtgtgcatgtatacgtttataggaggtgagtgtgtgtatgttgcgagcgtctgacgtttgtattgtgtttctcagaaaaaaaaaatatgccagctaaccaaaacactctaccgcgtaaaaattagagtgcatgtggctgccgttctccccggtcttgtagcgttcatgtgttccatgctttccatgatcgatacatcgattcaaactaagctagttagagatggtacggtttttgtcacgccctgaagttcccctcccttgctctaaattcataaaataaatcgtccgaagaaattgtttaatttaacctagagagaaaccctaaagtaataaatgcaaataataatcggaatcggcatgtggaatttttcttgggttctacatgtcaaaatacgctaacaggatttttagtggaattttcagagccttggaaataattttaaccaattaaaataagcaaagtgcaatattaaatccctgggaaaatccttttttcctttttatctttcctttttccccctctttttcctcctttgggccgccggcccatctctcccgccccctcccgaagtccaggtcgcctccccctcactccctcgggcgctgacaggtggggcccacctgtcagccctttccctaacctccggcagccgccaccatccgccgccgaaaccgccgcccacgccgccgcttcctccgccttccgcgtcccgggccacgtcgcccactttccccgcgcgccccgccctccccgcgcccacgccccactcccgctcaccccccgcgcccgcgagatggccgggattcaaatttgaatcccgcctctctctctctcctcctccacctcctccactactccggcgaaattgcgccgttcccggccacgactcgccgccccctctccccttatttaagcatcgccggcaccccctctctctttttccccatttcgccgacccctcccgtgctccccatcgtccccgcgccgtgcaaccacccaccgccgcttcttcccgctactccggccgccgctagccgtcgctaggctcgccgccgtcttgcgccgtcgccgccgttcgattcgcgtggccgagatccaccccgtccacccctcctccgtcgaagttcgtcgccggagccctcatcccctcgcgcacgggtgagcaccacctccaccgccgccgtcggccatggtttccgatcgccgtggtccatctccctctctctaacccctcccaaccttttctctaggtcctcccggagcccgtcgccgtcgtcctcccgtctctcatcgttgctgttcgccgtcgctcctccctcgcgccggccgagcccctcggtgaggatcggtctccctctcttcctctctctccctttgccgcgccgcccgccgcgtagcgtcgccgctagggtcgctcgcgccgccgcttcggccgccgccgccgtctttgcgccgtctgccgccgcctcccgtcgccggttgccgtcgctggcaaccgtgcgcgcgcgccgccgccctcgccataaccggccggccggcttgaagccgagccgagccaggccgccttcctcctttccccgtgaaccgccgcccggtgggccccgcttgccagccgcgcccctcccgccttgtgccactgcccggtgggtcccgcctgccagccgcccctctccctctcttagtgtcactgacccgtgggtcccgcatgtcggcgccgccccaccccttggatgacgtcagccctggggcaatattgcgcaataaattgattaagggtttttctttattagtaaaaacacagataatcttctaaaaatcataactaattcatccgagctccgattaagtccattcaagtctcagtaaattcataaaaatgtgtagaatccattaaaaatggctttgttatctgtttcagtagtcttatagcatgttttgcttgtgtgctttgtttgtcgcgtagatttcggccgtttcgtcgatccgtggtttctcgaagacgttgctgtggttccatcagtgcgagagcaaggcaagtcatacattgcaattgatcatattgtacctaatttacaaatgtcccgcatttctattaaatattgcattgttttaccatatcatgtgggatgggtcctattactcagctatatgttgtttcccttatgccattgataacttgggtattaaaatgactagatgttggtttaggagatgcttagccatgcttagttcaactagtgcacaaaaggggacaacattaaagcatagacttgattattggcaatagctttggattagtgccaccgcaatggtgttggctaattaaaatacattacctggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccactgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaaacctaagagccctctgaatccttttcattgcatatattctttgcaattggatttgtttcgggaaaaatttggggttttgcctctttggtttgtgggaaaaatcttggtcgttcattcggatcggatccttaaaattagctcggtctagggttttagaaaaattttatttggagttatatttgatagtcagttgggaatttatcgggtgatatgcattaggtcgtgtctatgttcgatggggcaattttatgcgcatcattttccatgcaactagtttatgcattaagctatggtttagtcagtcgcattagtgtctttatccgggttcatgaaaaatgttctatgcataaaaatcatcatgctcggcaagttacttgagtcatttgttgctttatttaatttggttttgagcatgtgttggttcctatccctctgtactctttagatgtcagacctattctccgatcgcaagcgccgctccaagcttcagagtcgccgcccttagctttatcgtcttcttagtctgtttgcgtgctagtttttgtgtttaggtttgttgcttgtgggttagtcggcggtcgatatcatgtgtgagtggtatgacagcctttattaggagttgtgtgcctctttttcagtgttttaatcaagattaagataatggcacttaatcttataagaaagattagtttccgagccgtctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacttgcatgagttcaaccgccttgcgcgctacgctcccgaggacgtgcgcaccgatgctgagaagcaggagaagtttttgtttgggctcgatgatgaattgaccaaccaactaatctccggagtctatgaggactttgagaagcttgtggacaaggctatccgccaggatgagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgactacaacggtggcagtcacaacaacagtaagcagcacaaccacaactcgactccacccccactaatggcaccagatcagtcagatccgccagctgtgtcagttcagtcagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccttggaaatgatatgaggacagcacactactgcccctcggtgactatagagatcaaaagatcaccgtttctatccaacctcatccttctcgatctaaagactggatgtcat

SEQ ID NO: 56485 - DNA, 3285 bp, Oryza sativa
tcagacagaaacagtggagaaaagtcccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagttagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcatcaatgcaccggctttcttcatgaacttgatgaacaaagtgtttatggagtttcttgacaagtttgtcgtggtattcattgacgacatacttgtgtattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggcagtggacccatcaaatgtggaatcagttacaaagtggaccccaccaaagacagtttctcagatccggagttttcttggacttgcgggttattaccgtcggttcatcgaaaatttctccaagattgccaggcccatgacacagttgctaaagaaagatgaaaaattcaagtggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggtagagtggtcgcatatgcttcgcgacagttgcgcccacacgagaccaattatcccactcatgaccttgagttggcagcagtggttcatgctctgaaaatctggcggcactatcttattggcaaccgctgtgaagtatacactgatcacaagagtctgaagtacatcttcactcagcctgacttgaatctccgacagcgaagatggctggagttaattaaagattatgacatggggatacattatcatcccggcaaagcaaatgtggtagcagatgctttgagcagaaaaagctattgcaatgccttatgcactgaagacatgtgtggcaaattgcaacaagatcttgagcacctaaatttgggcatcgtggaacacgggtacgtagctgccctagaggcacggcctacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgaggagagaaatagctgaattcgtcgcactctgcgatgtttgccaacgggtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggttgctcacttcataccagtacataccacgtatacgggcaaaaggttggcggagctctacctctcgagaatcatgtgtctgcatggggtacctaagaagatagtatctgatcgagggagtcagttcacttcaaagttctggcagaaactgcaagaagaattggggactcgtttgaatttcagcacggcttatcatccgcaaacagatggtcagaccgagcgagtaaatcaaatcttggaagatatgttgagagcctgtgcgcttgactttggcggagcctgggataaaagtctgccttatgcggaattctcttacaacaatagttatcagtccagtttgcaaatggcaccgtttgaagcattgtacggacgaaagtgccgcacaccacttttctgggatcaaacaggtgagcgccaactgtttgggacagaagtgttaaccgaagcagaggagaaagttaggactgtcagagaaaggctaagaattgcgcaatctcgacagaagagttatgctgacaaccgccgaagagagcttactttcgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagcttgagctcccatctaatatggttggtatccacgatgtgtttcatgtatctcaattgaagaagtgtttgagggtacctgaggaacaagctagctcagagcacattgacatccaggaagatctgacttatgtggagaagccgatttgtatcctcgagaccagtgagagaaggaccagaaacaaggtgatcaagttttgcaaagttcagtggagccaccactcggaagaagaagccacctgggaaagagaagatgaattgaaggccgcccatccgcacctcttcgccagctcttctgaatctcggggtcgagattctgtttaaggggggtaggtttgtcacgccctgaagttcccctcccttgctctaaattcataaaataaatcgtccgaagaaattgtttaatttaacctagagagaaaccctaaagtaataaatgcaaataataatcggaatcggcatgtggaatttttcttgggttctacatgtcaaaatacgctaacaggatttttagtggaattttcagagccttggaaataattttaaccaattaaaataagcaaagtgcaatattaaatccctgggaaaatccttttttcctttttatctttcctttttccccctctttttcctcctttgggccg

SEQ ID NO: 56486 - DNA, 3003 bp, Oryza sativa
tgttagtattattttgccacaccaatctaattgacgtgttgaaagtcgaaaccaaagtggccacgctaaaaaaattcagattgtaaattagttttgcgagcccttatttttaaaatttttaattttaaataagttcagaaaacagaaaaaaaagggtacactggacatatttgaacgaggactggttgtagacccccgtttttataacaggaatcattcgtgtaaacagtaccattttcctggatcaaatagtctggtacatacgagttcatagctgaaataccaaatgcttatacacgagagtctagtgctaattattacatcataagcccgcaggtattgtcttaaatcatcggaccaagcggtccggaatacattccaaaagcagagttaggtaaggcagcggaattaaggcagcggcacgccattgccacaggcaacgaccgtaactaagacctactgggcgccatcgtcttcgtcatcctcctggtagtaagcgtaaggatcctccgaagcttcatctccgacctctgattaagtttgtatattgcaagggtgagtaccaaccgtactcagcaagccaccacagcaataatgcacatgacaggggaatccaaaggatggctatggttcttttgcgcaaagcaagttttataattcttttcacaagcctaagacctagcgtagactgatcaagttttaataccagtgttcacattaaacaacgatggttctgtccaccatccattgtaatcccaaggatagcttcccgccattgagtcgtcatgattttctgaggacgtccatattcccgcctctcaggaagtggctccatcagcataaaaatcatcatgcaatatcccatcccacacaagttaagaatttaaagtctagccaagtgtaatacatgttccggtactcattaaccgcgagcacggctattcgaatagatttggtttactcacactgcagtggatgtacactttacccgcactccgcgactgtccaacacgcctcgtcccaacacatgagacgcgtcacggcaaagcttttcgataacctcgcattggcagtacccgctccatgaacttaaatccttatgcactctaggcgtccatgtttctagcagtgagaggagttctgacgctcccgggaaagagaagtctcacacatattaaattatggttcaagttaagttctctctcacacactcatggcagtcctaccaatggcgacaccgatatagggcacgcctctcggccctacctcaacggttgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatcctccgtccgccccagtcgaaaaccattgtttaattttatttctcctctcacaaatcatatcatcaacgtcatggcaatgtggcactatgtctccacatgccgcatctcaattaccttcccaaaggtaattgcccaagcatatagcatttgataaatatgagtatgcatgattctagaatggcatttctaagcaattgtcataattgactagggactcatacgtaatcatggttacaaggattttaagggtaaacaataatcaagcatggcataatcacaagtaagatgttcatcattgcatgcaattttatttataaacaaaataatttcgcaattgggatcaatatattcaaagaatagtgatgacttgccttgctcaaagtcttgcggttcttggtcctcgcttggatccgcaactccctcggactctaaaattacgtgcgaagaaacgatttgaattcggttaaaattcaaataaagatccaaataaatccaaatggaagtcgaatgcgaaagttgattcttttatattaactttactattcgcgaactagggcaaatctaatttcgatttatacatcctaaactatttttcgggtataaatattttgttatcataagtttttaatttaatctacccgagcattatatccatataataggttagaaattttctatcgcgagctaaatatcggacggaatcaaaaaattatcttataatattatacgatttaatttaccctatgactaaccgattaaatataatatacgtctaaaattcctagtgattaaatccgaacttctaccgtgaatcgattacttatagagattatccaaaactaatctataatagtctataacaattcatctaattgtttagtcgttaattacatctaaactactaccacgaattgattttttttagaaattaccaagaataatctataatttatattaaattttgcaattctatgaccataattaatctataattaaattctaattattttagattttcttaaactattaacctccttaatttcttcctaattttctatttatttttccttttctttttctccattctctcttctctttttctttctttttctttcttttcgctctttctctttttctttcttttctctctttctctctttttctctctgccggcctctcttttcctctctctctctctcggctctctcccacccaagcagcggcggcggtggacgcgagggggaaggagggcggctcaccggcggcggcagcggcgacgacggcggcggcgatggtggtgcacggcggcgcgggagtggcagcacggcggcacgggaacggcggcgcggcggcacgggagcggcggcgcagtggagagggaagaggggaggaagggtgagatggggtgggggaaaatggagagagggggggggtatttgtagagaagggagaaggagagggggaggggcagcggcgtaatggcgacgcgacggcggcgctcggggcgggacgacggcgacgcgcgggt

SEQ ID NO: 56487 - DNA, 10349 bp, Oryza sativa
ggcgcgcgcgacgggcgggcaacgcggcgcacgcggcaggggagggggcggggctagggggaccacgatcgaacacctatgccgcaatgaacagtaacttttcctatttatcccgatttttgcccattttctatttaaatatagccctataaattctaatttttgcataaatgaagtttgctccatatttgtgttatcctaattaaaaattcaccctactttaatatcactcatattttgtttatataatttatttgaatttttaattagggttaattctcattccatcgtactaaaatttaattattgctaatatggtcgcgataaaattttatttatttccaatcccacctaatctttattttaatttatattttaattatttatttagccaacttgatttttagggtttattcctagttagttattcattattcgcgattaataaattccgagattaaaatctaatgaaataggcgaataaaatcggcatgatgcaatatttttggtgttttgatttcgttggtcgaattttcagggtgttacactggtgattcattgaatgcatcaacatatcaattgatcctacggtctattttggaagaatcattcaggtgagcatcaactaatctttggtaagctaattaatttcgaattttgttttctaagactaagtttagatacatctacatgttttataaaagtaattgtgaaaagagaattgggcaacgaaatgacgaagacgcgattaaaattaattctaaaagttaaggacagttaaggacgcgattaaaataaagccgtgcctagcaggcaagaatcctcgtgcagtgtaccgagataaatcattatcgaataaaagagtactaaatctcaaaaaaagaataaaagagtactccatttgagaatttatatcttgtcatttctaccatgaatagagaacaatgcatcaatttgctccaatggaatatatattctgaagaacagaatcttgttacttacattatttgactttatgtcactgacatatagatacatactgagatgcagtcacatgacttaacaccagagaatccgcatccatatttcgatgggtactctctacaactccccggtactataaaagaaagaatctctgtttttttatcgcaaaacattaaaaaaaaaggaaccgttgaaacgtgatcttgagtgatctattttcaattgcaccaacgaattaaactgaataaattgaccaagggttagtgaacatctccagtcattttttaagagctcactgtcgaagcacttgcatcaatcttcacaaccaaaaatagctactagcaccaaagaaataagataggtagaatctgataaaacctgctcccgaataaacatttttttcattaacctacgaattaaactcactaaaattgacgaaattaagcaagccaataggtcctcgacttttaaagctcattgttgaaggcaaaagcacttgcataaatctgcacaactaaaagtatgttcaaatcccagacttttatgtgtgcttgtatttacggacgattattttttctgacagacgatgtacccgttgataccggggtgtttgtggattgtgataattttatcaatttcaatatattggcctggactttggagatgcttataagtgtacaatatgcatatgtgtacttatgatgagagtgcttgcgtatatatgagagcctatgtttgcagtgtttctataaaaaaaagggttacagagagaactggtactgcatttagcacctactctgtatcaactgctatcttgattataaaagcatggccataatgatccatgctcttaaagttatatcaactggctggcaacttagtactactaattttcagtaaagtgttgttcctttcaagaacggcaagggcgatcagagcgtcgtcttgccgatctgcttgccctcatgggcaggttccagctcgatgtccaaaccctcatcgcagagctcatcttctgtctaaatgcaattgcaacgcatgtgttctactgttcttgtttcttcttggttcagattgtacttaaatttgttggtgtcagataacatgctggccctctagttcatcccacgacgcagagtagggactattcctattgtgttccaaaaaaaaaaaaattacatacgtgctattcgttctctacattttttcagttctgtgacagagtgaaacttcctgtgagcgagtaaagcttattgtacaatggtagagtactaaattacttctctttctacctagagacaaacatcaactttctttttataaacacattagaaatggagacgctcacacacacacacacgtgcacagtcatctctacgaacagaccttatccctatgagcacatcagaaagattaaaccaacatatctttatattaataaagttattacaaacgcataattgttgataggtacgtcgactaccactgagacattaactgatcttggtaagaccttgttatggtccaaatagtataattttgatttttaagaataactttaaatttttacttactgtcttagcaatcataaaaaagaactgaacaacaaatatgacaaaatgagacctttaaaattaattccaaataaaagttaaagttcaaaaccacctctgaagtatataatataaagccgcatgctaagccggcaagatcctcgttctgtgtaccgaggatgcaacaagatggatttaaaggacaggccccatggaactttccgatatgttctcttgtgaatctatcttctcatttctccttcatgtaacatgaacgtggaacaggtgcgtcaaccagccagcttttgaatgtaacatattcagacatgaacattaaaacagagaagaatctgcgaaaaattcatccaattcatccatgaaaattaaaacagagaagaatctgcgaaaaatatggtattggtcctattggataagctgtttgtatttgaaaccatgaaccatactgaataaaactgatcagaacaggtcaacagatcctatacttttttaaaagctccttgttgaagcattttgcataaatatgcacaaccatgagatgttactgaagaaataagacaagtagtactgttcttcacaatactctgaaaacaaccttcttggttactttttttagacaatgaccgtaatgatctttggtctaatatttatatcacaattggccagcaactgttagagaaaatgacctcaatgatctttggtctaaaaattatattgtgtcactggtgtcttgtagcctcatcaccttcccatacctaacactatcccttttaaaatggtctcaactcttctaaaactagcaatgtggtactcctaacactaggcatggagtattaccgaattaatattcacaagcatgtcttttatgagatggggctttgtgattctccatatgggctcccatatataattccaacatcctctccattccttgacttcgtcatgtttgaatctcctccttgaagtttctatttcaggcccaaacaatggaaaagcaacaggaatgcagaccaagcacgcgattctgaacaccacagcagtagtagtgaaaccgagagatccctgtcgctggtatagtttgctgtgctgccttcaactaagcaaggccacagaggcctagtttacttccaaacttttttttcaaaaaacttttctatcacatcaacactttcctatacacataaatttctaactttttcgtcacattattttaatttcaacaaaattttcaattttgacgtgaactaaacatacccagagtgatcagctgctgggcaaaaccgtaaatcgaaacgattctgaatttctggttcacgggtcggctggaatcatcgtggtgtcgtattaatatagtagtatttaactgcactgcactgtatcagtttagtgtgaactttacagagagctatactagactacgatacagagagaatgacagattggcccgatcgatttgttctccggcatgggcgaccctacacaaaatgcttcgttacagatagccaggtcgatgtgccgtctcctttgttgcttttcaccttttctttttactcaggctcacccagacacagacagtctcacatcacaagtcagtatgcatatgcctccaatctctgcagttcccagttggataggaggattcctagataatctcgcagagttcagtcgcacggctacagaatcggacattcagatcacagttgcaagcaacagatcacatgaacaagctccaactaatacagtttcagttcaaccagtccaatgcatacaggaacaaatcaagaaagttccagctcaccagccagtctttagtgtcttgctaccttcttcaagttccaacacgtacaaacagaaagggcaatccagatctccctgaagatgtgtgctttgtgatgaattttttataatcttttttgaagaataagctttgtgatgatttattaatacctgaaactcaattaggttctaaagcaagcattgcaagtagaggctctagagtagcatgacatgaagaggtagttacaccgtgtttagttccaaactttttttttcaaactttcaacttttctatcacttcaaaattttcctacacacataaactttcaacttttctgtcacatcgttctaatttcaatcaaactttcaattttgacgtgaactaaacacaaccttagtaccttgagcattcaaactccaaaaaggaagctgcttgagagagcaaagaagataccaaaccctcttctttccctatccccttccctcctatgatcctatcctatcctagcttccattccccctcaaccttgcacatcaccatcctccccttaatgccactcctcgcctcgctgctgccgccgcctcatcgcattctagagcattgctcatggcggaccaccaccaccagccgccgaccccaccacggcgccatcggcgtccccatgagctgtccatggcggcggaggaacgacaccatgggacgcagacggcgatggcgtcggatgacgatcgccaccatgatcgtggcggctggatcaggccggaggagaagcaccggagctccggcgtggcgtgggcgctggtgatcctgtgcacgctgctggcggtcggcgtgatcgtcgccggcgcgacggtgttcgccgtgtacctcatctacaagccccggatgccgtacctggtggtgtccgacgcgcagctggtgcggctggactacgaccagggcggcaccatcgactacctggaggcgctcgtcaccgtcatggcgaggaacaccaactccagggcggacgcctccttcgcccgcgtcgacctcgcgctccgcttccacggcgccgacgtcgcgcgcctccgcgccgcgccgttcgtggtggcgagcgcctccgcggcgccgctccggtacgacgtcgtgtcgaaggggcgcgcgctggacgccggcgggatgcgcgccatggacgcgtcgctcaagtccggcgtcgtgccgctcgacctcctcggccgcgcgcgcacgcggtggaaggtcgggatcttcgcgtcgctcaagttctggacgcgcatctcctgccgcctccacttcttctaccccggcaatggcaccgtcatggcctccgatcgcaacacctgcacctccaggtcgccatagccgatcgccattgattccaattcctccatttgattcgttcgttgcatctcgacgccatccgagacacgtacattactattacatcgcaccattacagatcatgtttcacttgtcatacttgtacagccaaataatgctggtacagtagaatctctgaatctacaagaagagtttattcaaatttagcgcgaaaacaaacacatttatatttgtaattctttattttttctcgatcagtcccctgtttgtactctgtaccaccaaattacgaagtcgatcctaattcctaaacagtgtgtatgaactacttcaagtgtcttttcgcttcgtgtcattgtcaggaatcagaatcgataacatcatcaactaatctcttcagtgttactactgcaaatccgatgaacattctctgacaaaatcagacgctgtctgtctactgaaaactgataatacttcaccattgggctgggcctgaattaccagattggactttctggcccaatatgtaaatccgatgaacattctctgacaaaaggaaaaagtacatcgaaggtccctccctgccgccgcgccaccgtgcggcccacgatgggccggcccgcacaaggagaaaagtgagaaagagagaggaagaagggacagaagaggggagagagatggtgatggcgtagtcaccctgccgtatgggttccacgctaactcagctaccacgtcggataaaatcagggtcaaaatcgtccaagtatccaaagtgacctggttttgtaagttgagggatggtatacaattttataatccgatgacaagatgagattggaccttatggcccaatatagaaggcccacctattcttgggccgaagtctaagcccaacaaccggtcagcgagtcgcgacggggagggagtggctgggaatcgccggagaagaggaggatgacgccgtgacacgggagcacagcaaggtcatcgtcgtcggcttccgtacgagactaggaggagaagtggggattggattgccgcggaattatctccgtcgctgtcgccaccggccgtggggaagcagcgcgcggcgcggcgcgggggggagagtctcctccgccaccgccagcgtgggcagtgggactacctccttgccccgctacgcgacgcggcgacgtcgccgtcggcgtcgtcacccctccgcacggtgcactgaacgtggcgcctccacttggcgcgcgacgcgacgcgacgcggcccgccttcttcttctctactgctacttaaccaccagccgcgcgcgaagtgcggcgagcgcgcaatcgaggtcgaacacttggccggcatgaagcccaggcctaccggattcggggccgcggcggcggcggcggcggaagttttggtggggggcggatgcggtggatgggcgtggaggccgaggccgaggccggcgacggtggcctccaccgcggcgatgtcggtgagggggcctggtactacccaggcggccgcggcggcaagcgccgtgcactcggagcgccaccgcggcggggtgcacgggctgcagctccctccgctgcggctgcagttcaccgccgacctggaggcgcggatcgagaaggtgatctacgcctgccgcttcatgaccttcctcgccatcgccggctcgctcatcggctccgtcccctgcttcctcaaggtcgatttttatctcctctcttcaggttcgatctactcctagcaatttgttgactgtccaactctgcagggctgcgtctatgtgatggatgccttcatcgagtactacctgcacggtggcggcaaggtcaccctgatgctagttgaagccattggtaactaactaactaatctccctaaacttgatgctgttctacacacttcagccatgagcaattaaccactttgtatcttcagcaacacagattagcagttgataacacgggagcacaagcaccaaaccacaaattgcatcgttgctacatgcatcctagtggagttatatgtagtaatttctgataactgaccagtgtgcatttcttgatttacctcagatatgtttctggttggaacggtcatgtttgtcttcgggacagggctatacgagctgttcatcagtaacatggacattgcaaagtcatcatcctatggctctaacctctttggcttgttcaggctcccggttggttcacgcacttagcatccctctaaatggtgcggtaactggggaatttccagtatcctgatacctctgtttctatctgcaggaacggcctgagtggctcgaaatccagtcagtgaatgatctcaagactaagctggggcatgtcatcgtcatggttctactggttggcatctttgagaagagcaagagggtgaccatcacatcatgtactgacctcttctgctttgcagcatcgattttcctctcttcagcttgcctctacctgctctccaggctcagtagcaagtagaaaaataggaggtagcgacacctgaatggctggagcacaaacaggtcttgtacatatgacataggcctgttgtgtttcctatgccgtgcaacacctcatgttatgtttacataatgtaaaattagaggggagtttgcacatctcacgtactctttgtatggaatggaaactactttgtatagtggagccataagacattattgtcaccatcactgtgtaccacctggtactgcaactcactgcttcgatgataaatataaatagttactgctatggcatgttatgaattgattagcaatgctgccttttctgtctgtgattcttttgaagtttttagagcaggattactttgttgatttcttttatacccccaaaagtataaccaagtgctagttaattagtttagaccaggaggagttgcacctatttcttattcttatgatgtcttttatgaacacttctgaatgatatgtatgttatgctattatatgccaaacatactacttgccttcaaaatcattggtgtgatacaggaatgctctgacctccctctttgatattagtagttcctatttgatcacaaggccctggtgaagcttgccaacatagtgtttccatattatcgcttattttcttacacacagagtatatttgatgaatggagtgttgtttggtgtgactactggcttgtgaatgaattgaaacctgcagaatctaattacgtgttatgtatccatgtccttctttctaaaaaaaaatataagtgaagctcatgatgtactctttgccgtatgttgaagcttatctgcgtagctatcgcccttatgagtaagaatactgaacacgatcattaatttgtgaggttataattctgagcaaaaacttgcttgatgttgcagttttatgtataactactaaagctgatgtttcagttctgtgacctacgtccggccaactgtccttcccacacataagatttggatgccagattatctttgaggtatgtttctgaccttcagtatttgcaactgttagcatcatgccatgatctgttgatttctgaattggatgcgccaatgtatggttgttgccttgagatttgtttctgagttctcacctagtatttgtaattcttaagaccattcaatgatttccgagttgaatgcatgggtgctttcctttgaggtatgtttctgctatcaagtattttttaaactgttgcaacattcagtgattcccaattgggtgcaccaatgcatgtttgatgcctatactaacagcaattgacctattcctaaaagtatttcgtagagaggcaaaactgctctggcaagaacgatgaaaattcctatgctttatgaactttggttaagtatgacaccttttctcttaggtgatcaaattaaaggagaggaataataagaagagcagcttgtattgtgccacaaacgatgacagaacctgaaataaattattcaggagttccaagccaaccaacgggaagcaaaggttcccaatcgaaaaaagacttcaaagtggcctttccaaacataaataaaagttccaggaatttgagaaaataaggatcccacaggggaggaataatttttggtggcgcagcaccttgaacgtatatacaatataattactttgaacatttgctgccgtatgatctcttttctatatgcagccgtgagcaacaaaattagaagctccaacttgctgttgtttcatatacataatagattggcagtctctgataggtcagtcatggttgcttgaacttgatgggaacacacaaagtgttgcacttgatgttttaagtatgcaacttgcatgcttaattaagacttgaaagatatatttagcccattataactttgttgctgccaaagtgtgggttgtcgagtattatctgttagatttattacaagtggatcaacttgtctattaaacttacattatttagcacacattttgctgggataactgatcatggtaatgagcagatgttttcatgactggatcctcagtccttggtaacatttggtaaaaaaagaaatgatagttcgctttcctggcaaaataagttgaggatgatcatggtggtaagaaggatgattttacataaaagcattatcctgatacatgtcaggttggcacagatttctcttagacctacatatt

SEQ ID NO: 56488 - DNA, 3045 bp, Oryza sativa
cctaattattaatacagtaacaatttgtgcacatcagcgcatgagaagggcatacgttggtaggaaccattttgtaattgcaacagaaaagtttgaaagtttgatatcattgtaagttatgaacctttcaggatcacctccataactagctatattattgcagacaaaggcaatcccttgagatgcatcttctaccatgtcaccaatagtcccttgaggaaagtttctgcaaacaaataattggtatgctccatgaaaatggtatgaaccctcattcttctatatgcatatttggaatttattttgagtacctgtaatcaatgcatgcaactaagatgcccctctctgccaagcgcctgcccaaaagggccccccaccctttgtacctgtggatgtgatatgtataatttgccattatagagtcaacacacaatctaaatcttactggaacttcaggtagtaaaaatacagaaagttggagaccaggatagtacatacttgtacagttttactcaccctatgatccaagctccacccgtgacaaatgccacaactggcttcaacccagttctatcggtaggtatgtataaatccagcctagataacgaattttcagggttcaatatatgaacagcataatagactatgccaagtacaccaagacaaattaaaatacaaatatgagcatagcattatgaaaaagatagcaagaagtacctgtttcttggttgttctccatatacaacacttctacaaacttggctcgagaagaaataataatatacaactgtattaaagaaaaaaaaaagagtcaaggccatctccattctgttaaacactttctgtggtaatgaaatttgtttttccttttgaaaactggctaggagctctagcactaactaaggaagaggatgtgggatggaacccatgctagtcttaaggtttcaaaccagcggatgggacaattgtgatctcaggtatataacacaaaatcctactgaaatactacttatgaagacatggtgaatcaaccaaagaaaaatgtggagatgtgccaagcaagtgcaaatgctttctctccctcaacaaaagagtaatggcaaggctaaccttgaatgaaacctggcatgagcaagaaggtgtaacaacagagggctaggaactgcctgatccatctgtagcctatcctgcataaatcagacagagacaggttattgcaaagaacaaaacacgaaaaggccatactcccatgcacaatcacaaaagcagtttagcatctgatcttagtagaaagcctagaaatgatcatttagctcagtggtaaacatgccatgatacaatttccccaaattacagcattaacacaaacagatcgcaaggttgaagtgatagcagccttgtagtagagtagaactatcagaaatggaattggcgagtacccgaggtagcggaggaggatgagcgtgaggcgcgtgagtaggtaggtctcctcggccgcgcggcggacctcccgccggaaggatccgctgcgctgccggaaccgctcgctcaccaccacccgccgccgcacacccccacctccacctggcaagagcggcgcgtcctccgctgctgctgatgcagcggcggcggcggctggagatgacggcggagcctcccccgtctcgctgggccgggctgccgcgcggtcagcgagctccacctgcatcgcgactgacaaaccagccggcgacgtgcgatattcccccacgtcgtcgtgactcgtagcgctccctgctccgggcaagacgtagcgcggccgcctctcacgcaacggcgaggtcgccggggagagatggcggtcgttctgcggcggcgctccggcggacgacggcgaagaagagaagatcttctcactggagggaggggggggagctgacaggtgggccaccacatggcagcgaggagtatttattcgaagagcccctttaattattttcgtattaccagttaaatccatccacgatcgctaatccaaaactgcacgcgtctgaaccgttcgatctgaggtgcggccagatcgagaaaagagtagttggggagcgcatatttacattttggaccttactcttattcgtatttgtgttgcggccatatcgagaaaagagaagcggggaattagcacatttacattttggtccttcttcttattcgtatttgtgttgacgggtaccgtggattccaccggcggcgcagagccggagaccggagggcggcggaactccggcgagctcggcggtgaccgacggtggaaggaaggtgcattgttcgtcagtacaccaagctctcatcaactcgccgagcgcttcccctccctccgctccatccatccatggcgtcctccccgcctccatcgacggcgtcccccacctcctcctcgccctaccggaagctcctccactccgtacgcctcgccctcgccctcatcttcgcgtgcgattccgagtcctctcccctgatgatacactttgtttggattccttgttcggtttcagttgatttactgggcggtgcagcgctgccggatgtcggagtcgccgtgccggctcacggtctccgtcaagcgctccccggaacccgctggttcctcgcccctgcgtatatctggtagtgcagctgcgcgcttgcgccgttgtgatctgttgccccttccttccgcttacattcgtgaactactgcagtttcagatactggagttgggagcaagctggaggagttcctggagctagatgcattggcgcgtgagacccccgtggagaaatggggtatgcgatcaccttctctcgctcaatttccctgtttgctggttgtcagtagcatcctcagactgcggattgcatgagatgtgtggttctgttgttaacaacaccgctgaatcatctgggaagttggtttgtacggtatagcctgttaggtacggagtagatatggagttcaccaagtcatcagaatttgcttaagatatattatcactacatttgatatgttcatatgtagaattgtaga

SEQ ID NO: 56489 - DNA, 2234 bp, Oryza sativa
ccattgttctccatggtcccatgctgctagtgctcattttattatctctttttggagtggaaatcccacaaagcctgagaattttcccataagagctgcaaaagttgatagcattgtgggcatacttaaatcggtcgaaccacagtagtatgccatgaaattcgctgtttcactttgctaaaacttatatttgaatcttgctgtctccttggttcctttttgttccttttttgcatataatgtagttctgtacatactgtctaatttattcaaaatggctttattggataaaaaggaattctaaagtcaaaggaaatgttaaatatttatgttgcgtatacttatcttgttatgtttcttcagatattttccagaaattctgtgtgtatgtttattctgttttgaatacatgttatgacacctgtggatccctccacaaattagcatttgccatgcaaatacataaatatatatgttgtaaactattgttttattatcttaattctatgtgtttattcaatgctattgaactttttattgcatacttttccaatctgtaggaatcgatgacaaagctatttatcgttatcaatttaatcttcaagaagacacatcttcaagcacaagatttaccaagctagtgaccacgtacaaaagtcgtgctatattcaggcaggtcctcttgtgttactttgatgtgacctatggaaatctggtgtttgttgaatcgtttatgcctttttcaacacagtggaactgaagtatgcctttgcctgccaactgaagctgatgttgatgacttaatattatggttggttggttttgtccgcaaggttgtattaaggaacattcatattttttaaatgttttttcaccataattttacctgcccaaccttagcaacattagtgatcgttgtaatttgttatcctgtcaataatagaatcctcataacaatcctatattacagacttactatagtcatttgtttccaaatatgatagaattagtaacattatgttgctaaccatttctttttgcgcgattgtcccgaatactttctaactagcatgtttctgttgttgacctttgcagatattcgtgctaagagcatctgtaagtatttctgaacttttttctctagttgtaaccagtgtgttcttcctattttctttgttcactatgttttttttccatatttcataatgactgatcatatttatactcaccattaatccctttaatcctgagtccttaatcctcaagtcaaaatgccaaatgctattcgtccatactgaccatacacactggtgctattgtgtgtctatctcttagcagcgggtgatgctgttctctgaggatgtgtttttcttgttagaataactgtgtcatttacaaagccttctagcttatcccgtatcatgtgtggcgtactgctctaacaacagtacattatcccgtatcatgtgtggcgtactgctctaacaacagtacatttcatgccacttatatcatctaaatcgaatgtgcagattgcattatgtgaatactttttcacacactgcaggacatgtttgatgtatttctatatgtgttcccgttttatatggagtctcatacctttgtgcatgatgtgcaaaatgaaaatacatgttcctgtatttatttatttacttctgaaaattcacaaatacaaaagtaacaaaacacggtgttcattggtctatgctacagggcaaaacaactgaaaaccctaatattggagtttcctacagatgcatttgtttgataagttcttaacagccatctgatatcatatcaccaatttgtctgcctgcattttcagaccaacaatattgtgtatcctgagatgtaattaaaggatataaaactgatgatcatgattcatcctcagtacttggttacattccattcctccgaacatgtctaattttactttgtgtttgcatatgtccagttttagttgttgcacagtaaacaggcctagaattagaagcatctatctgcttttactctgttttttcttattgtgacctcttaaatggttgtttgatttcttttgtactactcagaatttagcatgtgagctctttgttgcgcaaacagacagtgctggatcaggagacgtttgtctgtcacaagattctgatgatgtccatatttccattaccacatcaagtattgaccgtctagtttctggccttaaagattat

SEQ ID NO: 56490 - DNA, 2944 bp, Oryza sativa
cttattttgggacggaggtagtatctaaaagcaaaggctgaaaaataaactacgatgaaaaagaacttttatataagtgttctaaactatctctaaagaaagcaatcaagaaggttgttgtcagagtattgtgaagtagagtactccttgtattatttcttcagtaacttctcatggttgtgctgttgtgcagattcatgcaaatgcttaaacgaggagcttttaaaaaactgtggatctgttgacctactttggtcaaattttattcagtattatttctgggttaaaatacaaacagcttattcataatcatgtttcaacagattctttgttgtactgtacagagagaatccccatttaatagctggctggttgacgcacctgttccacattcacgtggcctgtttagttcgcgaaaaaaaaattgtgtgttacatcgaatgtttgatcgaatatcggaaggatttttcggacacgaataaaaaaactaatttcataacttgtctggaaaccgcgagacgaatcttttgagcctaattaacccgtcattagcatatatgggttactgtagcacttatggttaatcatggactaattaaactcaaaaaactcaaaagattcgtctcgcaatttcctctctaactgtgcaattagttttttttatttatctatatttaatacttcatgtatgtatctaaagattcgatatgatgtttttgggaaaaaaaatttgggcaactaaacgggaaaccatgaaggagaaatgagaagatatagattcaccagagagcacctcggaaagttccacgggatctgtactttaaatccatcttgttgcacttgcatcctcggtacacggaacgaggatcttgcctgcttgacacggtttatattatagtagtagtggtaatttggaggtgattacaatttttttaatttttttgaattaattttagggctccattgatgtgtaggaaaaatgtaggaattttagaggatttcaatcctatggaaaaaaaatcctataaaggtttttgaaataaaggattggatcctatccaatcctttaaaatttatatggaatgggtaatcctatacacattttggaggaaagttagcaagaggtctaacctcttggaacatttcctctgaatctatctctctcatctgatttctgcgtttttcctgtggtctaatcaaatggccattcctgtgtttttcctgtattttacattcctctgttttacaattgtattcctgtcagaatcctgtgttttctctattcatctgttttttcatttctacgattcaaaggacccaactgttgctttgtcacatttgttgttcaattctatttttatgattgctaactgcgaaggccctcttgaattgtagaaaaaaatatattctatcatattagaaacaaatgattctattatattctatcctttgaaattcatgcggaataggaatagacaatccggagtctatctctcttatccgattcttgtattattttgttttacggtctaaacaaacggtcatttctatgttttgttgtcttttacacttctctattttctctattttttttaattcctactatttaaaagggtcctaagagcaagtaaaaatctgtttgaagttctattaaaaaatataaattatcttaggattgtaacaaagttgatgttcgcctctgcttaaaaagaggagcagtcgtgcggataagccacggaaaaaaaacgaataaaaataatttataggtcaactttttatatccgtattatctacggtgcagccaagctagaaatagactagaacgaaacaaaccacaaaggtaagtctcttctaaaattaaaattttcaaaatttataaatgctgattattgttgataagccaataagcaaagcaatgagagacaactagactaatgcattcaatcgagagatcaccagttctgattcagataatttagtaccacacactttcacagaactgaaaaaaaatatcaacttagatcctctgcattagaggtactaacgcagtggatgaacaatgataccaaaccacacgatcacagtctaacgatccagatcacactgatactgtaggctgtagccataaattgtgcttagttactgtagcagactcggatcacgttccacaggaactctccgctgtacgatgaccggactggagaaatgtagagagatacgatccgttctaaaaatataaacattttgactctaacacaatctccgagatattattttaaccaacaatatctataaaagaaaaatattttaaataaaaagagttatatattataatagtttatttaatgataaatttagtaacatcaattttatataattaattttttatattaatagttaaagttaaaaatatttaatttatcattatactaaaaatatttatattttgggacagacagagtatattttttgaacacgataggacatcgtcattagtagtacatagtcagtgcaatttttatcagacaccgacaggtataagtacattctgaaccaagaaaaaacaagagcagtagaacacacttgggcaaaaaaaaaaaaaagtaacagtagaacacacatgctgcgtttcaatggtctagctgagctcggcggtgagagcttggacctcgagctggaacttgtccatggcgtccttgggcaagcagatgggcacgacgacgctctgctcgcccttgccattcttggacctcgagaagtagttggtgacgccgaggagcggcccttcgccgcccttcgccggaccgccgtagacggcctccccccacccgaagtcgacgctcttgaacccggcgtggctcacgtcggagacgatgtacgtccgcgacagcgcgaacagcggccgcccggcgaccaccatcaggtccgccaccgactgcaggta

SEQ ID NO: 56491 - DNA, 1793 bp, Oryza sativa
ggcgcgtccaccacgcagtggcagaacctctgcccgaagatgaagccgccgcaccgcagcctcgtcacctggatgtagagcagcgggcggccgaccaccggctcgacgccggcgacggtggtgctctcgaggatgaaccgctcgaagcaagggaacggcgggctctgcacgtcgccgaagtcgtcggcggtgaggtcggcatcggcctcggcgaacatgacgccctggccggcgcactcgacgacgagcttccggccggcctcctcgcggaggcggccggcgagggggtagtacgggacgagcgccctggccagcgcctcccggatcaccatggccgggtcctgccccttcttggccgggttgttgcggtacaggtggatgcccgagctgtagaaccgcatgccctcgccgtcgtcgatgtcggacagcgccttcacctcccgcggcgtcggcgccgccggtgtcaccagcaccggctcgcctcgccgcaccgtgaacgccggcagtggagacgacgccattgttgatcgattgagtgatgcgtaggtgcgtatgtgcgttgggatgaaaggtggtcgtagtagtgtgttcgtggagtgggcgaagttttggcgcgtttatatagcgcgggaaacgaagacgggggttggtggccgggtgctattggtggtcacccaagtctagcgggtacacccatccaccccacgtacacgaacacacgtgttcgcattccttttacacacaccaaataagtttcacgcactctgtacaaatatatattactcccaccgtttcatattataaactagcataatggcccgcgcaatctgcgcgactagaatcattatattttctctcatataataacatatatgttttctaattatattattcaaatatattaaaatgacaacgtaattttaaattttacaataactttacaaagctactaatgtgtaatattcatattatattttatatacgtgttatttattaattatttttaatatcaaattttagttatttgtaaattatatatattcctatatgtactctagactcgtcttttaatatttctttttttaattccgaattttccgtaaattgtatttttatatatagactctatgctttttttccaatattatttatttttatttttgaattttcatattatattttatatacgtgttagttattaattatttttaatatcaaattttagtaaattataaattatatatattcctatatggactctagactcgtcttttaatatttatttttttaattccgaattttctgtaaattgtatttctatatagactttatgctcttcttccaatattatttatttttatttcttaatttttattatttataattgtatttctgtgtggactctaaactcatcttttaatattctttaattttaaatttcgaatttcagttctaaattgtattcctatattgatctttaaacacttcttcccatgtttttcttaatttcgaattttagttatttgtaaattatatttttatacggactctaaaatctacttttaattttattatgtttattccaaattttagttagttttaaattcttatatggactctatactctacttctaatattccttattttctaattccgaatttcttttttttttcttaattgtatttctatatggactctatactctacttctaatattccttattttttaattccgaatttatatttttttcttaattgtatttctatatggactctatactctacttctaat

SEQ ID NO: 56492 - DNA, 6215 bp, Oryza sativa
ttattcatctacactgaacttattaatcattttggtcccattgtgaaagatctcaagaacaattaaattcgcgtcactgcgtacccactacacacagtcgatcgagcaaagattgtgtccttttctagtggggtttggtggccattttttaccggccacggattcttggatcaggttcagaaaccagtggcgtgcaaatctgaatctttttgacctgaagaacaaaggaattcagtcagagtagggttgctttgatatgacctaaatgaatggagacttctaccagctggcaagtatacattattagccggtgctgtgcctaatcaaatcgcacgtagaaattctacaagtcatcactactttcacctgcatgggataactgataagattactccaaatgtctcatgcttacctttatcagtctgtcaatggtgtttttacaggataatgtcatcagtgggattagcacttatcagcactgtcagagcaaacaatgaatccagatttgttcatgaatattttaattggttacctgttcatgaatggattccctcttgcaagctcatgctgataattaagttgattcatggattaataacctacagttcctttgacgttatgtttcatctctccaagcatgtacagatgtgctgacattatatttcttcagctaatccacgtatgaacaattagggactaggctggtgcaccaacccctatgatgtggggctattttagacacatggggccgtaccaacacagatagtcaatttttttgcatttaaattactccttttttgtggcgcaagtaagcatatatagtagcttcagagatacaaagcatctgaattattagtacaacatagcccaattaaataatcaacccatcgcgatgaccgatttattacgcgtgcacggcatcataatccatcgagctagaaaaaaaagattaccgatgggttgttttcatgtagttatcatctagctaaaaaagttgtatcgtctaactaacaaatccagggaatgattgattggccggtttggcagaaatgtgatgacaatttgacccttgggtccaacctgaccgaagtcatctgaattttaaatattatatggttgctatgatatggcgtcggcctcgcatcatcgcagacgcgatgagcaatgcaactcagtgtcttgcagttagcagccgtgttatctcaaagcttgcacgtaatatattttcatctcaccaaaaaggtgttcagtgaagttgctgaaaagagatggggttccctaatcaaggttcagagtttcagacgttgaagagtttgtgcagacagatcaaggttactatacctcgtcttcttgattatcccgtgttaaacttctactaaaataaaagtattttatagtatttaaattttgagggcagctacacaacgggatattttaagtgactctcccttttcctttcctctatccacgtgtgctccctggtacctgatacctggtatgtccacgcgtgctccctggtacctgatacatggtaccttaggtaccggttggtacctggtacctggtacctttggtactgactaggtatcgaccgatgcctgatacctggtaccttacctggtacctgatacctttggtaccgactaggtatcgactgatacctaatacccggtgccaaggtaccgggtggtatctcggtatcagcctaatacttgtggggcatcagagggtaccatcaaaaagaggaggagacgtgggggagggagggccgcaacggcggaggatggcgtcgaggacgcacggcgagttgagggtcgaggcccaagccagagagcgtgagaagtctcgaggagaagccgaagaggaggttgacggccatacctgttgcaagtcgacacaggctgccggcgtccatcccggaggcgcaaagcaataggctgcagcggggacgacggtgacgccgaggccgagggcgaggacaaggggagctcccgcttctgccctccccggggcgacgactccctggcgcacacccgactgacgagggcggcgagctagagcggcgcagcaaggggaggcgagctcgagggcgaccctgttgagggttggtcgacctcgccaacgcagtgccgtcgtcgtcctcctctgccgctgaagacgacgacgacgaccccttcctcccggccggcttcgtctccgctcggccttcttcacacagagagagagagagagagaggagtggagtgaggcgagagtgagatggggattgcgtcgggtggatgaggatgcgggtcggatggataaggttgaagagctatctcgacaccacgggataccggggagtagattttctcttaaattttatgccacaattttaatattcacgcattgattctcatgatttaaatgattccaaagctaatcacatgcttgaaaaggaatctaaaaaaatcaaaattcaaaaattaataactgaagtaacttaaaaaaaatattttaactagtatttgctaaacaatctaaaaacattatattttagaacgggtggagtaattttaagttaaaaatatgagatgctttgatcattttagctacaacttgaaacctaaatgaaataaaaaaatattacggttaaatatatgtgttattagctacataaaaaaataatgctagaaaatagcctaagacaaaaatcaacttcaagttttgaaatttaaatttaggctgtgatttagtataagctaacaagcacatgataatagacgaattttattttctgtttccttttctatcgaatgttgatgaaaatcatggtctagactctagactagaatgaacatggctcttagcttctctccggatcttagactctagacaggatgtcaggatctctccgggtttccgccttcagcacttctcgggggaccgctaacccgattagttagcggattacctgaaatacgtattctttaatggaacgcgtattttcttagttagttatcggttccactcttcttccccaactcgctcctgtctccgcgcgcgccgccatggatgcatactacctcgtccgcctccatctccctccaccactccagcttccacccaccctgcctctacctcgaggccgccatgaccgccgcgtcggtggcgccgtcgcgtgccgcgccaccgccggcccagtgggcagccaagagcggccgtgggagtcctacgaccgcggcattcagcaccacgcaggctccgacctcgcctcctccctccgcctgctcgccgacatgcaggccgccgggctgcgccccagcggcgcggcgtacgcgcgcctcatccgggcgctcgcccgcgccggccggacgctcgaggccgaggcgctcctcctcgagatgcgccgcctcgggctccgcccggacgccgcgcactacaacgccctcctcgaggggctcctctccacggcgcacctccgcctcgccgaccgcctcctcctccagatggccgacgacggcgtcgcgcggaaccggcgcacgtacatgctgctgctgaacgcgtacgcccgggccggccgcctcgaggactcgtggtgggttctcggcgagatgaagcgccggggtattcggcttgacaccgccgggtacagcacgctggtgcggctgtacagggacaatggcatgtggaagaaggccaccgacctcatcatggagatgcaggagctcggggtggagctcgatgtcaagatttacaacgggttgatcgatacattcggcaagtatgggcagttagcggatgcacgcaaggtgttcgacaaaatgtgcgcagaaggggtcaagcctgatattactacatggaattctttgattcggtggcattgtcgtgtggggaatacgaaacgtgctctgcgattcttcgctgcaatgcaggaggaaggaatgtatccggatcctaaaatctttgttacaatcatcagcaggttgggggaacaggggaagtgggacgaaattaagaagctgtttcatggcatgaggaatcgagggctcaaggagagtggtgcagtgtatgcagttttggttgacatttatggacaatacggccattttcgtgatgcccatgactgtgtagctgctctcaaagctgagaatctgcagctttcacctagcatcttttgtgtcttggccaatgcatatgctcaacaggttagtctagttactggatatagatggaatcaacttcgtctaatggcatgatagttgttattaacatctgatgcagactaacatagagtgtcaaagtgataatataactttggaaaacaacaatttgcagtcattttagtattaaatcacagttctatctctggattaaaatatccatgaataattcagtgaatcctgaccattttgtttatctgttcaatgccgtgctcattgttcatttgccacccattctgtttagttctagttaaagggggtggcaatgattatatcccacccatgtgtcacacatgggccctaaggcacatgtgttcttgcacactctagcaaggcatggcaagggtatcaagagagtcaaaaatgtggtggcattactcggtagtctctactgtagtttcaaaacgctctggaatcttcaattatcattctgccttcacagttttgttttcttttggacgaaggcttaattggtctaaaaacatcaatatctacatgtcactgtgcatacctttcagtttgtgtggcttgtgcaccatttcaactctctcttttcagggtttgtgtgaacaaactgtaaatgttcttcaattgatggaggcagaaggaattgagccaaatcttgttatgctgaatttgctaataaatgcttttggtactgctggaaggcatttggaggcacttgctgtactccagcatatcaaggatagcgtacgttctttctccagaaatgagagaagaaaagtgttttttttaatgtttcttttttgggttccatgatttaacttagtttgagcaatttctacctattgttgatttcattttttcagggtatgagcccagatgttgtgacttacacaacacttatgaaggctttcatgagagcaaagaaatttgaaaaggcatgtccactatttttctactccttagcatttagtaacttaaatatcatggattgtagcaaatcctcatcctaaatttctgttgaaattctgaatacttatttgttttgctcttcaccataactgttaaaataagtttttcctcatgtatgcaactatctcacattatattatgctattagatcatcttgatgatacaaaatattgtaacaaagctttatgaaacatggcttattaatctaaggttttaggagattgaagtaattctgattattttcctgcataggtgtcagaagtatataaggagatggagggtgctggttgtactcctgatagaaaagctagagaaatgctgaatgacgcctctattgtactggcacaaaggggaatgttacatttgtagccacccttttgaattccagggatggatgctttggcgggttatcgaaattggaatacctacaattctgaagtggctcaagcttcaatttctataacttgaagaataccatatcccttttttgcttgccatgctgaatgtctgaaacagatacgatatatagtaaacacaggtgagttttggcttgctcaggaatatatagacacttctgcagttctttttctccctcagtattgtaagatgtcactcaataaaatttctccaagcctccaattatctttttaatttgtttactgcagagtgtgccaaaaaagacagaaagcaacattatttagaaagagaaggttaggctcctttcaagaaaaagagagagagaaagttaggtcacaactttatggaacatatcaacgtttgaaatcttgtatagtttatcctacaactgtaagatgacctcttgctttaaacattgcaatagctcggctcctctattcgcttcagatttacctattactaaatttcatgggagaaaacaatgaggcatcaagccctcaatttatcttaagcatagaaataaggttctcatatttccatgtctatctctatttctagttagaaatccatcttacttggttcctcctcaacatatgattgttgatactcttgcactctttcacagaggaagaatatcgaactacattcagggttcacaaa

SEQ ID NO: 56493 - DNA, 3490 bp, Oryza sativa
actagatttcaaaccctacacctaataaaggtccttaattatcaaagatttcaaacaaaatgcttaataaactatttctagctagcttaataaccctcaatccatcctttttcagctaaatgtaaacatgatccacaaaattcaataggtctagcaaaagggaacaaaacaacatatatagcagtacacactccatgaatggttatatgtccaaatggctcttaaatccacatccaagttgcaaactagctacacattcaagttttaactaacagttgcaaccataggcagcagcatgggcaaacatagacagcaaggggcaagtgtagataataaaacagcccacaataatttatgtggcagcagcagcaggggtatataaatcatgtatataaacaacaattcaactattcatagacaacaagggtatataaatcaataacttatccataaagaaaagaacatctactgcagcaaaattcatgctaagatcctctattgatgctaagattcactgcaccaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggcgtacttggagacggcggcgcaggccgtagtcgtcctggatcctggtggcggcggcggagaggcagtggcgaagaggtcgaggcagtcggcggtggtcggggatcccggcgtcgggaaggtcaggatcggggaggtcggggaagtcgatggacggacggcggagaggacgaccggcggcgagggcggcggtggaggcggcggcggagagggcgaggcggcgatggagagggtggagatggcggcagagagggcggcggagatggcggcggataggtcgagacggcgacggtggagatggcggtggagatggatggcggcggtcgagagagtgagtgcggcggcggtggtgcaggccggcgtcgggaaggtcggcggagagggtgagcggcagagaggtcggcagtggagaggtcgaggcggtggtggggaggtcgaggcaacggtggagagggtggcggagagggcggagagggcggcggatttggcggcggcgaggacggcggtggagaggtcgaggcggcggtggagaggagggcggcagagaggtcgagagaggcgaggcggcggtcgagagagtgagtgagtgagtgagagtgggcgccggatctggatcgatctagaagatgtccaaccctaggtcaaccctagtcaaactcacctgtgacgggctccaactatgtggccgtcacaggtggcctcacctgtgacgggcgccaaccgtggagccgtcacaggtaagaccacctgtgacgggcccaacactctgggccgtcacaggtgagtttgcctagagcaattttattttattttatttcacttagttcttttattttccttaacatattttcacatacactacatatttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggttgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacgaacggttcatccttgtacgcgttgttagccaagttgatagtggtgaaaccttcattgtcaacttttacattgcgaagatcgacccatcgacaacgaaacaacgggactttgaacttcaagtaatctagctccaatatttgctcaactctaccatagtattgatcacgacgaccaccgtcactagcagcctcgatgcgtaacccactgttctgcactgtgcatttgctgtcttgctttaccgtgtgaaaggtgtatccatttatgtcatatccttgccaggtggtggcactccattcaggaccctgtgacaaccactgaagtgtttcactagacaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgacctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaagaatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggattaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgaaagagtgtagcaggctggaggaaggtaaaccctgccggattccgtgcttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtactctccagaatattgacttctttttccacatgctcctctcttttgtcttttgtttttccacatgctcctctgtt

SEQ ID NO: 56494 - DNA, 1454 bp, Oryza sativa
  unsure (1)..(1454): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttctatccaatctttcttctttcgatggttgcttgtagagcgatagttgcttgtaaactgccatccgattcgtcatcctggctgttgacctgtgttattccagtgatctatgaaacgatcgatctcgtaaaacttaagtttctttctttctttctctgtttgcttagttctgaaattacttgctcctgcatgctccatttcttagaggagtgcaattgcagcactactatgcaaaaagcttgtgccctcttttggagctgttctcaacaattggtcccatcatccttgtcatactgatccttaggagctcatatccaagttgtccacttgtggttttggatgatctcatcagaatcggctactaattagtactccaggtttgacttggtctggcctatgtatatctctggtacggactgtttctattgggaacaagtcgcgtcttgcacatggtatggagcaggtgttcctttcatttgcgaataaacctacatgtctatgtactgaaaatgtcaatttttgttaggttggtcatgatattcccagggacaagatcatggttttgtttatagggctattctactactgaagaagttttataaccagccactctgtatttttagttagcttaatattttcttgcaaaaattgtgatcttgtagaacacagtgaaaatggagttcttcactgagtatgaaaagcaagccagtaccagatccagaaagtcattggcaaagaaagttatggagttagttgctgctgcagtagatacccgcacgggtgagcgggttgcaatcaagaagatcaaatgatgtgtttgagcatgtatcagaggctacgcgcatattgcgggagatcaagctcgttcgtatggtcggtcgcccagacatagttgagatcaaacacattatgcttcccccttctagaagggagttccaagatatatatgttgtttttgagctcatggaatcagatctccatcaagtcatcagagcgaatgatgacctcacccgggagcattaccagtatttcctgtaccaacttctccgtgctctcaagtacatccatgcaggtaagcttaactgctgataatccccaattccccaagaacgtacttgaccaccattaaacacatagttctgttgatttatc

SEQ ID NO: 56495 - DNA, 947 bp, Oryza sativa
accccataaatttaaaaaataatttgaatttttaaaaattttacacgatttcgtacgatttttcacggttaccgcggttaccgcgcggtaaccgtgcttatcaccggggcacggtaaccccggccctggcggtttgggaaaccctatttgtaactccctctgctgactcttcatcactgcagaggatccgaattgcctctaaactctcaatcctcctctcatctctttgtcaaacgggccgacttaatcgggacctaaacgcatgttatgcgtgtatccttttacccacccggactaaccgaagtcagttccggggaaagcctttccggcagcttgcgaatgtcaaggccctccgaaagtcaagaagagaaaatgacggcccacataattcagacggcctgaagctcgcagggaaggagcggcgggctgggcctccgggattgaggaacacttggcccaactcaaatgtcagcgaatgtcaaggcccagcctgagcaagctccatcatgagctaaacgcgtgaattttacaggattttcatatgaatcagtttaattcccgtaaaattattccaaaaatcctagattcggaagaaggccttagaacatatgattcaaccaccataccaccatgattccagtgaaattactgcctgaactctgaacaaactcgtggtagacaaaatatttctgaacgtctctgaataccagcaaacctgttgggactctgaacttggtaagctctaatcaacaaggctccaaatctcaggcagcatatctcaaggcccaaccatgaaacacagttggcaacaaatggagtagctagctagcatacctcgatctcagtttgattcgattgaacatcatggatgaaccaccatgattccagtgaaactgctgccttcaaacaagagttataaatatgacattttctgaatctctgaatac

SEQ ID NO: 56496 - DNA, 4703 bp, Oryza sativa
ccgcagttaagtcagtgtcaataggttgatccggacgccagataaaaaaaaaaaacggaaatgcagcagaagcagcaacgcagcaaaagttctccacaacaagcaaagaaacagccgttcagacttcagagacgtggcacaacatcaatatgccatgaacccatccttccatagtggagcatatataataaaacctgggcctgacgcagagctgtcaccaccaccacaaagcagagaaaaatttgggactgacgaaaacgactcatgatctaaataatggttaggtggtcatcagtgttggtgtgttaacctgacctcttccttctatcacatgctcacaggtcgattaagcactaacaatttctttttatattgcaggcctctgcccctttggtcagtaaaacataagagctgaagaaactggaattcagatgtgcttcgctaatcaggcgaattcaacaacgaaaatgaagtccttggaaattcattgggaactcgcatgagacaattctgaattgttttttttcctgtcatcagactgaaaggcacaaatatttttgttaagaaacaattggagctaccaggagtttatccatagaatgtctgaagcagtgcagggccccagtagaacagtaaaccccgagtggcaagtactcaccaacacagatccactgattgatttgcaaaatcttcatgcgacttacagatgtcaccatgggaggctcaattcaaagcatgctaatgtaaaacatgtggttttccatgacaaataattagagcacacagatttggaatccctttgctaagtgcctctaataccgctgtcaagaaagctgcataccaaccggatgaacagcacggttgaagagaagatggccacacctaacctcgtcgcaaagaaacaaggtcgctctcacaactaacactctctgccatacttgggacgacaaggactcccaaagttcaaaagccaaggtgatttgggtttgactcttactctacttcaagatcctgagttactaacacacaagccaagttaatttgctcctgaaaaactttcttgtatcacaaatcacaatgccaagcttattcctcaatgttctttttttttttgtatgatgacgagttaatcttcatgacaatgccaaagtttatttcttcatcctcatataatcataattccaagatatctttttcttcccaagaggaaattacttggaatgaagcacaactaacaaggcaaggaacaaagggttcaaagaaccctgtaaagaataatacagatgcagatttgcacattgcaatgcaagtatgagcatcaagaacttaagttgagtaacagagcatttcatgatacagtaccatatggagccatggtggcttggagcgcggaggaggaagacgatgatgcggctacttcctgacgggggtgttgttgggagcgtgcggcgagccctcgaagagctgcttccggagcacgtcgtggaggccatcgaagagcttcttcttgacggaatccatggcccattcgaggcgattgagcagctcggtggagttcttgttgtacatgaagaggccattgtagaggtcgaagctgtcgctgcaggtgttgtcgacgaggcggagcagcgtctcgtaccccttggtgttgatcggcgtggaccggagctccagcatggcgagcatccggccgacggtgtgggtgaggaactgcgtctcggcggcgtgcgcgtcgtgctcggcgcaggtcatctccaccatgcggcacccctcccgctcgaagatgttgaggaaggcctcggcgcgggcgcggcgcgcggggcagtcgccgacgcggaccttgtcgaacacgaaggggaggccgtcccagccgtcgcgcgccgactccgggccgaacatggggtgggtgcagatgacgtcgaagtccggcgggagcgagccgaggaggaggttcctggggaactccttgacggagagcacgtcgacgaagagggtgttgcggcggaggcggtggacggggagcgagcggaggacggcctcggcggagaggatggaggtggcgaggagcaccacatccgggtggcactcgcagaggtcgtgcgggtcctggaagtaggacgcgccgacggatgcggcgagggaggagtagtcggagcgggagtgggcgagcagcgtgtggccctgccgcgcgaaggtgcgggcgaggaactggccgaagttgccgaacccgacgatggcgatcttgagccgctgccgctcctccaggagccccgccgcgcgggactcgtagtcgaacggctgggctgcgtcgatggcgcggatggtggtgccgcccccgcgctgcggccgcgcgcggaggggcgccgccgccggagacggagggcggcggaacgcggcggccgaccggaattggtggctcgccggcggcggcggcggctggtggaggcagtgggtggaggtggaagacgacagcatctcgccgcctctcgcgttggatgcttcgggggttgggcttggctcactttgctgcctaccttgctctggagttgtgggctttgggggaaatcctaaatcccaattactagtaattaagtgagctaaatgatggtgattagtcagtcaattaattaattttgtgggctaactgatgaggtgattagtaaattgatcaactggaggacagaacggtgttattcgttgggatggatcatggctgctaactagtagtagagtagtagtaggagtcagtactctaatgctgatagccagattaaagagagagtaaactaatgcaagagagcagcaggtcagtggtgatagccagattaatagagactaagctacaagagagcaacaggtcagcggttggagaactattcggttgagcattttaaacactgtttgcaggggaaagcaaggtgatttgagcttacttgttgacttgatttgagcaagttgataactttttcaatggacgttggtggaagaataagttcttttttttcctaacaggaataagccttgttcagctttgaggtgaagtggtgtccatgttcgcttagcgtttcatttgacagttgtcaaattgcagagtttcttttttgtttttcagtcgactgcaattttggaaaatgaaacacagagttgaatttattttgctgaaaggctcttttagctcttggaaaacatcaacgatgttagcaaaaaaagggcaaaaacctgaaactcaatgtcttggatatgtctatttggtaattggtacagatactaggcataaaagagtaacaaattcgtaaggacctccattacaaatcatgctcagttgagcattatatttatccaggcataaaagagcaacaaattcgtaaggacctccattacaaatgagggcctttattcagtgaattcaaaagataccatgatgccaaacaagatattttttaaattaataaaagtccctcgggtacaagcctacaacaaaaggcacaacaattcttctacagaagacaaaattcagtcacatacattactatcgcatcacaagtcgattagcagctgcagtcaccaaacaccagcaacccgtggaccctggtggccttaagaaaatgaccaagcatatgtagctaatgacatcatataaacggcagagcgatcttctgtggagacatcatgcagattatacaacactgctcattttcttctacgatggcgatgactatagtgccgttcggagtttgaataatcagaagcacttgaatcagagtagtgccagttcaccttcaatgtccttgaatgcttattgctctcataaggccttgattcagtgtactcccgcttatccctcgatctctttgaatgcctatccctgtcatgcgtgctcaagtcagtataggccctcttctcctttgatctccctgaatgcctattgtgctcaggagaacttgagtcactgtagtacctcttttcccttgaccttcttgaatgccgattgctcctagaagaacttgaatcgctgtagtattgctcatccttatgtcccattgagtgcttctcattgtccgaagtactagtgtcactgtagtggtgcttctccctcgatcggcttgaatgcccattttcagtcatatttcttttctccttcctatgctctctcttcggatgcctccttgtatctctatcaacttcaacttctgaatcagatgaagaatatgactcagtgacatctcttttcttcttcctgtgctccctcttcggatgtttccttgtatctatatcaacttctgaatcagatgaagactctgactcagtgatatttcttttcttcttcctatgctctctcttttgatgtcttcttgtatctctaccaacttcaacttttgaatcagacaaagactctggcaggtgtttcttcttgtgctttgatttttgcttgctttttctagcttccacctcagcaccagaaaatgacgaatcagaacaatattctttctttctcttgctccttgatgtcctgttgctcttctcagcttcagagtgtgaagattcctcatgagcagcaggctcagcctgcctatgcttgcttttactcttggagcgtttctttgatttgctagcagaaaagttggaaagaagagctggaatatcacatccaccaagaaatcctgaaatataagaaaccagtataatcagccaatatactagcc

SEQ ID NO: 56497 - DNA, 7891 bp, Oryza sativa
  unsure (1)..(7891): unsure at all n locations
tatccatagtattccacttgatgacaatttcaagagctatcttcagatattaattacccaagcttcaggaaaaaaaagcaactgtagataagttgctatcagcaatcaaattatatgcagttattaaaagggagacaagcaatacaaatggttgacagagatctactacttgcaagtcttgttacaggaagcttatttgaatgtaaattgcaacagggaaaacattttgacaaaaaaaacctaacctcacttgaatcagtctgtgccattatagctgtaagaggatcatcccttttcagtcggctctcctcgttaggcatgatcacatccttcagtgggcattctcggtcaccactctgatgaccatagtttccacaccttaaacatctaacgttacgaacttcaactccaaatggtttaaccctcgcaggagcacctgtctccaacctgagagtacaacaaaaacatattaaatcataaaatgctacttaagagttatctcaaggcagcacaatgatgctctaagcctactcccatctaagtcacaaaagttcccagatcgatggatcgaggaacgtgggacgtcatctttaaaaaagatggaacaagaggggtatacctcttctaaaactatggaacgatagatggaacatgttcctagtttttccggaacgataatccggaacggtgtacccaatttaaggaacatgttcggtgttcctagtttgactccctggattgtgctcttcttttttcatacaaagtcgatagcgcgatggcagatggctcgaagcgacggcaagatcagcgcgatggcttggcactgcgctgccgcggacagcgatggaggagaaaagcgggtgcgacacgcagcgcgcctcaatttctccatcctccccttcacgatggcggcagcagtgcagcgcacgctcatatatgcacctaggcgcgatggcagcgagctgcaaagagcaaaagcagcggtcgtcccatggagcgatgaattctgttcggaaattttggattgcctttcccatattttgctcatcgtagctcgttcctccctcatatcatcctgctaagttcctccattgttcctaccgtgtactggaacgacaacccacccattttcggaacgaagttccgcctagttccagttcctcgatccggagcgaggaacttagctaagttccacgttccctgtgacttagactcccataactcacaaaaatgtaatgaaaatgaatgtcatgtttgatcatttgagattggaaaaaggtgaaaatgaaaataaagtgaaaagggtaattgtttgggtttggaaaaagaaactctgtatgtcatactgtcatgtagtgattgtttcaagattttaacacaaaacaaggtgaaggaagtaaagtaccttggagcatttttcagcacttcaaattcttgttctgttggcaatggccggccaaaaacatcttttggcctgtttttcttatctggacctgcgtgggtcttgtcaagttccttatcaggcctgtattttttttttaaaaaaaaagttaaagaaaatatagagaagtgatatgagcagaagtaatagggttggtagaagcttgataaatgtgaaataattcatgaatcacggcagggaaaaaaatgctacattacattgaagaggtgcttgcagcagcagcactttgggttgcatcaccttcaccagacctcctcttctcatcttcaatttcagctgcttttgcactctctgcgttgtagccaggtgggcggacatacatgaaactcacagctttcattatctccatctgaacttgagaaacagattggatatcgacaaccgtgaatttttcatgggtgacaaaagaagcatgaagacttagataaaagcatacttgttcatcacagcttaacataaaagctcctataaaggatatatgcaacaaacatataaacctcttgtatgcaactagcaatcatcataactagatttctcagtattaaataggtttgaggtccatggtccaagtgcagataaatctttcctcatttctactgtaacttactgacttatgtcccatgctgatacatgtaacaaacatatatttgactttgagggcacaaaagtggggctgcacagtcactggcacgtattatcatcatccatggagcaaatatgacaatgaatagaaagaaatcctacagaaacccatgtcaaacatttaggtaatgtctataagcaatgctaagttgctaacactacttgtcaatggccatatcggatcaaaagcacaagcagattaagctatgatcaaagcagatgatttaggagacacatatacagcaacatagttagctaagaaggtaattagcatatacatagggttccggttccattataccttctccttgtccttcttggagaagagggcggtctggcggaagaactcctgctcctgcgcgaactcacgctgcacctcctcctggcggcgcgcgcggttggcgtggatctgctcggcgatccacttccgccgctggttcgggtaggagagcgggtgccatggcttctggttcaggtacgagtggctccacgccgtccccgccttctccttcagctccacctcccccgccgccatcttcttccctccccccaacccccctcgactccccgtcacctcctcctccatctccggccgcctcccccaatctcgccgctcccgattcgccgccgctcgaactcgattccaccctcctcgctgctcgcaaagcggattctgattctcctcccagccgaggagatgggtttcatgggcttcgtttgatgggccgattcggcggtatgggtcggcccatttaagaggcccgcttcatttccgcgagacctagaaggctagaacactaccagttgagttgactggttcactctctccccatttgtaggctggcggcgcgagacaccgccgcgttggcgcgccgctcacctcgacgccgagatggcgatgtcgtgctcttcctcctcctcctccgtgcgcctccgattgaatctagcgccctcccgccgccgaatcgccgctcccgccaacctccaggtgctccggcgcgtgggagtggcggcggcttcaatccggcttcgtgccgcccgcgccacgggaggtgatgcacggcaaccgttcgaccatgtgcctcgcggcgttgaggaggttggtgagatggaggaggacgaggagcggcggaggcggaggggtctcaagatcgccgtcgtggggtttgggaactatgggcagttcctgaccaggacgctggtgcggcaggggcacaccgtcctggcgcactcgcgctcagactactccgccgtggcggccgagctcggcgcgacgtacttcaccgacgcgcacgatctcgtcgagtgccacccggatgtggtgctcctcgtcacctccatcctctccgccgaggccgtcctccgctcgctccccgtccaccgcctccgccgcgacaccctcttcgccgacgtgctctccgtcaaggagttccccaggaacctcctcctcggcacgctcccggaggagttcgacatcatctgcacccaccctatgttcggcccggagtccgcgggcgacgggtggggcggcctccccttcgtgttcgacaaggtccgcgtcggcgactgcccggcgcgccgcgcccgcgccgaggccttcctcgacatcttcgcgcgcgagggctgccgcatggtggagatgagctgcgccgagcacgacgcgcacgccgccgagacgcagttcctcacccacaccgtcggacgaacactcgccatgctggagctccaaacaactccgatcaacaccaaggggtacgagacgctgctccgcctcgtcgacaacacctgcagcgacagcttcgacctctacaatggcctcttcatgtacaacaacaactccaccgagctcctcaaccgcctcgaatgggccatggattccgtcaagaagaggctcttcgacggcctccacgacgtgctccggcggcagctcttcgagggctcgccgccgttggactccgtctccgccgccgcagccgggtcgccgccggatgacgcaccaatcgatggcgatcttgacagcgacaacgaggaggagcaatcggagtaaatcggtgatcgtggtgtcacgctaactctgacgtcgatctcctgtgaagtcgtggccatggtcccttctcgggtcatttgcaagattcagaagttgctccccactatgaacatcaaatcgcaaatttggcttccttttcacctttcctcgcttcaatttactaccctgttcattcaaactccatgctaaatactccatacaataaaatacttgtattacatcgcgggtcgaatctatacatttttatcttaattttgcgaaatttcgtcgatttgaatacgaatttgtttgattctgaaatgatgaatggagtaataaagaaagtgggttgtatagggggcctaatcgcgttgggcctaattaatcgaagtgatcgcgtaaagtggccgacaggatgaggtagctgggccgtcggtgagattcggcccatgacgtcgtggtctggagcgacacgtatcctccaaccaaccgcaccaatatctctcccattagggtaaggggaggagcggcgatctcgtcggcgacgacgacgtcgaggtcgaggcggtggcggaggagcatggccgacggtcaggaggacgccgcgggtctggacgatgaccttgttctcgaggatgagctgcgaggtcgagaagagggcgaagacggcggcggcggcggcggcgaggaagaggaggaggacgacgtcgacggcctcgccagcttcctcgaatcggagatcctctctggatctagcggcgacgaccctaccggtgtaagttgttctcgatcgatctctcgcgtgattggcttgtgcgaatctggttgtgatttgggggtaattggttgcagcgggaggaaggggatgagaaggagaagcagttaggagatgatgcgaagaacaataagaggaagcaggagtctgaatctgatggggatagcggcagcggggaggagcagaacaagagggtgaggagagcaaaggggaaagagaaggacgtggcgtcggtggcgcctcagatcgatagcggcatgttctgcaatatcccgccggagttgttcttgcagatattcaagttcctctcatcggaggatctcatctcctgcgccctcgtctgccgcttcatgaacgtggttgcgtccgacgagaccctctggcgccgcctgtaagctttacctgaaacttcatttgctccaattttgcatttgttgtaataaaaagaattcactcacatgtttgatccatgtccaataatttcaaggtattgtatgcggtggggcctgtcatgcaataccaaactcagggagtgcgcttggaagaaactctacatccaggtaatccatccgaaacctaccttttcaagctacagttcagatgttgtagtgctgcagttttatggtgaaactaagaatggctacgcaatttcagtaccaattcaagaataaacccaaacagttcaatgtacaaactaaaagttgatatttgttttccttgtgaccttgttgcactcactgaacagaagttcagttacatgttgcaactcaatcattttcgcttgctgctagttgtctgcatcagtttgttgatgttattttcattattcgtaaattccagcaagatagagaggatatggttgagtttgtgagaaatacacctacagaattcaaggagtattatatccagatgcaggcttcaaaaaggagtcaagctccccttccctctgaagtaatcactaattcttatctccattatagtttcccacatagctatggaatcgtattatattgacaagacttaaatgtgactattgtgaattttgaaggtcaacgatgacaaggttattcttgataaaacaatagccgatcaggtgtctagctggaaaagcagcagaggcctcactgatgatgcggtcaaggggcattcttgttctgggaatacatgctcttacacccagattggtgatgcttatatttgtgagaagacaggccgtgttcatggtatgtttgtttttctcagtgtctagtcacatgtgcgcatgtaaatgtagatttgtatacatgtgaaatggttggtttcttctatttttcagtttgcgatgacgcttgtcgtgaatttgtcttggaccagtctagtgggctgctgctttgtacaatatctgggcactgctttgaaaggtggttgtgtcctgatgatgagtgggatgctgatgatgatactgtaagtctattacacatagccttctttttgtatccttcaaataatttggctgtcaacttgttttatcttgactggcatattgttctccatatctgcaaccacttcctccaacattgctaaaattttatgtgtgttattgggggtcaggttatgtacttgttcataaccctttctacttcacaatttgtaggatctacaacaagctggtatgaccgatgaagcagagccatttatgggttctggacgatttggtaatatctttgaacttttctactgtgaaaatttcttcttccaccatatctgaaattatgaagaaattaggcttttggtatcacgatttgaactttaggccatgttgggaaaggtggtggaactactaggcattgttcaataataatataaaaaaatcgtccttgcacaacagcatggccctgtttagatttcaacttttttcttcaaacttccaatttttccgtcacatcgaactttcctacacacacaaacttccaacttttccatcacatcgttccaatttcttcaaacttccaattttggcgtggaactaaacacagcctttgtatcatatttaacctacagagcaaatagccttttgtatgcacatcttccgttttgtttgtacttttatattattggattccaatagtagtgtgtggtgccactgtaccaatcggtgattgtaggctgtgtttagaatgcataagtcgtttgtttcattacattgaattactgacttgtgctctgattctgaacagcacgcgcatatcagttgggttacagctgtgctgatgagaaggaacttgaatatgccttgaggttttgctgataattgggattgcctaatcatactggcaacatgaaaccaagtttttggtttgcaaggganattatggtcagaaggcttggtgctatgttttttttttttttacctagtttaggtttctggtatgttcctatgtgtacaactcacgcacaaatatgagacggctaaaattctgatctgttttgatcagttgaggaagctgtatattgttgtaatcttcctaaattacaaggtgcatgctagtaataaaagaaaccttctgtaatgctcactgtatttgtttttgcgctgtatttgtatcgttatgttctaattgatgtccagcttgcaaagcatcaagtttttagtgtttcagtaatgaacccatgtgtatgtttctgtgctctgttttgtgcgtgtaatgagcgtgcgcctttgtgttctgttttgtgagatcatcatattacctgattgctggtcgacaccagtattacaagaatcaccaccccgatctgtgtggttcatcaaccatgtaagaaaatgctaatggctgtaattaattcttgcggtgaaactagatagatgtcgaaaatgccttggttgaattgaggaatttttttcggttttagatttttttaaaaaaatatttaccagaaataatctatccgccaaaaaaattacaaaaatagaccctgccgcccacctttggggcggcaagctgac

SEQ ID NO: 56498 - DNA, 7879 bp, Oryza sativa
  unsure (1)..(7879): unsure at all n locations
ttattgagttaaatagtgtgtattctttaaaaatttgtttgaataaatgcattatatttttagggtnttagttgtactaatctagaagtgcgtattgtagatatcggtaactacgtagatctgctagtttggaatcaatacattaccgttgcattggcttatacaagaagatattacgttgtagatgtttattgcatgaaagagtaatatgatctagttatttcgttgacagatatgtcgaacaaacaaatatttcaagtttaccatggaccaggaaacgtccgttacgggccaactggggtagatctgtcagattttattgtatcagaaaggggaattgatagatcggctgagaggagtgtaccttctataaaaggatggttaatgaagggcttgagagttgatccacagacaagtgacataacaatcaatgttatagtaagttgggcaactgagggtttttattgggaactaatgccagttcaaaactctcgagtgtggagatggtatttggaaaatgcattgcaacgcgggtggcctctagctttggttccgtttgttcacccgaaggatccaggtgtgcaaatgaacatggatgatggcgagggaccaagtgctgaagtaaacgagacttctgtggaggaggtcaacgcacgagaggacgggggcgtagtagctccagttggcattcaaccaggtggagtggccgacgagggggagactgtcggtgccattgtggatgaaatggagagggaggattctgacaatgagcgtgtagaggaaggtgattcgtcagatgatgagacggatattaatccagcagaatgggctagtgaggattttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtccaaccggtcgcaatatgaagttcggtgtgttaaggaaaaagatggttgtccctagagagtgcacgcgtataaggggaaatggaaggattattggacagtgtcagttgttaccaagcatacatgttttctacctggtgttcagaaataccacagaaacattacttgtgcatttgttgcatctgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaatttccctcaattgaacatcctagcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcctttggcatttgcttttgttgagagtgagaataccgacagctggtactggttcctgaaattggttaaaacaaaagttgttggtatgaggccaaatgtgtgcctgatacatgataggcacgctggcattctgcgagcgatagaagagttgcagtttgggagtatggaacgaggataccccggtgtttgggaagatgtacagagtaggtggtgcatgcgtcatatgggagctaatttcttcaagcaattcaagaacaaagagctcatgaacaagttcaagaggctgtgcaatcagaaccaggagaaaaaaattcaatgagctttggaagagattagatgaattgacagccaaatgcagtgatcagcgtgcagcggctccatcgaccgccgttgctgaccctcctcaagctcttggacctctcccaacggatagtccaacattggttagaaaaactggattggagattcggaaattttctcagtggattctgcatgaaccaaaagagaaatgggccaaggcgtatgacacaggtggtgctagatatggaattatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacatcgagctgtagtgcaaggtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagcaagtaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcagaatcagcagcagatggagctcgccttacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggactgtggacaggtccctcctagcagctttggtcgatcgatggaggccagagatgcacacttttcacttgccgtgcggtgaggtagcccctaccctacaggacgtatcgtacttgttggggctaccgctcgcttgagacgctgttgggccagtgaccacggctgtggactggcaggacgatctgacggcacgtttcgcactagtacagcgtgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctacaggaggaggccgacgagtactcctacagccgatgtttggaggcgtacttgctctggctttttggctgggtgatgttctgtggcggtcacgggcacgccgtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgcagcggctacccaggctcgtgcgccgttgggtctgtccacactctgcaccagggaccaggcgtactggatgactacggttccgatggtcttcgacatctgcgttaagcctcacgcccctttccgcgtgatgcggcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcactcagctagcgactggcccgccaagttggcgacttttgttgaggactggttgctcgcaaccgaggaggtcgtggaccacgagggagagccacacactgaggagtcgtaccaggcctacctatgctggtaccagccacgcacccgtactagggtcaccttcgctcccttggagcagcagccccatgttgcgagcactagagacctctatgccaggcaccgcgaccaggacttcgctcgtgctgtgagtaccctgcattgcaccattcctttatgttttcatgtctttctcttcgtcaaattttacgaatatttacgaacaaattaaccatgcaggtcgacgacatcaaccgggtcgtcattgacggttcaacgacgatccaacgtttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcacatataagtgagccgtttcacttgctgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgtgtcgatgtgtaggtttcgcccagttcgctatgacgcaggccgcccacttttcccaggctgcagggtcagcgtctcaggcagctgtgtcgacctcgcactcagcgcagttctggcagtacaccgggacttcgtcacaggcagccggcacgtcgagtcagggtccaccactggaccatgctgggacctcgtcggaccgcttgctgccttccaccttgctcttcgacatcactgacttcgacttcgcttcaggctcgacagaggacgtcattggcccctcacagctgggaggcgcaccgccggtgcagacgcaggaccaggcgcaggccactcctccgcaggacactcgtgctacccgtgctgtgccaccggatcgtttcacctactcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgataccttttggcgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcatacccaccataccccaccacgttcacatgtcaggggtatcactcgattttttgcgcctatataagtcgccttaatgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccatgaggtattttattatttgcatatgcttattcattccgtatgggcaatcgctttattctttgtaatactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttctttccataaatcctacaacattgggtcgaaggttctttgtttgtccaaatattcttgacgacgatttcatggtaagaatattttgattacatgaatccttattttctcacaacatttactaactttgcttgctttacatctattctttcctccccggaaccaccaaggagatgtcaatacagagaatggatagacaccagaagggttctaactccacctagccgtgttgtgcagcttgaactaccagagcaatacagggttactaaagcgcggtttgagagaggaaagggatcctcacataggggttagctattatcggacaacttggcatattgaaatttctattgtcatgcttccttgtcccattactacatcgtcgttgtgttcaactattgcactacctccctcctagttcgaatctaatatcatctatgtaaccgcaatgcaaatagtcgtatcatgttcaaattgtactactatttcttcatgttacataattctccttgttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttaccaataacataacatagaaaaatcttttgccgtacttttttcatctgg

SEQ ID NO: 56499 - DNA, 2156 bp, Oryza sativa
aaaaagtacggccgcaagctctttatgggcggccaaaattgcaattagccccttgccgccctctgtatgggcggcaagggcctaatcgcaattttggccgacggcggcagacggcgcggtcgacccaccgtctgccacgtcagcttgccgcccaccattagggcagcaggggctatttctgcaattttttcggtcgatagattatttctgtaaatataaaaaaaaatctaaaaacgaaaaaaattcttgaattgagtgcctcggtgcaactgaagcccggaagaacagtcaacaagattgatgggtggggttcaatcttccatttgcacaagcacaaaatgagcatatcctatgatgatagttgtacacatctaacaaatgccagcttatctctgaatactctgctggagatgatgcacaatactctcctatctgccatgcagaaaccatgctaatcttgctaggttagtgagaatcaagctactcatgctacaaacttccacacggccggtcatctggtgtttccctttcatgtaccagatcatgctgaactatgctcttgtatgtgtccttttagcttgcgactttggcaaaggcatgtcctgatgctcactcatttgctgatatttcgcagccaagacatcatcaaatgctttctgaagtgcagcctttgcaaccttgtaaacttctggtgacatggctcctctcattccgtatgtcaaaccgtcgagagagagatcgttgtaccaagcaactaggcgctcaggaaagctaactccagtctccaacgatcgctcgtctggtacaacactactcacagcatccattgtccacctcttcatgatgtattctccggtagattccgaaccccgaccatgaagaagattcttagcgcatgcgtgcataatatcccagcgtagctcaaacttgcaacatggacactctgctttcctgtccagctggttgaaagagactatatagccccggccattttcttcctcactggccacattgtacttgaggataactccatcctcaattttatcagcatgatagcctagcgattcgataaattcctcctgaaatatgtcaaacactgcccttgtatagatggccgcagcctgcctttcaattacagaaggagttttcagggtaggctttgaatatgctgtcacaaagtttgcttgagcttccttctcgaaactcaacgccatcacttgatcaaacctagagataagaacaagcagtggagtcttcatgttgaaatgcgtcttaaaaaacttgttcagcctctcagatctttgcgacttgagtaactctggaaagaaggatcccttctgatacacccaagcccattgctgccgagtgtcatacaacgactgaagccaagtgttctcctcgagattatacttatggatgacatagtcccaccgagcctgaaactcctcaattgtctcagcctcaaagacacattccctcagatcagctttcaggttgatgtgctgtatatacacagcagacaacttctgcttacataggctcaaaatgttccgctggcagaaacgatggcgggtgttgggcaacaccctcgcaattcctgcttccatcgccttacactggtctgtcaccagcagatcaggttggcggccacccattgcagcaagccatgtatcaaacaaccaggtgtatgaactctttgtctcatccatcagcagacagcacccgaatatgatcccctgcaaatgatggttgattccccggaacaccgcgaacggcatcatgtacttggtcttcctgtatgtggtatcaaatgtcactgcatctccaaagctcttgtatgccatccttgcctttgcatcagcccagaacacattggtcacgcaattgccgctatctacctgcatcgcgtagaagaatcccgggctctcggcctgcatcttcctgaggtaatcgagcaaatcttgcacctcggcacgcaccccagctggattcgctctgacgagcctattgcagaaggatggccctccattgggcgccccattgcccactgcagcaggagctccggtgggttcgtccgagggttcggtggcggcttgggtaggttcatccaatgctgcggcgtgctctccggcgagaccatcggactcaccggcggg

SEQ ID NO: 56500 - DNA, 1391 bp, Oryza sativa
gtaagtggaccatagccagtgaggctcaagcccacgttgggtgggctcatgtccggcctgctagcttgggatggtaggtagatcctgggaccacctatacatttgtcgataaattttctcctaaaaatttgacagatataattatagtataatcgtagtgtacactataacttatatgtaattacactgtaacttgcatataactacagtgtaacttgtatttaagtttcacgtaatttttaatcgttaaatctattacaagatttgttttggtgaggaagaaaaaaaaatcacagcacacacatatgtgtaaggatttgttcctacaacctccattttactgaaataacatattacagagagatttttgaaagttacatacacgttacactatagttacagtgtattacatgcaagttacagtgtaattacactatgattgtactgtaattacatctgctaaatttttgggagaaaatttgtcgacaaatatatagcaaaatcgtccttttttataagagaaaaaaagagtcttaggcctgttcactttgatgccattttcaaccttaccaaattttggtaaagttgccaaaaaaagtggctacatttagtttgctgtcaaattttggtaactatataagaaatcctgccaaaatttggtaaagttttttttcatcaaagtgaacaggcccttagtattgattttttttggataatgaataaacatcagcctctatatttacaagtgggcatacacagcacaaagaaaaactcttattgatggttggttttttttttctttgcaaaacgattgcggtgatacttgttggtattgaaatatatttatacatgtttatatgcaaattgaacagattgagaaaaaaagttagttgcaagtgtaacttaaagggtgtaattacaggacgcgaggaaataattattcacgatggatattttttatgtaaatcttatcagtttatcaccgatatggaatgtagcaacctacttttattgggactcaaatttgctgaagattcaacaattggtatttggtagcaatgtatcggtaagctgcttgagatgatttgacgacatgtcgtcattcgctcactggaagtatgggttattgaaatcccctaaatgattcatttatagacctattaatacattgctctcaaactctttaggtagatgccgtaaaattgagaattaggcattcatagctttattattgataaccgttagttcatgatgtcatggttatggataccacatacactacactggccaaggtcacctgtgacgggcccaaaccctcatctttgacggcttcgcgcatggtcagtgatcagtggtcactggtgagtccagtcacctttgacgggtggccg

SEQ ID NO: 56501 - DNA, 4754 bp, Oryza sativa
ttgattgcctcaccggctgtcaggtggtttaattatctgtgggctttccactttgtgttggaaaagtggtgatatattatccatcatttgtatatatagatggatgaatacttgcaggttagcatgactagtttaatgacaccatcagtgttggacagtggatctcatgttcttgctatcctctatgtgcatcatgccatcatgcttcagaattttatctcatttgttgtgagaaaagataattaagtttcaggtcaggcatctcgctcaacgaaatttaatgcaaattcagatggaactgtcttaaatcttaactaatgtatcccaaaaccatttatgaaaatgaaataaacctcctatttggctgagccgctaatcagtttggaatttcagaatgcttactaagtagctcatcagttccatgcctgttttgccttctcttcaacgaattgcagagccgggacagtaaatagcttgcaaattgcaccaaacatgcaaattttgaagcatattaaacatattaatttacataaattgtacccttcttcatgaaatacagcgatgattccttgttgattgagctctgaatgatagataattcactcaattccctcatggctacgcaacagaaggcatcaaaagtaacgctgattgcatcatctatcaccaagtagcagtagtactctgctttgctgacaccatgtacagatgtactcgctccctcacctacatcatcttcagagtttaatgtagttgacagaaaaaaaaaggcttaagtcatccaggcatcacagaaacgccattcacattttttttttgaaaggaaattaagcaccagggtgataaatttccaacctgaacgtcattttttgttgttctttcagatatttcaaccgtttacatatcatcttagttatttgctgtatctgttctgtcaaacttatctctagtttggaattcaggatgctaattatcccagttcatgatttcaagtagatggtgataccatgggtgttctaagaaaaaatgagtttgttctgggacatttgacgtttgaaagttgcagtggttactgccaaaatgagttacttccaatcttgaatgctgacgctactccctccagccaaaacagaagtgccgtcatatagcttgaatatatcaacagtatcatatgaataatcatattagccatagaaaaccatacaaatatgattaatttacagttcgagattgtgtcttgaagaccatatgtagatgtgaagaacagcactcccattatctaaaaaaaaaatgtgaagaacagcactcgttttgctagtatttgcaatttcagggttcaacaagtaagcaatatataccaacattttacagagaactttctacctcttcttggatgaaaaacgcaaaatatcaaatgatcattgaagaaaaactagtaacgtggagcatttggtcaagtagcaagatgatcattgacaaatctctgttccgaaacactagcctccgatcaagaacacatgacgagtgtgcatatatctatcttaatttctcaacccgtggctgctacctactccattgatacatttgatcactcgcataagatgaattgaattctttgcatgacatcaaatcatcaattcgatggctccagtgggcagatcagctttttgagctttgaccatggtgctcattgccggcgaggtcgtaagcctccttcgccgagcgaatgcaagaatccaagaacgaatttattgcagctagaggctcgcggcaatctccctttttaaggggctcatcagctgcggattcttgcacaacacatcgaatttgcattcgcattagcattcgcatcatcgcttgttgcctcagagagaagagagaaagaaagctcgagctctcggctcccatggcggcggcggcgtcatacgcgcacctcgtcctcgctgccaccctcgcgttcctggtgctgagctcgccgccgcagtcagcggcgagccgcgtcgacgtcttgaaggaagtagtagcaggcgagccaccagctgcggccatcgaaccagttgtcaacgatccgtcgtcgtcgccgccgccggcggtggcggcggtggtccacacgtcggagccatggccgccggtgcctccgtcggccccgtcaaacaagttcaactagctcaccagccgctaccaccaggatgtccggtcgctgtgattcggcggacgtcgccggagacgatggccggacagtcaccgtcatttcttgattcagataaaatcataaaaagcttgcatttgagcaagccgtataggtgtttgtgcgaggagtgcttctatgctctactggagagaaaaatcttcagattttagggggcgtctaggcttctagctggttgtgattaaactctgagttcgtcgagaaatctgtaaatcagtttcattttcagttgataatggaagcattttcttgctctctgattctgccttttcttcagttcttaccaaaatttgatactttgattcatctctgtgaagtacttgcattgttgataattgatgtggaagatttttgaaacctcatgtgctcttggagaggagatgaacaagtacatccataattttcagatacagccatctagtttaggtgcaaacattaattacagatacattcatggcgcacgtcaaacgtagcaaaggaaataagaacaaaaaaaataaaaatacagatcttgataaaattaaccggacagattgatggacaacggcatggtataattgggtatcaagagaaaatatcacggttgatgaagtatatatggctatggcgtgcaagtggaggaaggggcatccaatcctgcttccagacacccataaaaatacaatcaacaatatgtagggtgccatcctttggcatattggtgaaataagccaaacggcatatttgcaaacgaaaaataattcgtgaataaaacttttatatgtgtgttcttagcaatctaaaagcaaatgctggaaaataaacttcgatgaaaaaaccccaaaattagctttaaatttaacgttgaaaattcaaattttggctgataagcatatgaataatcgtgacatgtacccacaacccctttgtcccctagcagtccacccctcctccctctcgtttttctttttattttcttttgtaatctcctagccttgggttattgtacagttttttcccctactttaatacaaatacatcccacggggttaaaaaaaatgaaaatatcacggtaagtgatgctttggtaagacaacagcattcagatatgcatatactatgaactcttaatgaaaatataggttagtttaacattcaagaatgtttaccctgacccagccaacggttgggaaacaactacaaacaaaagactgcctaaaatgtcaaaacctaaaaggtacaaaactatatagcataaatatattataaaccgttagggttcgaccagctagaacaccatagccataaataagaagctacgccatgtcatgtgtcaatgtttgatgtctcgactacggtatttggacagtatggggatcgtcggtgctaggatatacgcgagactgaggaaaaagagatggagacagggatttttatacaggttcgggcccctgagctatcaggtaatagccctacatcctgttggctggagccgatgttgctttttattcaccataatcacaccagtacaatatgtggggtagcctatctaactgttgtcgacatggcggtctgaaggtctgactcatagtcgacaacagggtagccttcctcctcgagctcacgcccgacggaatcagagacagtgctagatccctacggccagcctctaaaggtaccggatagggtcgatccaggcgtatctctgatgtcgatattcggcggcttgtcttggcgtatgtaggcttgtatgttgtggcttctggtgggtgttgattgtctcttcatggtgagtgtcgatcgtgttgatcgtcttatatcatgggtgtcttccatggtggttctccctggtgggtgtcgatcccccatggtgggtgtgtccccctgtcctcctaggggggcttgtatttatacccataggtgtccccttgtccaagtagaactagggaaaccaatatggatacaatccgagtagtccttgtcgtttccatgtagaactctggttgtctttccttatccggaactccctccatatccgaaggttgtttccgtataggacatggtatgtggtgggtcctgccgagatttagtcaactactattaggtatgtggtatccataaccatgacagtagcccctgacttcgatgcaaatgaacgaattcatattctcaaccacgcgcagacattggagtaactgttatcgagctcatgtgatcgttctcggtaagtttagagataatgttggacttcctttgtcagcctcgtgcgggcaccgaaagggtttgtctaagtcaatctctaatgtcgaccgagaaagtacagagcgtacgactaagtctcccgtcttgctgtaatcgagaatttggattgaagtcaagaaactttatctcggcgggtacaccatctcttcattccgtattccttgtcaagatccagcaaccgttctcgagcgatcgagaaggcgtagagtctgcgaaggagctttgtcaacatttgtcgtactcgccttagtcgatcttggtgtagaaccatagagacatggagtcttcgtcaatgtcgaataga

SEQ ID NO: 56502 - DNA, 10967 bp, Oryza sativa
tattgttagacataaggtagtactgaaccgacacctgttagatttagtgcaacctcaatgcaacacttcttaatctgtgccacctgccaacctcgcaaagtgaccactttctgtatagttgctcttttggtcacacaaattagattgacgtcataataagcttcatattataatttctgtaacttatcatcagaaataatcactctgttggttcctacctcaatgtgaatatcatcttcactttccttgatacttctttcccttgaaatatcaagtgtgtgtcggctttatactacgaggggaaaactgtatagggaagaactggtgtgcctactgcctagtacaccctagcaaaattaccactccccttaaataccgaacaaagactagacggcaatattgttcagcttgggaatgggctttgtaagtctgtatgccctcaactattcttgctagttttcatcaggacacacattgaatcttagtttggtggcaagccacaaatgacatggcctaacatttgcgtactgtcagttcaattactacaaacttgaaaaatggattaatctgatattctagaacaactttcatatagaaagttttcacacgaaacgcaccgttttacggtttgaaaagcgtgccatgagtatccaaaagttaatccaacctaaggtaacttgatgtaacttgttattgcctacaatttgatgtaacttgttctttccataattcaggttcgcgagtatgtccctgatctcgcagaatcgatagctggcttaatcttatcatccaatgatcaagagttccaagatgagtgcatcgctcttctcggcctaggctcagatcaagatctcacagaaggggcggttagatcctgcatcggtgagaagatgaaccgtatcgtagagatgaatgacaccaaggagaacgtagagcacaacgcaccttatctgttcgagtgcgagaggttcgatgaagattatagcctactggatgaagacgacccagatgaggatatgattttcgatttctagcatttccaattgtctcgtagcactcctaatccagagatctcctatgctgtgagagagctttactttgaccagagaactttataaacactaacaaagactgctctctgagactgtttcctgcctcgtgtaaacaaaattcagacattgttacgtcaaaaattcagaaactgcaagtaattgcccatgtgctgagcatctctttctgttcgttctcgttcatgataatatctgcgttcaataactccatgaagattgtgtatactataagcatttttaaaatagtgccaagtcaaatatttttaattgtgactattaatagaaaaaaataaaaaaaaatcatgtaaaattaatattagtagatttatcattaaacaaactatcgtactatacaattatttgtatttaaaacatattacttttatagatattgttggttaaagtagcatctcgaaaaccgtgtcgaagtccaaaaatacttatattttagaaaggatggatagagtataacattacagacaaattacattatttttgtagaaaattccacaaaatttgagttgaatccttgccttcttgatatcagaaagacgcgtgagggcgtgaggctggatgcgtgtggcctcctgacctcgcgtcagactcagagccccatttgcttttacagaatgtgaagcgtcctcgtctcgtctagtcctctcctcctcctcctcctcactcctcctcctctccgctttcgctttgaccaaacccaaaccacgcgcagcgctcccatcgcccagggcaacgccacgaaacctagccccaccgactcgcctcgcctcgcctcggaatcccccaacaccagagcgcggcggcgaccatggagccctcccccgtcggcggcgggtccgcctccgggtcggtggagcggtggcgcgcggaggcgtcgcgggcgttccagcactacctggatcgggcggcgccgcacacggcggggcggtgggccggcacgctcgtggccgcggcggtgtacgcgctgcgggtctactacgtgcaggggttctacgtcgtcacctacggcctcggcatctacctcctcaacctcctcatcgggttcctctcccccatggtcgacccggagctcgaggcgctcgacgccggcccggccctccccacccgcggctccgacgagttcaagcccttcatccgccgcctccccgagttcaagttctggtatacgatttttcctgattcgcttctgatcctaggcagcaaactggtgtaggtagttggtgatgcgaccgtacaaatgtgatttcttaatgtgaggttttgatcgaaccagctgagatggtttggatcatcaatattcaattcaccgaccaacacatgtgttccactgattaatcggatgatgaggtagtagatggataggcaaaggcttcactatgaatgctaacctacggcttatgcagattccattgggagttactacttaatagggctatagataattttgatatggtaattgcttaggttgtgcatagctggaaagtccgcgatgaatttttctagtggagctattgcattttttgcgtgctcttatcctgtttagttgttggcttgtgatgtactagtacagtaacttttacctgtttgtttttaagttcagatattatattacgtaacatcttcgtcaagcttacaattttttatggaacttagttcatgagctgcttttacacgttgctttattgacacttgttcacaaaacaagaggcacttgctgttttatagcatcgaattttatttcttaaaaagatcaggaatagtaattgcattagtttgtcatgggcacatcatgccactgtaattaaacacttccctatttcgtgttctactgccaatgggtttggtttctttgtgtgcttgtgttggcgtgtctagcaaggcctatttgcgatgcaaatgcaaaatgtcagctatgctaactaatttattttttttcaggtatgccatcacaaaagccttttgtgttgcttttctgatgacattcttctctgtattcgacgttcctgtcttctggccaatacttctctgctattgggttgtgctttttgtcctgacaatgaagcggcaaattgtgcatatgataaagtacaagtatgtcccattcagcataggaaagcaggtgagatcattatgatatgtatgcatagttgatagtgttttcttctgccatttggaagttcagtagttcatactgcaccatatgttaatcttccaagtggccattactttgtgtatttggtcctagtcatgatagctgtcttgggggcagtaaaaattagaaaggccctttatttgcaattgcattgggggcttgtcagagttacatccctagtaccttctgattaagtttgtacttactgcactaagattcaagagtaaatcatatgttatgagtaggagctactggccttgtcttgatatgttttctcatagtgtgatatactcccctctgttcatcaatatcggtgtcaaatattagtgatcagaggtagtatcatagccaagcacatgtaagatgatgacagtaggtgtgtcaccatgagaagacatcgctaaccaatttagatcactgacttgttgcgctacacattttcctttttcctgaaggagttgcactatacaattttttaaatgtacaatatattagcttactgaactacattaattccaatgcagaaatatggtggaaagaaaggcccgggagccagtacgtctaaagactgagacctggattgcagatccctgtgttgctcttgaggcaacatgctggcatggtggttttttggtaccagctactgacagtggatgtacacctccattcgctagtcgagaggagcttaaagagactttgcatcggttgatgaccatttgtgttgtatatcagattcttctgtgcaatgactcgttcatttatagttcttgtgctgtgcggctcttgtgtggacgagtaatgaacctattgagtcaggtgcaatgcaaatcaaaactattggggcttgacatggatttgtactggaattcaacatgctcgtttccagacggggcccttaattactcgcatgttagtaacacatttgttattctatttagagtcctatgaaggttgtctgttttgtgtatgcgcatgagccattcggtaattgttactcccttcatcctacattgagcatccaataatgtctgctataatgtttgtgcaccaagaacaagaataatttaaatcacatcgatcaagacgtcatgtataatatgcacacattctctcctaatgcatgagttggttaaaacacaatgcacaattccactctgcctttagcatgcacacattcttacatgatgtattaattgtgctctaataaaatccttatacatgtgatcaatttgaaaaattaattttagtttttattatatgataatcaatttaaaaagaagggagtactatcttaactgcactaatgattggtggccaagtgatttacaacctctgatgcccatcgtaaaatcccaagctgttttagcctgtgctaagtcaaaactgtcagcctaccaggcagtttgtaactaactgcaaatatggtaaccaacccgctggctgataggcggggccgaccgttcgctccggccccacctgtcagccagcgcatgatctctactcttttttatttattaggaggttgctgcgctgcggaggctgcatgcattagcgcggaaattctcaggctcgccgtcgacgaggaggaggaggaatcgggaggagatccgagatggcggcgagggagacgtcgcgccacgcgtcgctctgcctgtggctcgcgctcgtcgccgccaccctctctctcgcccaggtactcgattgatgatgcttgctcattctgtttatatcattcacattgcccggatttttccccttcaattcttagttgccaccctatcattagtttgccactctccctgatctgatctgattactcgtacgtcactcttctccaatgtgttcgattttctatttgttttagaacttttgctctctctgttttctcttttcaggcggtagaatcagaagccgaattgaccaaggtcaccaccaaggtcttcttcgacatcacaatcaatggcaagccggcaggtttgtgcatcctgactccctgatttcttgagttcaccaaaattttgttattgcctgcttctctggtaataatgccatttatgtatgttgaagattgttcattgtttaatgaaatcttccattatctaaaataatgcgtgtttgattgatgatatgctcattgacgtttagattgtttctacttggttgttataggtcggattgtcatggggctttttggaaacactgttcctaaaacagcaggtataacatcaacctaattacttattgttttcaacttaattgtttttgtctgagacacaaattggtaatggtctctgcatctgctctttgcagagaacttccgagcaatttgcacaggtatttcttcccaaccgtcatactacatttcttcaatgtaatgctaccgatttcatacaaattatttgaaattatacaatttggtcagctatcccaattcccaaacgtgaaaggctatatgtccttttagttttcttctctaaaagtgtcaaatgaaaaggcatattgctcgcatcctttttatgttatactatagggttaatacttattggcatattcggtgttacataagttatttcctttatcactctggggcctgttggtacttactgagcatgccccaagtcatgtactccagttgatttggctactatagttcacgagatttggagagagagatgtccctccaaacattttttttaaagaaaaaattgcaagcgtgttggcgattgaacacgggatatcaggattgaaaccacacaccccttgccactgcactatcaagtgcatctcttggctactatagtttcatgtagcaatctcaacttcacatttatacaggtgagaaaggacttggcaagagtggcaaacctctctcctacaaaggaacgccattccacaggatcatcccaggcttcatgatccaaggaggcgacaccgtgagcggcaatggaaccggctgtgattcgatctatggtggaatgttccctgatgagaacttcaagatcaaccactctgcaccaggtgaactgcttttcttgatatcccagttgtatactactatattactgcacagaaatttcattcttttgagcagcaagtcctcatgtttgatttgctggctggtcattggttcagggttgctgtccatggccaactatgcgaaagatacaaacggatcccagttcttcatcaccaccgtaaagctaacccggtaaacttcatcagctcctgagagctgagaattagttttcgtgcaaattttctttttgtttgctagaaatcttccgatcaaattgtaattttgatcatgacctactctttttgtgttgtttgctactgcaggttggatgggaagcatgttgtgtttggcaaggtgctttctggaatggacgtcgtctacaagattgaagctgaaggcagtcagagtggtactccacggtccaaagtcctcatatcagacagcggcgaactgaagtgatcttccattaacagaagcttaataacgagctgtacttacttaccgtgaattcctatcattggagtatgtgtgcacgtcattagtgccatgcattgtttggagcctgtttctgctgattataatgtgacctgctttgtgtaattgttgtaaaatgagagtgttctctcaatattttcccatggcaattcagattggatatgcaatgcaagcttatatacatgcgaacacaatgtcatattcctctttgatttagattattgagcggattattccatgaattatcaatttgattatgactataaattaaataatttataaaaataaacttaataaatagtttaaaacacgcatttttaagccttgtacaagaaaattctttttataaaaaaaatttaaagcgttgagcaaataatccgtttctataattagaataaggtttagtttgattgtgaagtttggatttttaatggcacgtaaaataagactagactaattaagtattaattatttaaaaattatttgttttttaaataaacttctaaacaaaaagtatttggaaaaaaataaacctttaacagtttagaaagctaaactatgctcacagtaaataacacccaaactaactttcaaactaagcctaagttgaaaagaacaactcgatagaatctaaaatttttatgctctcttgatcgatttatctgcatcaccactccctcatttacacaaaacaacccgcaatcgaaagttacaaaaaaaaaaagcacctcaatgagtgtgattaatgtggagttaaacacgaagatctttgcttgagacagaacccgacactgacatgtagggcccacctgtcaggcagcgcatcgctttcaccctcttggctactatttcttcgtggactcttgggcagagtgcggagaccgcagtgtggagcaacagatctatccatccatcccatcctcgatccttcattcctgcccggcggcgagcgagagagaggcggaggagatccgagatggcggggagcgggtggaggaggatcccggcggtgaggaggccgcccatgtcgcgcccggcctcggtctgcctctggatcgtgctcgtcgccgccaccctggcgctcgcccaggtgctcatccacctcgtccgtctccactctccaccacgcctcgctcctcctcctgcttccccgtatctgcgtgtgatgtgatgcgtgtgctctccgatctgattcgattgtttgtgctcgtgcgctgatttcttgatctgtttgatctgtggatccaattggccctggtgtgctgatttgttagaattttgagtggtgcctctatgtgcatctatgcgtactcacctttttttttttgttgctgtttaggcgaagaaatcgaaggcggatttgactgaggtcacccacaaggtctacttcgacgtcgagattgatggcaagcccgcaggtttgtgttggccccctatgtttagctctactaccatatcagcataatatataagtcttcaggcagaaagaagaaaagatatgcatagtttgatgtgtctagcattagcaaatacggagcagtaacaatttaatttgcattaattgtgtcccaccgttgtgtataagtgacttgtgatgggctgatgtcatatgcagtgattattacagttagagttatcagcatttgagattgacctgaagctaactctattatgatgagaatttagcttcttctattgttgtttatgtttaaggagaaacgttgatgtgatatttgtgtatgtactatttataatgtctttcctgttaatgattgccttactgacatttattattttttcttgtattgccataggacgggttgtcatgggacttttcgggaagactgttcctaaaacggcaggtaccatttgcttatcatttagttaggtaacaggaaattcattgtcatatcacaaatgctaatgattcactatatcttttttttttcctacagagaacttccgagcactttgcacaggtatgctccctgatgatttatactgtttttattacattagatgtgttcattcatcttctgctagagtttccagatggttaatcccatggcaagcttggtagtggcagcatgtagaatttccagcattgaataacactttctttgccactttaacctgaaattatttttgaatgcacaacttttgtgtcattatcaagtttggccaatcaaatatactgttacagttgactagttaaaaattgatgcaaaaatacatcagctcagctgttgtcattattcatacgcaagtgtagaatattatgaaaacccataaaagtatttacttcatataatgagagagatcccattctggacagcgaatagcactacaatctgtgtggtagcattccctgatgcctacttgtggttattatacgtaatctaagtttgggtttgatgtagcgctttcaactttgttgttatacaggagagaaaggaactggaaagagtggcaaagcactccacttcaagggaagtgcattccacagaattatacccagctttatgatccaaggaggtgacttcacacttggtgatggaaggggtggtgaatctatctatgggacgaagttcgccgatgaaaacttcaagatcaagcacaccggaccaggtaattttcgttatttcctgaaccatttttttactacactatagacgcattatttgtgtggtagaccatcaaatcatccttgtttgatttgatctcatgtttatgcaggcctcctgtccatggccaatgctgggagagacacaaacgggtcccagtttttcatcaccactgtaaccaccagctggtaatcgtcgtttcctcactagcctttgtaatcatagcagcactatttctaatttgtactgaagacacttcaatctgttgaaactatttatttgattaggttggacgggaagcacgtcgtgttcggtaaggtgctgtctggaatggatgtggtttacaagattgaagctgagggccagcagagtgggtcaccgaagagcaaagttgtcatcgcggacagcggcgaactgccgatgtaatgagctgaaatgatgtttcactgaagctactgctactgcttctcgttgtagaactgttattagctgctctgttttgctatgcttctaccccgaatctggttggagtaaatttctgttagactataacagcgtgcttatatcgcctcttagttgtgggcgatttggagtgaactagcataaaaaggtcgaaactttacttaagtcgtcttcttgttctaagtcgaattatactttgaagtgacttgcttactgttgagcgcttgatctgcgtctagttcagacgaagatattctagattcattgaactgcaacagactaaaaaaaaaaaacctagatcacgatcgattagatttgagtggattaatttacacaaaccaaccacctcgggtagataaataaaatctgtatgtttcatagattctcactgacacatgaaaccgaggtaattagagagagaattaaggccgatgcaaactggagtaatcctcaaaacagcgtgattccgtgtgccaaaagaggacaaggagagagtcctgggagttagaaccagacacacccacagaccgcatctagaccgcgaatctccgatcgggcggtggatagcacagcatccaggggaaagccgtgtcagacacgcatctggaccgcgaatctcagatcggacggtggatagcaccgcatccggggggaatccgtgccagagacgcatctgggccgcgaatctcagatcggacggtggatagcagctggaggaaagccgtgtgctgctccaacgagcctaataattggcggccgagtcagtcagcctcccgacccatcaaacacaaatagggttagcgagaatcggcggcggcggcggcggcggcgagagcggagagagacaggagggggcaaccgcggcggcggcggcgggggggcgcggagatgacggggaaggcgaagccgaagaagcacacggcgaaggagatcgcggcgaagatcgacgcggcgacgacgaacaggggcggcgggaaggccgggcagaaggaccggctggggcaggacaagggcggccacgccaagctcgagtgccctctctgcaagaccaccgcccccgacatcaagtccatgcagatccaccacgaggcgcgccaccccaagctccccttcgagcccgacaagctcaacaa

SEQ ID NO: 56503 - DNA, 7572 bp, Oryza sativa
cgccgccggtgaggccgccgcctcctcctccaagcccaagcccggcgtccgcggcagcctcaagaagtaaccgcaatcgaatccatcatcacccgaatctgctactactaccgcccgccgccgctcgctccggtgtgcttacttgctgctgcttgctgttttgaattattactactgtgtcatgatgtgccgtgtgatagatgcgttgattcgcgcacatatacatatgtgaccgtgttccgtcgcgtcttcgtcggcatgttttagctatgatgtttagtttatgtgtcactactctatgatgctgtcaatggtgtcaatggatgataatgtttatgtctgtcactgctcaaacaattgctaaatctgagtaaagaaaaaggtgatggctaaatccgtttgctcactcacttccgtttcgtagcaaggatgaattggaaatttgcaattgtgattagctgattattatctttgcggtgtcaagcggcatcttttttaacttggtgatcataggtatcatgtggggcatgttattctgcgctgaacccatgactgatctgcttttagcattggaagcacagtaattaggagattctacctgtttagaaaacatatgttttttttatttcatagttatgcgcctgaaaaacaactgcctcttcacaattagaggtaattgcaacatggaactgatgaaaaatgggcctgttgccctgtataagggagttagttgcgggttgatgaaatcgtggtacagtgttaaaaagaacacttctttcagttctgaattttagatgcacacctcacacggttcagttttctctgtcaaatttcacagttttcctaatgttaggactagtgaactccttaatctccgatatgatctgttaaacatgcagatggctctatgccaagcccttcacagtgagaagttgcatcatttgtttcatgtgatttccactattcgtaggtagttcattgtggttgtcatttagtcatctgagcatggatttaccaatgcagcggtgtgcagatacaaggcattccaggcttctaacttgtcaaaaaaaaaacaagttttgtctatttgattggtacctaaactaaactaccattgaggcttaacaccataaagtgatgttttgcactaatttatagcagtgagatgcctttctaaagctcatggactttagttagtgcagtgcccactggggaggcattgcaatgatgtgatattatggtgcttgaagcatgggggaggcatattatggtgcttcaagcatgggagaggcctttcacttttctttgtatgacatggaatcaggcagtccttagatgaaagtcatgaagctctgatgaagtttttatgtggaaaattttgactactcgaacttctgctctggcaatttggcattagatgaaaatcatgaaactctggtaaattttgtccagattatttggatttgatcagaaccagatgatatgatgtagtgctgcatcccttgaaggttttgaacagtatagtttactgaaatcgagatgccagaaattcattgtgcaatcagagtgttttatataaactacgccgtgagaccaggttgttgcagaacaagaatatgcactagacagtaaggattttgcatacagtgttttcctttatatactttacactaggtaatacaaaaaagtaacagtgtgtactgacaatttacatcacatatataaaacaaatgaagcaacggaatcattactagacagacacaacgaaagcacaatcctggaattctctcttttccttggacagaaactattgtgctctcaagacataaacttgaacaaagcaaagaatacattgggtcccatcatcagagaagaacagctgtcttgccgcaagtaatcaataactcaactctgtttcagattgagttcccaggcctagagaacaacctgctgaagagaaacacaaaaccaagcctaagatcagtcattttggaaaaatctctgcaccaaaataacaaaaaaaaacacgtttccagttcttttgttaattaagtgtggtacaaatatgaattaaatctttgggtagctttaggtgcataacttttcaatattacaaatggaacatcagatggtaacaatatacatacgatctattatgcgataagtagaatcagtaagtaacaagctatttaaggtctacctttaatcactgaagctgttcctactggtgaccaccagtgggctgtaaaaacaactgttgaagctggaggatcactgaccattgttagccaatggcacctccattgatgaaaaaatggctccttgatatgagctcaaaacaatggctattgttcaaacttattttcagcatagagctcagtattctgatattcctgatgatggagatggaacataaaccaactacaaattctaaaagtgatggaaatcttgacgtaggagtataggcgagaactgtatttatacgtgaagtaattctgcagctactgttcaggacagctcatttaaggatcaatggagccagtgaaagaactttcctgtgtcttgggagttggtggatcctcatcctccacaagaagagggtctaaatatccaattgccagtaccctttgcgcctcattgtaacgggcccaggtaacaaggtatagaccagcaatgataaagactcctccaataatgctgaaaagtagaatggaaacatacaacacgtgattatgacattatgtatactttgaagtttcttgaaattctatagtttagaggaccaaaaaggagtttttctaaaatagtatgggagtgaaatgaacaaagcgatattggcaatgttatctgtaaaaaaaacagtttttatcatattttcaccggtattaacaccaatatgaagattatttgtctggagagtatcagaaacaattaataaacacaatgaagagcgactattgtctggaacgagtatcagaagcaactaatgaacgcaatgcagagcgactacagttgaatgaatcccaaatttcagaaaccgtcaaatggcaaagttcaaagaacacatttcgcattattacatgccagaattttccgttataccttccaagatatattggggtaccaagaaatatagttgacaggatggtagaacatgctggttggagtggattgtagagggcaaccagagaaggaccaaggattttgtttgaccaagtcatgattgcgtaattcaagcaagatgcaacaattccctggtgaagcaaaccaataaattcagttagaacatgctagaggaggatcataaacattagcattgcattggtcatacacaagtctatgtaatataagcccaagggaatataaacatgcttacagcatatagaatagcaatgatctcggtcgttgtcaatgcccattcatggagcccattggttgtaactacccctgtcagcaccatgaatacagtggcaaatgaataagagtaagctgttaaggataagctcgcgggatattttatcagcactggagcctgcacataagaaagcaaccctgtcaatagacattctttttccaacaaaaataaagacattttatcaacatatagatattaatcttcaccaaggataagatgttccaaagtttgcatcacctgtatgaccagataagcgcccatcaggaagcagttcccaatgaggcagatgacaccaagattccatgtttctagaccgtattggagcatggccgatgtcaaccattggggcgtgtaagaattgctgctccatgtgccggccaggacattctcacccacaccattggagcctcctcctcctcctcctcccatgccaatcaaggatggacctctatagaacaccatcagcacggctccggagacgcacacagccgtgccaagaaccttgacgatgccgtccttggtgaagatattgatcacctcaacactgcaacacgcgtaatttcactcaattcagttgaaatttgaagccaatgcaacatcaggagtagataattttccaaatcatgaaccaattttacccgacgattgcggctaggaggaatgtgaacaccggtatggctggctggaaggctgcggcgtaggaggcgttggtgaagctgaggcccagcaggaacaggagctggttcccgaagatcctggagaagaagagatcgatcgataagatgagcagaaggagaagaagaagaagaggaggaatcgatgaatacccggtgaagccgaggagagcgaaggaggcgaggaggtgaggggtgagggggcggcgggtgcggcgctcgcggaagaaggcggcgggggcgaggagggcgagggcgacgaggtcgcggtagacgcagaagacgatctggttcatgccgacgttgaggacggacttggtgaggacgtggtagccgccgtaggcgagctgggtgaacgccatggcggcgtgcgcgcgccacgccttgtccgcccacagcagccgcccgctcccgctcacgctccacaccgacgacgaccaccgctgcagcatcgtcatcccctcgccgccaccccgttccctccccatctccggcgaccccgccgccgcgattcctgcctcctcgccgccggttggtgtctcttgcttttgcttgagcttgtcttggaaggcgtctactgactactgctgctgcttttgatccgtttgtttatttatttatttattttgttgattgatgcgtctgagttttcgcttgcgtggcaagttatatattagtagaaaatgtgttgagcgccacgcacgctaaaaggccgggaagaagtcatgcatttttttcattttttttctaaaagaaaatatgaaaccgggagaaaagtcatcagcgttgcttgtactcccactatgtaattcatagttatagaatacgttatatcgatatgtctacatctatactgagatatttttatattaggatagagggattatgtattaatcttgtgtacggcttgattctaagtaatacggagcactaatcatatggctggagtaatggtcttattttttttcttatacttatgtttattagctatttttttagaaaatttttattagtttaagtttgaaattttaatcttaaatttagagttaattttatgggtttttcatcgaagtttatttttcaccctttactttcagatcgctaacaacacgtatataaaagttttatttataaattatttttcgtttgcaaattatgaggccgtaagtatcaatatgtcatttttcaggagaaggttgtcacctggatatcgacatatcgtgactggttttttctcgaccagattttgtaagattctcgattgaggaaaagaaaaatctcaccatacacagggtgggtgcgccactgcttatcgtatctacagtactcccctggcaattcactgcttttttcagttagtaaagagactaccctataatcttttcgtcccaaaatataaaatattttaggtgaatggaacactttatagttttctgtctaaagagtgtcatattcatttcaaatctgtttatcttttgagacgaagaaagtaattggcataggctaattataaaaccatatgagtaacctaaaatacttatagatatcggattttatccattatttcaaaaaagaaacgatgtaacacatgattataactcattaacgcaaggtgttctcagactctatggtagtttcgtttgtgatttatttttttatgttcgagttgtacggtatcatttttatttttcgggtctctgattccgtttccaagagagaaaaaacgattgcataaacattttgaatattttttttgatcattttcattcacagttattgccatggaggaacatgtgagtgagatagttgaacatttccttcttatccagaacacaacttccctggtggtggtggcccttcttctttcatttcaaaaaaaaaaaaaaaagaaaaaaaacacccaaatcaacacagatcgtaacttggtggcgggcgggtgagaggacagcaggttaaattttacattaattttttttatacattaagatagtattaaattttacactgaaacatgtgatacctttccaaacatggtaaaattaccctacattatataaaatatgttctttttgattgggtaaaccactctgtttttcaataaagttaaaaagatcaaactgaattttcaatttttgataaaaatttatttggatttcatcagttttatcaatggatttcgtgaaatccgatgataccacccctgagccgattttaatcactgtcgggattgtgaacctagaggatagagcgcgtgaatgctgagatgaggcgtgccgcgtgcgtggctggttgagagcacctacatttcgccgtgtttatctccctgatgtatcgtccctttcgccttgtgactcgtaccactcatcagacggttagggtgtgtttagttcacaccaaaattaaaagtttggttgaagttggaacgatgtgatggaaaagttgaaagttcatgtgtatataaaagttttgatgtggtgaaaaatttaaaagtttgaagaaaaaatttataactaaacacagccttaatgaatcgagagcggcagcggcagtgaccgcgacgagaagagaacgattgattgattgatcagccaagatataaaggtagagagcggtgaccacgctgtaatatgatgtgataatcagatgctagcattatgtcctgcacctgcactgcagattccgtttcttcgctgccagctaactgttcaaatctttttattttctttttgggtgatggagtttaaatcattttttgaatgaacagtgttcagatccgtatcatatgccatgaactgtagcgattgcgatggacaccgacgaccaaacacacgccggggaggtagggattcagtgtttattattattggtcgtggagagaaatctgtacagctgtgtattgaacatttttgtgtcatgtctgatgtgagtgattctgtttaatggttgatcgctaatactatgtttacagttacattcctgggctgggatgaagaggccgtatggtcacattcgtggagtatgcaatttactttacttacgccgtgtttagttccaaaataattcttcaaacttccaacttttccatcacatcgaaactttcctacacacataaacttccaacttttccgtcacatcgttccaatttcaatcaaacttttaattttgatgtaaactaaacacagccttataagttattttatgaaattattagtaaagataaacagtagtcaagatttgcggggtgaagtcaatcgtaccaatttatctaaaagaatatatagggggtgtattaatgtattacgtagtactattattcatgtaatattagggtgtggtatttgacacgcctctttagctttgaagttcagcaagaaaaatatggtgtataagcataccacgtcaaacataggaaagtccaatattcttttaaggggacacacataaactcactccatatttacatcacatcacgggctgcaggaa

SEQ ID NO: 56504 - DNA, 749 bp, Oryza sativa
cattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttacacttgggaggtgtaagctccgtcggtcgacttggatgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattag

SEQ ID NO: 56505 - DNA, 6222 bp, Oryza sativa
  unsure (1)..(6222): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcttcattgatatcatgacgggacctgatccaaaccagaaccaaaaccatgatgctctggtcatcgaggatccacagattgaagaagtggaagccatggcacatcacccaacgcaaacccatgatgttcagcgatggtcgacgtcaagcgttcgccctcgattccttaacattcctattgcctctgctccacttcccaccacattgaaagactatcatgacatggttgaagacctggtgaacaagcggctgaagcaaatctccatcgagcaaacaccccgaccaatggagagtgagcttgagaagccatatgaagcttggcatgatttagtacctttcctggcagggtggcacccacccaagttccgtcaattcaatggaaccggagatgcaagagaacatcttgcgtactttgaagctgcatgcggcgacactgccaacaacccctctctcctcctccgtcacttctcggggtccttgactaggccagccttccactggtacagtcgccttcccatgggatccattggaaactgggcaaccatgaaggaagtattcaagaagcactttgttgctatgaagaaagatttctctattgttgaactatcacaagttcgacaatggagagatgaagccatcgacgactatgtcatccgcttccggaatagcttcgtgcgtctcgcaagggagatgcatcttgaagacgcaatcgagatgtgcgttcatgggatgcaacaacatcggtctcttgaagtgtctcacgtgaaccaaaaacatttagcgcactcagttccgccgtggcagcaaccaagctcgagtttgagaagtcaccccagataatggagctttacaagaatgcaagcgcctttgaccctaccaaacgctttaacgcaacaaagcctagtggtagtgggaacaaacccaaagttccaaccgaagctaattccacaaaagtcttctccaccgcacctcaaggataggtgcccatgattgcaggcaacgctccacgcttcaagatcttctcaaaaagcagtatatcttccgccgggagttggtgaaagatatgttcaaccagttgatggaacaccgcgccttgaatctgcctaaaccacggagacctgaccaggtaaccatgactgacaatccattatattgtccttatcataggtatgtcggccatgctattgaagattgcatcgccttcaaagaatggctccaaagggcagtcaacgagaaaagaatcaatcttgatgcagacgccatcaacccagactaccatgccgtcaatatggtgtccgttgagcctttccctcaaaaacaaagagaaggtaggcgtgcaacatcatgggcgccgctagcccaagttgaagaccaaattgcaaaaataatactgacgaaagcacccgccactcatgtggaggctagccatggcgacaacaaccgaccatggagtgttgtgcaacggaagcctcaaccattgagctttccaccccgtcgcccacaaatgaagttgtcaccgcatactcacccaacttcaagaagatggctagacccaagtcagcgacgtcctccacctcgatttgtccccttctcagagggagacaagtcttttccccgctggggtcgtgagctacctactttggcgcaatttctgcccaagggttgggagcaatcctcaataagcacaagggaggctatggaggtggacaattccaccccgactccaaacattgctccatgcaatgtcatcctcacctacaatgactccacaagtaccggttccgatgaaacgtttacgggaagggagcgagaaatattccatgctgagttggatccagagaagacgaaggtagaagaggtcaacataagcctgcgaggggggaagaccttgccggatccccactagtccaaagctccaaatgtagacaagcctaccaaggaggcctctcctcctggagaagctccagaaacaaaaactggaagcaaagagaagcctgctgtcgactacaacgttcttgcgcatctcaaacggatcccagcactattgagtgtctatgatgctcttatgatggtgcctgatctgcgcgaagctcttataaaggcgttgcaggctccagaagtttacgaagttgatatggctaagcatcgactctacgacaaccccttgtttgtgaatgagattaccttcgctgatgaagattgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgcccccaacctatataaggagggcagggagcccctctaggggcatgagacaacctgatcgtcagatcaatacacactcggcggattcaaatccccaaacaggagtagggtattacctctcatcgagagggcctgaacctgtctaaatcctttgtctctgcatccatccacttttaggtctcgtgcgctacccccttttattattgccgaattcatgtttcgacagttggcgcgccaggtaagggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccaccggcctgcctccgtcgccgccgactggtgtccccgcctatacggtcggttggtcacaccaccgttgatgggcatcatcatctacaccgccggcctgcctccgttgccgccgagtggtgcctccgcctacacagctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgttgttggatgtctacatcctcactgttggctcaccttcgctgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttccgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgtatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttatgtttgttctgcaggatccagatccagatatgcataaaagggattcatggctttaagcttatctcttacgctctaggaatggatcagtcagaacatcaccaccggccgcctcgtccgccgccgactggtgttttcgcctgcacggttggcctattatgccgccgttgttgggcgtctacgtcttcaccgaccggcttgccttcgccgccaccgactggtgtttccgcctgcacggctggccttttatgccgccgttgttgggcgtctacgtcttcaccgaccggcttgccttcgccgccgccgactggtgtttccgcctgcacggctggcctttatgccgctgttgttgggcgtccacgtcttcaccgaccggcttgccttcgccgccgccgactggtgtttccgctagcacggctgtcctattatgccgccgttgttgggcgtctacgtcttcaccgaccggccgcctcgtccgccgccgactggtgttttcgcctgcacggctggcctttatgccgctgttgttgggcgtctacgtcttcaccgaccggcttgccttcgccgccgccgactggtgtttccgcctgcacggttggcctattatgccgccgttgttggtgtttccgcctgcacggctggccttttatgccgccgttgttgggcgtctacgtcttcaccgaccggcttgccttcgccgccgccgactggtgtttccgcctgcacggctggcctttatgccgctgttgttgggcgtccacgtcttcaccgaccggcttgccttcgccgccgccgactggtgtttccgccagcacggctggcctattatgctgccgttgttgggcgtctacgtcttcaccgaccggccgcctcgtccgccgccgactggtgttttcgcctgcacggctggcctttatgccgctgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccaccgactggtgtttccgcctgcacggctggcctttatgccgccgttgttgggcgtctacgtcttcaccgaccggccgcctcgtccgccgccgactggtgtttccgcctgcacggctggcctattatgccgccgttgttgggcgtctacgtcttcaccgaccggccgcctcgtccgccgccgactggtgttttcgcctgcacggctggcctttatgccgctgttgttgggcgtctacgtcttcaccgaccggcttgcctttgccgccgccgactggtgtttccgcctgcacggctggcctttatgaccgctgttgttgg

SEQ ID NO: 56506 - DNA, 78175 bp, Oryza sativa
ttggtgggcgtctacgtcttcaccgaccggcaccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctacatgattctaccagtgttgattagccttatcttcttcaccgccggtcatctcgtctgctgttgactagtgccctcgcctctacgtctggtttatacagctaccactactgatggacatcatcgttttctgccgccgactcgtgttatgccgccgtcgactggtgcttttatcttcacaactgcgcgtcttcactaccagtttgcttctgttgccgccgactcgtgttcacttcatcacggcgatgcaactttgtcatcatggtagagcgacttcatatttattatcttcggcaccggcaaactctattgctgctacttcgcaagttttgctacttcaccaaccacgacgtctttgtgaacctcaacatctcggcatgcaatgtcgtgttattttactacaacaagtggctctccaacattcatgatttctacttggacatcttcaacacatatcttcaatcaagcaatgactattcgacgacaagaagctacagttctcgactctatgttcagttgtttcccaactaaccaaagagtcgggggctacacaaatacaagactcttaaaattcgacaagctgaagcaatcaattaatcagccaacgagtcaattccaggagtcattatcttcgtctttgctttagagcagagttatcaaccaatcacctcagtttcgacaagatggacaacatcatctactttcctccaagtgaagcatctgcaacagctataacaccaatttgatggattattgtcactgacatcatcaccagcacctctgcttcatcggccctgacatcaactctgttgctaatggatgactatgtcttcgccgacttattatttcactttcacggttgctattgactggatcaccgacattgttatcttcatcaacatcctgtcaagcctcttcaacatagcccactctactgctattgatgggcaacttcgtcattatatttgatcatctatgattgctgcttatcatcattactgtcggttgcgtttgtcgtcgccgactattttctttatcttcatgattggtggatttcgtcatcacctttgatgcgtgtctacatcttcaccgtcggcttgcttttgtcaccaccgaccggtatcctcgccttcatggatggcttattatgtcgccactaatgggcatcttcatcttcttcaccagctgcatcgtctgtcaccgactgattatttcactgccatggctacacaactttattgctgggcgccttcatattcattgctggctgacctgactgttgccaactggtttcttcgcctccacggctatgcaactttatcacttttgattggaatcactatcttcactactaccaatatttttgccacctctggtgggcaatattatctctatgttggtcgtcttgtctctatgccaactgcgtcagctaccatcaatggacaattgtgactacgacagaaggacaagctatatgctcaggggcttactagttcaaacacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatccattttggagtatcccataagggataatcactcagatcagaagctattcatatgagttacgcttggtctatattacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgccaataccttaaaatccttttataccgcagttactcaactttttaggagttggtacaatgcatcttaaaaggtgtcaaacagtaaagctttatatagctgtcccgctgacttttttatataagtcaaggtgctgtttgggtttttaagcaattgattggatacaatatcattgctttttgccacgtaagtgtgtatttttattgaccaatattatggcttaggctgattatatattatggtcattttccaggcggttggtaaatcctttatgagtttatttactcggattttacaccacatatgccatatatttccgggtgtggtgaaaccatgtgtcttttagggacttaagcacatctgttaaagcagtgtgcgcatggcgtatgcccaatactttggaaatttctttattcacagcattcaagcttctttatagttgttttgctatgtgaactttcaaaaatgttatcaactttaggttgtacgcattatattttgccaagcagtcggtatatcacttggatcatattattcggggattcacaccgcatatgctatatgttgatgtcaagtcacttggttgattacaattatcaaaaccactcggttggttagattatttattccttgactatatgtttggttggttcaattaaccacatagttgggggctacacctattaggtgcatctattcgatgcacctgactttatttttcagccctccacagtcttcaaatttggtaaaagtacccgggagaccatggcgaagatgattgaagcactcggctttggagtaatctagttcgagagaagattatattttcgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgcccccaacctatataaggagggcagggagcccctctaggggcatgagacaacctgatcgttagatcaatacacactcggcggattcaaatccccaaacaggagtagggtattacctctcatcgagagggcctgaacctgtctaaatcctttgtctctgcatccatccacttttaggtctcgtgcgctacccccttttattattgccgaattcatgtttcgacaaagataacatcatcgaagggggcgatcacaatcgtcccctctacattgaaggaaacattggttctgctcatcttcgacggattctcattgacccaggatctgctgtgaacattctacccgttcgaagtctaactcgagcaggtttcacaacaaaagacttggagccaacagacgtggtgatctgtggctttgacaaccagggcaagccaacattaggtgccattactatcaagatccaaatgtctacattcagcttcaaggtgcggttctttgttattgaagccaacacatcatactctgctctcttgggacgaccgtggattcacaagtaccgtgtcgtgccgtctactctccatcaatgcctaaaattccttgacggcaatggagtgcaacagtgcatcattggcaacttctcaccatacactattcaagaatcataccatgccgacgccaagtattacttccctgttgaagaaaacaagcaacaacttgggcgaacagcaccggcagccgacatcattattgaacccggcaccgagacaacccctaaggtgagacgcctcattatgccatgctccccaatcattagcgaatcttcatcaaggaatcgcaagaatagtaggcggggaaattcttcttcagcaaccaacctcagcaccaagcttccatttcccgctgaaaccagcacgtctgccccatctactacaccaatattgctcaaagcaagacgctctacctcaacaccgatcaccttgggggcaacctctcgaggaagcaagaaaccgcccaaaagcaacagcgatgtgccaactaccatcaccttacaggcaagacggagtccaagcaaggaagccgcgcttgcacaacaaggagtggtcaagaagagagttgcagagatagagaaggtaaaagcgggtgctcagtgcatgcagcccccagccctctacactttagtttctaccccgttagaggtatgggcaattccagatccatcttcttctacatcccggaccattctctacaaggtcccacaggtacaagagtgtgattctataatcgaattccctaagccttattctgatacagaagaagcgtgcacgaccatgaaggctgagcctagaatggctcgcctattggagaaggcgggcatcaacctacagcgaaacaacaggttgccaccacctccagcagtatgtgaggactggtgggcacaagcggaagagtttatcaagaggagatgtaaagaacaaccaaagtacggtctcggctatatcaacgtagatgaacccgatgatgaagatgaagtatttgaagacgatatatttcattgttgcaccataagtaccactacaataggtgatgctttactccaacaacacccctttgaggttgcagctgttggggtagaagaggagctcgatgttgcaggggctcttaaacaacttgatgacggtggccaaccaaccattgacgagttggtggagatgaatttaggaactaaggatgatccatgccctattttcgttagtggcatgctgacgaaagaagagcgagaagactatcgaagcttcttgatggaattccgagattgcttcgcttggacatacaaggagatgccaggacttgaccctcgtgtcgccacccataagctggcgattgatccccaatttcggccagtgaagcaaccaccaaggcgcttaaggccagagttccaagaccaagtcatcgccaaagtcgatcgactcatcaacgtgggttttatcaaggagatacaatatcctcggtggttagccaacatcgtccctgtggaaaagaagaatggacaagttcgagtctgcgtagactttcgcgacttgaatcgtgcttgtcctaaagacgactttcccctaccaatcacggagatggtggtctattcaacaacgggttatggcgcactgtccttcatggacggctcatcaggttataaccagatcaagatggatccccttgatgccttcgacacggcgtttagaacccctaaagggaacttctactacactgtcatgccgttcgggttgaagaacgccggtgccacataccagcgtgccatgcagttcgtcctcgacgatttaatccatcattcagtggaatgttatgtcgatgacatggtagtcaagactaaagatcgcgaacatcatcaaaaagaccttcgcattgtctttgagcgactacgtcgacaccaacttaagatgaaccctctcaagtgcgcctttgccgtccaatccggtgtcttcctcggcttcgtcgtccgtcatcgagggatcgagatcgagccaaagaagatcaaggtgatacttaacatgccgccccctcgagaactcaaggatctgaggaaactacaagggaagctggcgtacatccgacgcttcatttccaacctctcgggccggatccaacccttctcaaagctcatgcagaagggcacaccctttgtgtgggatgaagaatgccaaaatggcttcgataatatcaagaggtacttgcttaatcctccagtactggcaactcctgttaaagggagcccccttattctctacattgcaacgcagcctgcctcgataggcgctctcctcgctcaacataatgatgaaggaaaggaggtggcttgctactatttaagtcgcaccatggtcggtgctgaacaaaactactccccaattgagaagttatgtttagccctcatatttgcattgaagaaactaaggcactacatgttggcgcaccagatccagctcattgcaagggcggactctataaggtatgtgctaagtcagcctgtgctcactgggcgactaggtaaattggccctgctcatgatggaatatgatatcacttttgtgccgcagaaagcaattaagggccaagccttggcagaatttcttgctgcacatccagtgccagatgactccccactcatcaccaatctaccggatgaagagattttcaccgcagagcttcaggaacagtgggagctttacttcgacggagcctcacgtaaggacgtcaaccccgacggcacccctcgacggagagctggggcgggattggtgttcaaaactccacaaagaggtgtgatctaccactcgttctctcttctcaaggaggagtgttctaacaacgaggcggaataggaggctctcatctttggtcttctcttggcgctctctatggaggtacgtttcttaagagcccatggggattctcagctcattattagacaaatcaacaatatttatgaggttcgtaaaccagaactggtgccatattacacagtggcccggaggcttatggacaagtttgaacacatcgaggtcatccatgtgccacgaagcaaaaatgcgccagctgacgctctggcaaaactggctgcagcgttggtctttcaaggagacaatcctgcgcaagttgttgttgaagaaaggtggctccttccagctgtcctagagctcatccccgaagaagttaacatcatcacgactaattctgctaaagaggaagactggcgtcaacccttcctcgattacttcaagcacggctctctacctgaagatcctgtcgagagacgccaactacagcgacgacttccctcatacatctacaaggccggtgtcctctacaagcggtcttacgggcaagaggtcttacttcggtgcgttgatcggagtgaagccaatcaagttctccaagaagtccaccatggagtatgcggtgggcatcaaagcagaccaaaaatgtaccatagcatccgactggcagggtactattggccaggcattatggcggattgcctgaagacagctaaaacctgtcatggctgccagatccatgacaatttcaagcaccaaccgccggctccgcttcacccgacggtcccttcttggccgttcgatgcctggggaatcgacgtcatcggcctcatcgatccaccttctccaagggggcatcgcttcatcctcgctgcaatagactacttctccaagtgggcggaagctgtgccactgcgtgaagtgaagagcagtgacgtcatcaacttcctcgaacgacacatcatctaccgcttcggggtaccacatcgcattacctccgacaacgccaaatcctttaagtcccagaagatctataggttcatggagaaatacaagatcaaatggaactactccaccggttattaccctcaagcaaatgggatggccgaagccttcaacaagaccctcggcaagatcttaaagaagacggtagacaagcatcgaagggattggcatgatcgtctttatgaagcactatgggcgtactgagtcacagttcgtaccccgacacaagccaccccatactctctcgtctatgggagtgaagctgtgttgccattggagattcagctaccatctctacgagtagcaatccacgatgaacttactaaagacgaacatattcgcctccgatttcaggagcttgatgccgtggaggaagagcgcctaggcgcccttcaaaatttggagttgtatcgccaaaacatggtgagagcctatgataagctcgtcaagcaacgagtcttcaggaagggcgagctcgtactcgttctgcgacgtcccatcgtcgttacacacaagacgaagggaaagttcgagccaaaatgggaggggccatatgtcatcgagcaagcatatgacggaggtgcttaccagctgattgatcatcaaggatcacgaccaatgccgccaatcaacgggaggttcttaaaaaaatattttgtataaaaccctgcgcctcttgttttcttgttttctttaaaaaaacactgtgagcttgccaacgtgcattggccattgcattgtctggtgctccacgttttgttttacaaaatggatgccacatcccacaaaaaaaatcaaaatggctttccacatatcacactgagctggtagaagaagacaaggcaaccttagaacacctctacaggattcaatggatgaccatgacagactgtgcttacaactaaacatccttcacgccaacacacaagtactacgggtgcatatttccgaggaatagcaaaaagacttgattgggttacttcctagtagcaaggtccccacgccttcgtgtccttcggtgtgcttcaaacctatggagataccaagccccagggaagactataggagaagagtaagaaagggctacctacctcaacacaagttgtggttcagtgtgcagccacttgccatccctgtgaggcatgtcaacaagggactttacaaaagaaatgggcctgcaaggattacatagcccacaaaggggaatggttgtcctccaagttctaaggatgccaagatcccagatcaatctcaacaaagtcgtgatgatctcaactcaagaaaacaatccaatatcaatctcaatgaagtcgtggtgtcatgaagccgcgaagcaaaaaaaaaagaagaaacaaaaagatccaagcaatcagtgatctccactgcattctgtcagaagtaggaggatagccattcaccatcctcggcaaaaggaaaaggccactctcacagccgttcccctataaccctatcttaattcagccatacctaattctctcggttcgatgaagcacaataccgggggcatgggactcgtggtggaacctagtgaactgaaaggctagagcatggattttcgctgccttctgaaagtatcaccatgtatgctactcctatacacaagcacactaggaagttaggttgacagggagcaatcgtcatggtcgttcggcgattcccgcgacacgttcttcggcaatcttatctgacgctaccacatagccagtgttcagtgggaaagccaacattttaaaagaaaaatcaacaaaatcattttcttgctaggtttctttctatcaactcacctggtttgctcgactctagcaaccatactctagttttttttctcttttcctctctctttttcctttttgtgatgcagggttttcgcttcacgtcatttggaggcaacataacactctgaagtcgccatcgggctatacatctttcaacctgacaggtcggcatcacaacagtcaagtggtcgcgtccggattgataagatgtttctttcttgggagcggggcggcgcaccaacgcggtcagcgccaagccgtgaaacccttcatgctgatgaggcaggcaccgtgatatatcaacggtctcaatcggtctgataaaatgtcttcaattgtggcatgggtctttttcgctgcgagtaggagacgatttcaagttattttgttggctggcacctatacttggtcccgacaaaattcctttaattattatttgaaggcatgaatcttcgcctcgagacctcaggaggacagcttatacctgaagtcatttttattcttcacctattctcaaagcgctagactttctgaatggtgctactaccccacatgggttgatctattatatgaagcaacttgtacagaaggcaaaccaggaattgatggaagagatcatgcatgcagctgcgtgagtacagaatttgtgcatgacactgtagcatggtgatgatgtgtcgtcctctgattgctcggccacattgccacaagatgggtttgttaaaaaggaattaacttaacaatgcaaactgctggctggccttggctcaatatgttgccgccgtgataatcaacagaagttcatatgtattcatgcacttataaattacagccatatattcccatatatcagctctcgggtcccggcaggatcttcggcgggttctatatgcgacggtggccacatgcacgcagtgccgagtattcggatacagaagggatgatacatattagcaagttgaaaaaaaaatgaagaggacaaaacacaagcactccatatatatcgatgaagacaatatgacagactcaaataataaaacaagtactcctaattaatgggtgcatgataatgccccaactttattcaaagattaaaaactagctagctgatcatctaaattaagagcgcttctaatgtgctttacatgactcgaaaaaaaaatcctaattaaggtaaaccaaggagaagcatatggaggctattctaattcttcgacgtactaccccgaggcgccgattctctacgatatgatagaatggcggccacctctggcggcacggccactgcaaggcgtttcctctcttcagcaagatgccccaaatagaccttcgcctcgtcacgacgctttatcagctgcgtgacgccatcgatggtactatcataaacttgcaggttcttggcggctgcctcctctgattccaaacactggtgctccttctccctcgcatctttggctttcagctcgtgttcctccgcctctttcttccaggtagcccctgcttgcttggacttctgaagatccgcggccacgtcttcacagccactcttgaggaggtcaaggtctggtagcacgtctgaacacgcactctcaagctttgctaaggaagagcgcgcctcgccttcatgagcagctaaagttctcccttcaaaggttaccgggagctctcccttaagacgttgcacaagtgcccccaagtaagacatcaacttctccaagtctgcggggcgtccaagctcgtaactattttcccatgcagcggtggcagcaccaatgtactctatggtgccctccttgttcaggggtttctccatcaaacaatcttggatgctaaatagatcctcctccaccatgtgggcgttgcgacgttcagtaagcgtggactttggaagctccagcgtcggcaattcgtcagtcgccgaactcacagagttaagttggagatagcgaccgcacgtcccgaactcagcaaggtaacgggacgtcttctccatcaactcgttcatctggcaagctgtgtcggatggattgcctgaagtttctacaatgggtatagtacacttttctcagaaaaagcaaagaaagaagaaaatacatcaaaagaaagcaaaggagaatatgacctctattaggagtctaatcatccttaccttcctgatgcttttgagtcgagggtcccggagctgaagcggcatcagccgccggcatcaccggagaagagcggacaggagcattagcagccggcacaactgaaggtacatcgtcaataggtaccggagcaacatcggaagaggcagtagctttaagtccacccaaagcagttgcatgctctatcgtatcctgagttgcaagtatattctaagagacaggttatcaaaccactatgacatagaattttaagagaaaaaaaaagaattggggaaacacggataccttgccagtgccatcagaagaagaagaagaggaggaggaggagtcgctcaactggacagcatcaagctccgtgtcgggaaccacagagcggcggcggcggcggcgatcatcgcttgaagactccgtggatgacaccctctcataaactacggggttttttcctcgcttctcacgcatggtgcggtctagctcggggtgtggagaatcttcaatacgcagaccctttttagaagatttcggcaatggaagtctgtcaggacgagcagttctctccttcttatgacgccagtcacgcaggaatttgattgactcgccgtggcatttgtatcctcctcgatcatctctacggaccgggatcttcgcgatatgctgggaagggtcgtcacccttggtctccatctattgcttgccgccggatcctcccgggagcttatcttcgacagtgtgtctatctcctgccgagcgcctgtcccatgttactcgcctgtcccccgttctctgcccgtctcgcgggacacgctctccgccgccccggtcgctggcgccacgctcgcctgcacccctggatgctccgtcttccctggccatctcaagatggttgcctaataaaaaagtacaggatgatcaagaagcgtcctaattccagcggctaaagaatcgacaatggatatatacctgtgatggagttaaacacctgaggcgccatattgcataatcgatgcacaggcatgaccagcaatatataggcttcatccaaattactcgtaactgccaaggatttggagtcctggccgatgacggtctagctttgtttttctttcgccgcacggccggagataagcttcagcatgggagtcctttcgtcgcatgactaaactctaccggacatgtattgcatgagccaacacgacaccaagttaatttcgctcgctccacgatcaaaatttacttggtggggggcatctgtttgatggtattttggcgattatatgtgtacacaagacttactcatgatggacaaagcaaacaagcagtttgtaagttggctagcttatcatttctatgcaatgctcggccatgtatatacacgcaaatacatgcatgcacaggcagctgggaatatatatacttggattagtatatgtgcatgtataattaaccaataactagccgtgtgaagattggctagtgaggcaatcacgtgcatgcatgcatgtactatagtagacggtcgtatgtgtgtgcatgcctgggtgattaagcaacctatgcatatccaagtgattaatcatgggctcggcccatggccgaagacggtagctgcctacgcaccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagcagagaaacaaagcgaattacaaatcagatatttgacgccaggagaagctaagagataaaatcaaagaaggatatgaacaaataacaaactgatcgatcaagccttatctgcaacgaacttgacgcggaggaaacggcgcgcgaacgcggcgagcaccgaccccagacccctatataaggcgtcgacccctcggcagccaggggcattggcgaactcatccacacattcattcaccaacgcatctagcatccacaagccacccatcatcaacgcatctacccatccagcatcaacacatccatccatcaactctcatcggcgatctatccatcaactctcatcggtgatccatccatcgacgacacgcaccggcggcggcgagcgacttcggccggagtcccggtgtccggtaggagagggcgcgcgcggtgatccgatcatcagcaagcgcaggagaggagcttgatggctagtccaggtaaaagctagcaagattgtttcgttttctttcatctacaacacgcacacatccatgcatagggatccatctgcacgtatcgtcgtcgctggggaagttgcggtggccgattcatctacgcgtcacagaagcctcatcgatgccggtgtctgttcaagctgacgcagtgctacttgtccctggactcgacgctgctaattcaagccgctggtgatgcatctacccgaagctgcgacctcgtcgagataccagacattcttgatttgcaagcttcaccgcactggagcgggctaaccatggaggaggtcgtcgggaagccgccctgccggagcgcgccgaggatcgccggagctgccgccgactgccaagacttctatcagttctcatgccggaggtcaagcatcacgcatggcgtcaaaaccagcggatgatgatggaggcaagtatggctgcagtacagaggaaggacgacgggaggacggcgagccagtgctgttggatggcaacaagctaggtaatgcatgttgattaagttaattattgtggcaacgtggccaaccaatcggaggacgacatgtcatcgctgctacagtgccatgcacaaaccaatgcgtgggctgaagaagtcctgttggtttttcttatttgtcccaaatgagatgccgagctttgattaaatccggccgccgtctacatcaaccatcttcaataattcctccctgattcttctctaatctaatctcgacgcaacagctgtgacgtcaagtcgttcaagctacgcaactccatgcatgtcttcaccaacaatctacatcgacacgttgttcaagaccgacgaggctagacaacggagggtgggcaaccaacaccggcgcacggaccgacgaggccatggatcgctgccggcgctcacacacacacacacacatctacatcatcatcacaaccatgcatggagaacgcgaagcgaacacgacgagatgaccacaagcagcttaatcggaggttctcttgcaggcctagacctatggaggtaattaactgggagcttctcgaggccccaggaaccaggagaccacatcgcacaagtcagatctgtccaatgacatattatggagcgcgcatacatatatattacattgggaatttgtatttatgatcttttaagattaataaagagcatgttccctatgttttgtttacattgtgtatttaggtacactggcacgcccgcacatatatgtatctctaaacaaatgagatctcagatgttattttccaccctaaacagttatatcctaacttagagacggatgatatggaatgaattagaggtagcagtcacctctattataaacttgctcttaggtttgtctcgtttgcctaaaatgatttgacactagcaaattgaatagggttgtgctgaaaaaagaacaattgcacatcttaccctattttgaaggcgaactatcaatgtggtcatatttttttaacaactttacttgtttgatcctacttttcaaaaccaaagatatggtatgaccctattctgttaagaccatataacggtgctaactgaagcccaaaataccacttctgtccttgctcatttgaccatattttcccaaagcttttaattagtttgactagttttgtatggtggaaaattaagaaagatttttttataaattgtgcacttagtgtaggggtttacatatatgtgacaaatttgacttagatttgctagatacttcgttggaggcatcatcgtcaatttgtgtcaagcaatagctaagaagcaatccacattggccatcctccccaccccaggatctgaacctgggtcgttgttggcggttgacctcacctctaaaccctatcccacccctgtcgatcgtctccaccgtcggtgaacccctaggccaccaccattagggctcgatgctcttcctgttgcctagcacctctctgcacagattggtaggccgtcctcgcctactatcccaaccttctctgtgctcgcatttgtggatcttcatcaggccacccaccgctggcgctgtcctccacgcccctaggtctccaccgctcaaggacgtcacatgggacctcaccgatgctagcaccgttgggacatctccgtctacgtctccacccgattggctgctagacttcctccccgcgcactgccagggggcactacggctcatcttcgccacaactccgcttccttccgtgccggcgtgcagctcggcccccttcctcgccagcttgctcctcctagatccccgtcgcccgcgctgcacaacacccactatactaccaccagtcggccttgccactcaccgtttttctccaccagccctcatcgtcggccatcatctactggcggctccctctgctcgggagatgtccctctccttgcacctccgctggtggggacatttaactccatgccacttttaagacgtggcaattaattatttgccactcgttgtctgtctatgacatgtgggccctcatgtgtctatgacatgtgggtccagtggcaaataatttaacaccactcgtaagagtggacctaagctaatcgccacaactcggctccaccggccttacaaagcacccacctctttgccaccggccctgtcaccctcagggtttacattaccgtcggtaaccgcgcggggtacggtaatagaaaaaccacggtaacctccttaaattcaaataaatttaaaaagtaatttgaatttttgataaattttgtccggttaccgcgcggtaaccttgcccccagcggtttgggaaaccctggtcgccctactcggggcgcctctccgtgtcgcataggaaccgaacctcaccccgataatcaccatcgttgtctctcatccttctatgttcatgccgcaccgcctgtgctcctctcctctctctggtttagaccagttgagacagggatagggatagatttttgaggttgggttctattcccttcccgcatttcggtctttcttactccctccgtaccaaaatacctatcattttaagtttttgttgtagcgtttgaccattcatcttatttaaaagattatgaaattattatttatttttatttgtgatttgctttattatcaaaagtaagtatgacttaccattttttatatttacactgtttttttaaataagacgagcgatcaaacgatgtaagcaaaatgtcaaaacaacatctaatttgaaatggatgtagtatattctaattgcatctttttaaatttgttgctaacgtcgtggtcagaataaagtcaaataatagctttgatttttaaaaggagagtcaatcaaacaaagttaatagaacaaggtcattaaaataggatcataggcacatttgtcccttagaaaaaagtaaaggcatagtagccagtaatgcgcgttgggcccctagcctagactagtctccatgaatgcggtgccggtgtttttatttttcacgtttggacggcatttgactctagtgtctgccacctacttactccgtttttagaaactaatttagagtattaaatataactacttataaaactaattatataagtgaaagctaatttgtgagacaaattttttaaacctaattaatccataattagagaatgtttacggtagcatcacataggctaatcatgaattaattagtctcaatagattcgtctcgcgaattagtctaagattatggatgtgttttattaatagtctacatttaatatttataattagtgttgtctagatttattgtactataatatatcacatctagttggtttttatgggaagaagggagtacggtacacgcaagcaatgacacaaacacccctgtcctgtctcaggctctccctcgctcctcttgggctcaaacaagaagtggagcagcagagacaagaggactgattgatgaggccgcaaagcctggctgcctgcctgcttctttcccccactccattaatccaccaccattaatatttcttgcgctagctgcttgcgatctgcgagcactcgcactcgcagctgctgcaacaaaagaagaagacggggagggagggaggatgcgggagatctggagcagcttcggcctctggatgctgctgctgatgctggaagctgtttcccctgcaaagatccacggtcggtaaccaaagcttccatgcattctcctccgagtactcttcgatctactactcctatatcaagtagtactagtagtagtagtatgcagtagtggagtagtatgtgatgactaagtgaacgacgacgacattcagggaaccccgcgaacgacctggtggcgctggtgaacgccaaccggacggcgaccaagctgcctcatctgcgcaccagcgctggccttggctgcatggcgctgcagtacatctccgactgcattggcattggcattgggtgcgccggtgacaacacggtggcgtgccagccccccgaggcccacatcaccgaggtgtacgccgccaactgcggcgtcgagctccccacggtggacgtcatcacgggccgcctcctcggctgccaccgccagcgctccgacgcggaggccgcgctggaggccgtgctctccggctccggcaacagcaccgccgctagagcggtcatccgcggcaaggagcacacccaggtgggcgccgggttcgaccgcgcgcaccgccgcgggcccttcttctggtgcctcctcttcagcagcggcagcgccaactccaccttcctgctcgaggccgccggcaagggcgtccaccagtctcacggctgcttcagcgtccctgacaacactagtctctctctctcctgcagcagcgccgccgccgctgctgtgcctttgctcttcttcatcctcctcctcctcccagtactacaagtttattattagtacttaccggtgtatctcagtgcctgccggtctcgttcctttttctgattccgattaagatacatattttattttgatttgtgttagcatttttttaattattaaatgtatgcttagtaagaaaatggtttttttctaaaatatcaaataaacctattttctaattaaataaatcgaatcctgaggggtttgtcaaaaaaaaaccgattctagcaaaaaaaacgagaaactccatccaatcgtttgtgggccatactaatgaatacggagggtagtagcagtggatatagagggcaacgacctcccccgtttacacgcccaaaccttatctcttcccaagcaggggcgggcccagctataattcaagggtattcagatgtataccctaaaccctatacccaagatttttagacaaaaaataggtatatatactctatagttcatatatgtattcaaaaagttaaagaaaaagacttaaactactcatttgggcctcgttttgccatttctttctctattgggtctaaattttccaccttcctccccctttcactcggcccgtagtctacttgggccgcaactaagaccatttcgaagccaaactcacctgccaggcagctaacccaaaatccccaattcccaaattccctaacctaaccctagctttgcaaggagacgggcggcggggggcgctgcgtgcggcgtgcggtgcggcggcgggcgcggtgtacggcggcggcgagccggcgaccgcggggcagccagccaggcaggggcggctgccggctggacgcactggcgcagcatctcctagggtggcggcggagcgggcgcacggccgtggaggcgtcgacgcaggaagaggaccactcggcttggcgccagggcgcggggcagcggctgactcgtgaggcagcggcgcggcgcggcctgcggcgacagcggcattgcggcgcgacgcgcggcctgctgcgacagcggcagtgcggccatggacgacaagctctacccgcctcgaggcccagcgcgaagaaatcaagtcccgagccccgaggtaacgaccgcaccccccggcgatccttcctcctggtttggtttaatccctagctcctgtctcatgtgaatcccctcggtacttaggttttgcatcaagatttcagtttcgcatgattttctatgtttagcatccatgtgttcctgatcctgatgttggatgaactagtaatgggctaacaacctttttttaattgagattactagcgacttagcaaacatatttctgtgcatcatatatgctaatttgtgctttgtatcataatgtatgaacttgagaagcaagatagggcaacaatagttgaatgattgtttagttacattcattgaaagagaatttttcttgcaaattaaagacaaggacatcatcacttatttccaaaatatcaaacaacgaaaagttgatctccaaactgtaagatttcttcccaatttatcattttctaccctttatgtatttcatatgttggcactttgatatgtttactaattagtattctatatgttaaacaatttcaaatgatgatcaattctatcaatgtgtgaatttatgctcaattttatgctatatacgctatatattatataattattagtttgtgatactatacaagccaattagccaattattaggtttttaggtctatgaacaaattttttttacccctttctatttcgaatacacaagtttaaaatcctgggcccgccactgttcccaagcctctcgcatctctctctcgttctctcgcggcggcgtccagatgtggaacctcgccgatcctcctgccccttccacccctctccccctccctcctgcagtcctgctccacccctcactctcctctagccgtgattttctgcgtccgatgcggcggctgggatgtggcggctgaggcaaaggtttgcggggaagcaggtccattgaagccgacggtggcgtcggatggatgcagcggcagcgaagacagtggcatgctgttttcatggagaaggtggaggtgactgctggatgcggtgccgttggggatctgatgcagatttccttttttttctctattcttggttcttctatgttcttggtacttgctagttcatacaggtgaattaaaatcatttatttttttccctgattggagggatgctatcttttctctgacaaatgtaaaaattagttctttcatctgaattgagagcaattcttttttttttcagattgctgagatgtctcttctttcggcagtgcaaatattcgatttattttgccttttttttctgtcatagatgtctcctgtatgtgttttttcatattgctgagatgttcttctttcggcagtgcaaaaattcaatttattttgccccttttttctgtcatagatgtttcctgtacgtgctgtactagtagtattaattaatggatatagatagcggcagtgttgaccttaatgagggtactttggtattttcactttcgtcctacctcgggaatccaggaatcgatattttccgggacggagggagtacgtaatagacttttcactttacatgttcgtacttaatttctatcttcattccatctcaaaacagaccttcgtcagagagattattacccatcttatttatactaccatcttattaaggaatccatttatattaccatcttatttaaatgtagtagaaatattttgaaagtagtataaatatgaagaggtatagttgtaaaagaaatatgaatataaatgggtaaaattgtaatgtaacctagtacagttaaggtaaagtagtagaaatatgaaggggtataattgtaaaagaaatatgaatacggatgggtaaaattgtaacctagcactcaaacaacattcttgtaaaccaatcatcattggaggggccaccaccgccagcggcgacggcttccttttcctccgcaattccatttatttcttcatgaaatatatctgcacaactgccgctttcacgagaattcatttaaataatacattcagatcgacttgaaaggagagctgatagcatctgattagtctattataccatgaatcaaaatttttctactgtattaaccagaaaccatgcaactataaaatcatgaatcattactactcaacacattgtgcagtagaagtaggcgttaagaagccgaaagaagatcggcgacgtagtgcacgtctatgttgaggaagcattgatcgcagcagtccaaccttctccgtctcgtgtgtttgccttgccgtgctctcacgtcgatcagcaccgcaaaccagcggcgtctctaccgatatctacacgtctaaaggcggaatgccacgcgcggatgtgctagcgcccgcgtgtggctagggtttggctcgggagaggacggctagagtttcttgtgggacaccagtcacatcacctcaagaatatataagtaactgggcctggagacacataagaatcatactcggatccctatccgaattaagtacatattggatcttcatccaattctcttatttcggcctattgagtgtgtgactccgtaggttcatgtacactctgctacaacatggaaactccttttcagtccacgtgtcaacagcggctcctagcagaacatacataaagatcatatcgattgaacctttatatacacttgtatgaaccccttcgcctcacgatatcgattaagctcaaggttaaatatgtaccatcctttaatagctcaatcattcattcgatcttttgatagattatttaacatgtaattgactactcaatcactttggcatggctatgtacttctataatctataacattgaggggcccagagatatctctccataggaggggcacatccatcttgattattctatcccactacatgtttcatagcatacccgaagactacttttataactactaaatcacggagtagcgtttggcagtcctaagtaagctactacatatattgggaatcataataatctcaggtctaaggatttacactaacactaaataagatcactgatggcacgtcatatatagcctctcatgttagatctatccaacaacatgttttccaacatgtgtccacattattaatttggtgcctccataccatgattcataagacatgatcattcaatacatgtgttgatcattaaaccatatttgttccacatatgatatttgattaaggattctttagaaatagcaacatacaacataaaaaggtcacatgaataaatcacatattcattaaccaataatgagttatctatttcaaagttataaatatagtatgtgatgcaatcatctctataattaattgtaaggcatatcagcaacaataacaagatcaacggatgcctatatataccgatcgtttgatgtagccagtccagatgccgtgtgtgatcatgccaaggtcaactgcttttgcgcttttaacttcagtactgttctggatttcgatattacggtcttgtttagatataaagtttggatccaaacttcagttcttttccattatatcaatatgtcatatacacacaacttttcagtcacattatctttaatttcaatcaaaatctaaactttatccaaactttacgcttaactaaacacaacttacatatggccatgcaactcactgtgaaaaacaaagagggagacataatggcgatgccaaaatgatcctcccatcgaggacacggcaccaagcattgcaagaccgctagggaaagagatggagaacgatcggagagtagaatataaggttatgataaaattaatcactgatttaataaaatgctgatacgtcatatcgattcttactggtagcttattttaatcaacctagcaagctggagtggtagtagtatattgcaaacaaaccgacctttcccgtgcaagccagaagcccagaaacagggaaggtaaattccctttctcatccgcataactagcagaagcacaacactagcagatatagatagattgattatagatagaacaaaagaaaccaaatgcgtctggactctggagtctggacgaccttagagaccaacaccacaaaggcaggaggactatattatatcttctgccggtggcatctagcgtaattatacaaacaagcgacgattgaagccagaggctacaaatgaagggatacatcgatctgcactgcactgtctaccatttaattacaagatggcacatcctttctgcgcctttttcttcttcttcttttgctttggaggctggagaaccaccttaatcgcagcatcgaaaactgccttgatgttctgcagttgcaaaggcaaagcagcagcaatcagtaaccatgccaccgcaatggagctcaacgcaacaagtccattttactcccttcaactatatcaccggatcagcattgattcaaaaatcaccggatcagcaatcaaacccctcaactatatttgggctcactattttttgtttctctttataaaagttgtatgttaagtttgtgggatgataaatcgtattacaccatatgtctcaacctttttatatatttaaaagatcactgtttgcacaagttgcaagcacctaacactgattaaacatggagatttaaaaccgcatgtcaattgtcatgaaaaaactgtaaacacaggtcctgttgccgtatgtggagaataaaaaagtgaaatggtattagggagtagagtcccttttactagtttaaggggtgaaccataaaaacctaggccctttggcaaaataatttgagggagtaaaatgaaccctttttcaaaaaagaagaataaaatgtagtacttgctgtgtttttgaactgcattcaatgtatgccgctgcaccaatgagtttcctcagctcttcgccctacattgattagcaaaataattttaatgacttgtgtaacaatgctgggaagcaacaaaaatacaagcaaactaagctttgaatacctgagcagtggaaataggtacagcaccagggtgatctacgaaaaattgcttatcatcccgcagatctattaacagtaacttaatggttaagcaccgccggattacatcaagtacgcaagtgattaataaaagcacaatgaacagaaaagcaaaagaatattgcatttacatgctgaggctaggacatgtttctgaaaactatattgtgtatgattgtatcaggagcaaagtacaacttgcaccaccaaagctgctacatcgaacctgatttctaactccagtaatccaacttaagaacataatctaacaagagcccattttggtcagtgaggactaagtctctaaccacctaacttgcctctaaggccagtaagttgacaaggctgttagctgtacaggctttatctatttataacttgctgttagctgtacaggctttatctatttataacttgctccgctggagcagaaattcaatggtgaacatccattttgagcctttcaaatgttcgctagatgccattttaactgagcatgcagtatgaaaccgtgaataaatagcctacagaggatgtgttcccaggggacaatcctaaaagcccacctgccttgtgagatcaacagaatggaattctcatggtattcaatcatgcagtgtaaggtattggatcgggtcatatgtgcctttttattagcaacttagcatgaaaactagaaatgcagatttatcaacatttagcatttgctgaaggaacaagacaaaatatatttcagaggaattttcttttcttgatcataaatcaataagtgatatgtacaggaccaactggagtataggtcacaggcttaactttggagactagtaaagacccatttgcagggcaggatcgtcaaggtctcaatgaaatacaaacaaaaccattgcatgctcatttgtctctcaaactagctatgatactcaactgtcatagcatgtgaaatgttgctgaggtaatggttaacaatcaagcaaaaaaagaaagcattaatttcaaacattcttagataatggaaatgatttacatctccagctttctaccataagacagccataagtttgttcaaaacaggaaaatgagccataaggtgatgggacaaacccaggcccgtcaacgagggcgtgccaacggagcgtcagcgcagggccccacaaaaatttggggcccccaaatcagagagaccagtacaaccagccagccttagcatatacaactgatgtcatgtgtgtgttcatgtgcatgcatgcgaaccagcttctgaatccttgatcaatggttacgatgcccagagcagctggccgactacctcgtctatcatattagagtttctaatactgaattgttgatactcaattgttgaattgcatgcatgtaatgatcaattgaatatttcagtactcttcttttcaaatcaaattaccatgaatataattacgaatttaaattaaggaccgaatcaaaagtaaatttaggatctcaaattatatttcgctccggggcccccaattcctggagacggccctggacaaacccttaactctcctttattattgactagcattaaaccacatagattttttatccagcaattctaatggaactatgccacccatagtggaataagagactcttagctaccgattccccacaaaatctaaatttgaaaaaaaaaaacattcagcgttagtctaaggatgtcacccaccaaaaaacaaacattcttgatataatgcatgtcctgcaatcctgagggacaccaggtcaccaagcatctacaaatgtcccctgatagcatataacacttcatgtgttacaggtaacatgtttcaaggtataatgccatatattcagtcaaaacactgctgggcagcaatcatgctatcgtcgaattcaaatatcttgtcttccatgaaaccatgttcacatagatttccacatgcaaatattttacatttaaatatgattttcagatatcataagcatatggctttgctgtgaataacagtaaaattgaatttacatatacaaacatgctttcatagagtgttcacagcacacaagcactcaaatgatgagacaatttataggaagacagcaatcaccactcagttaagtgcaacgccaagctgctggtaagtgggagtgaaaatataatagcttaattctacagatatgtgatgctttgcacaaatgctatgcaacaagagttggaagggcataccaagctttgttccaacgagaattattggcacaccaggagcataatgccttaattcaggtatccactgacaacagaaatatatatgtgtcagtgcaagataacaggttgactaagctaaggtacttcatggagagagagcaaagaaagtgggcggcaagattttattgcctttttagaaacattctcatagcttgctttgctgatcagagaaaaggccagcaggaaaacatcagcgccacgatagctcaacgggcgtagcctattgtagtcctcttgtcctgttaaatttgtcaaatttttatttattttgatgaccgtgaaaggtggatgtatataaggaggtttacgcatgcatccattaaaaggaggggaaagtagaacctgctgtatcccacaaccccaagttcacagtgctcccatcgaccacaacatttgcactgaagttatcaaaaacagttggaacatagtcctgtaacatagagatgaagaaatgtcccattaaacatacagtctgccaattaaaaatgcaaagatgcaatacattagatttattttttcgcacaaaacgaaaaggggtagctgagttactgacggtgattgacagaggtcacggttagaatgatacagagctaaaacaaattcaccaacaaagagaaacgtctagaggtcaatggtggcgattagctacggaatgatggagccacggttagtaatagcagacaaaaagtcagacataccgcaacatatatttatgagtttattatttactcctgatagtaatacaacaaaatctggaggtgaagctaaagagtgtatatttagatctgtataaggagtgaatgttggcagctgagaaatcggcaatactatcctaattcctatacctggagaagaaggcacctggatcccgcagagagaaggacgcgtatagaagaataacgttatcataatcatcagtccccaaattttagcaagcaaaaagggaaggaaagctgatctatgtcttctctacacccagtccccagtccccagtcccaagacaagaaaaagaatgtttaccatggagtcgatcagatgcatactcgggcgggcaggaaggatcgagaagaagaaggggggaaagaacggattgcctaccgtggggaaggtgttggaggtgtaggagatgagcatgcaggtcttgcccacggcgccgtcccccacggtgacgcacttgatgaaccgagacgcgctcatctctactctcactcagcacagccagcgcatccggtaccctagatcccgccctcttcttcctcctcagtcctcactccaacgccacggacctcacctcagctgctgcttgctggtgggggtaggaactaggaaggcgaaccagaaccagaagcagaagcagaagcaaaagccgacagacactgagttgcactcaggtccaacaaaaactccactattacattaccttcctttcatccctactagtactagtagaataagataaaacattttgcagagaagcccctattcgatgaacatggtgtgatggcgatcataataacaacaattttcgaccctatttttttattattacatttatactatacgagcctagagaagtaagaatgattgagggattattatttcttcaaaaacatatttttttaataatatatttcattcctaagaaactataaccaattattacagaggtcgtacgatgaatggatatgaattacaaaatcacgggttgattaaaacataagaaagctatttaaaataccaccttaaagattgaggtttttcatctatggttgatgagaatctacataatcattgtttcttcaaaatgacatacattttgtatgattttttttattaggggttacaatctattaacatatcaaaataataaaaaaagagtctccatgttcgctctcacggcctaaaaattctcatattaataaaaaaaataaaaaacgagtccatatagaaatacaatttaaatagctaaaattagaaattaaaaaaatattggaagaagagtccataaaggaatacgatttagacttaattgaaatttaaaatttaaaaaataaaagtatagtcaaagtccatatagaaatacattttagaaataaataaaattaaaaattaaggaatatgggaagaagagtctagagtccatataggaatacaatttagagataattaaaattcataaagtttagagttcataaaggaatttaaaagaattgaaagttggaattaaaaataagaaaaaagtaaaagtagagtttacagtccatgtagaaatacactttagaaagagtttagaaataactgaaatttggaatttaaaaataagaaatattagaagaagagtttagagaccatataggaatacaatttataaataactaaaatttaaaatttaaaataaggcatattgaaacaatattatagagtttatatagaaatataatttacaaataacaaaaatttgaaactaaaaaaatattcaaataggagtaaataatggaacttcgaattaaaaaataaagaatattggaagaggaattcatagtccatatagaaatacaattcaaaataactaaaattcagaattaaaaaaataattgataactatcacgtgtatacaatacaatataaaaattatatattggttagtttgttctacttagtacataatttcaaattatgttgccattctaataataatatatgaaaatatatatgttatttatgtgagaaaatataacagtgctagccgagcaatctgtgcgggccaccatgctagttcagaacaaaatgactatactaacattgttttccaaaaaaacaacatcttgataatcaataggtgatcattatgtcgatcgatgagcatatatctgttaacgtcaaaattggtaaaatccaaagttatcattcgcctagaggaagtatcggcttcatatacctaaaatgggtcgatggatattatcagcctccaatagttggattttttatggattcagttaaggaaattaattaattaaaagaaggttatccagaagaggccgagtttaaggaggatgcggtatgttaatttatctattaattgagcatagtcagttagttttctttttatttcgaggaaagtgtgtttagtatcttttctttatctttaagaaatattgcgtcatgtcaaattaggactcttatcggcctatgggtataactatgtacaccctggatccctgtaatctatctccacaaatattctcagtgcatagctgccctcttttgcaaggttattatcaccaacagaacttggcacctgacgcggggctacatcggcttcgatctctggcgaagaggtaaaccctaagtttcattagccctggtcttgtcttagtcgatatatctctacaatcacaatatgattttaaatagatttgttatatctatcacattagatagattcatcgacttattgagtattaaattatcatgtacaatctcgtgctgcatcggttagttctaacctactagattggtaccgataatctaaatcttgttaagcaaataggtgcatgctaatgtttcatcagaggtttagtcgatcttatctgatgtattaaatttctctttgatggtttttctatcttagttaaatttaatgcatgacaaatttgatcggtatcatctcggcttgtttaaatctattaggcaattatcaatcttatgctgcatcggttaggctcgacctatgaggttgttgttgtaagttatatttatttaagtcagtaggcatcaatcattgtttcatcggggtttcagccgatgagttatttggacattgtttaagtgttctatcggcttatagagattatatacaagttggttttagctgattgcaacaaaagtttcattgattacttaatcatttggatttaatgacatcgggttttcagccgatatatactttaaccatcggattagtatttattcaatcatactattattggtccattggtttttattgaattatattgttgtattattataagttcactgcttgtccaattatctttgtatcatttattcaagtatcagaatctatatcggacatatagctgattgttcaaaactctatcgatatcggctattaccgctacatcggcttattggccaatcgactctttgatcatcgatttatctattttatcatttgcagaatcaaactggctagcacgctcgcatctcatcaataatttaggacctgcactaaaactaagcagatctacatacattaatgttttcagcatcaacaatatcatcggcagtaactaatgtcgaatgaaagcggaagatgacatagaagagtaacttagctataaacagtcatccacccagatttgacataaaacccagtaaaccaatctgataaaaacgcagccaccaagagtatcgcaccaacataaaacctccgatgccattactattccgcccatctgaaactaagttttcaccaggaggatctatcagcatcacctccaagaaggcgtgtggtgcccacggacatcaccgatgtcgatgctcatagcaacgacgacttcagttgcagatttacggtgatttgtgctcgacctcctcctaggctttgagtgacagcagcgacggtgacgggaggtggcttgcaacgggaaggaaggtggcgagttgcgcgcgccggcggcaccttggcccaccatcttcaccagttcgatcggagaggtttacagcagcaatggggtagggcgaatgtgctgattcgaagctcccgtagcccgatggcaactacttgagcaacggtgttgagagcacgccccctagctaggatcgccagaagctggatccggccataaccaggtcgtcgaaaaatacagatagctaagctaattgctatgataagatctttagataggttaccgaacaatatacaaattaatcttgatgcacgcatgtatatatatattgctgttggacacttggtttaattttgaggagcattatattgctggttatagatgctatatatcgtccttgcttagcaatatatcgtgagtaataattgagatgggaaactattaactagtgtttgttggattggttctcgatcgatctgcagagaagcggaggtctattttgatcgatccgagactgagactctgccatgggccatggatattggaaaattaaaattagtaacaaattaaaagatgctatagccattcgacgttatattgttgttgtacataagttgagttgagttgaggccatacatgcagtgcagggatggtgtggtggataagataagatagtgtgatcgatatgatgctagtggaaatagctagctagttgacgcgcctgcagttggctcggacctcgccggcgacgttgttgagggagctcatccgtagcatggagtcgacgaagtcacggaagaaggcgggctgcgacgcggcgtagagcgtgacctgggcgcgcgtcttggggtgggtgagcagcgcctcgtcggaggagagaaggccacggccggagagcagcatccgatagtagaagttgtcgaaggcggaggaggtggggtcgagggaggagccggcagacctggcggtgttgttgggtgggcaggagcggcggagggtggcggcgaaggaggggtgaagcgcggggtcgacgccctgcggctggatgcggttctggaaggaggagcagtgtgcgaagccaagcgtgtgaccccccgacagcaccaccaggtccttggtcgacatcccgcgcccgtggaacgcctgcttcagctggtcgaagctcgccgtcggccccggtagcgccgtcgtcgtctcgctcgccagcgacacgcgcccgtcacgacgacccaccggcacttgccaagaaggaccaccggactgcatgcagtacgtacgtacgtttagtactccatctcatctagctatatattgatatactcctgtatttactacttaatttgattgagggccggccggattaccatggcgactgcgtccctggcggccagcgcgaggatgtcagcgcaggagacgacgccggggcagagggcttcgacggcggccttggcgttgtcgatgacgtagaaggcgtgcagcgacgcgttgggtgggccgtccttctccgccgacatgttccccgacgagtccaaaagcacggaaccgtcgcacccctgcagctagctagcagcttccttcattgatgttaatatatatatattcgaattcgatagagtagctagctagttaccctgacgaagcagtcgtggaaatgcaggcggagcaggccggccggcaccgtgcggtctttggccatggcctgcttcaccgccgccgccaccgccgcctccgccttggggcagctcttggcgtagtagtccaggctcagcgcctcgccgccacccaccagcatcgtcatagtcatcaccacaacgattagcagctgtaccagatccagatgggactgggacgacgccattgctgatgccattgcctgctgctgctctgcatcgatcgatccgtcttagagctaccgtgctgctaattaagctatgtatgtatgtatacctcgttcgtacccactctgctttggctttggagctagctagattattagacaagaataatactatatggtactggaaataataattattaattgtacgtatgtagtatgtatagcaccagcagcatgcggctggtagtggcgatcgagaagagagagctggataatactacattcattcatgactaattctcactgcattgcatgcgctttacaatacagacagagacagacggacggacagacggacagatcatctatctctatacttactcttggcctggcatgctcgcactgcagaatgctcctggcgtagtactactagcttagctgtgttgcattggaaagtgtttgcgatgcacagaaagaaatggagaaattactacccccaccccactcgatattggatccactagagctagaaagaagaaagaaagatgccatacgcacgcatgcatacaaacgcatcgcatgcagccaaggcacgtgccctctgtctctgcgtgctgcacatgctggcatgcactttgctactcctcactctcactcatgggctcatggcagtggcaggcaagcagcatgcagttggtactggaccagtgcaaccatttccaataggattatcatacattaccaaccggctggccatgcatccttgtccaccgtgacccttttttgtgtttcatttgtccatcaattaattcaaacacagcggccgtgcaaatgcaatgcctctctatctgttcgttatatcctagtacattactgtacaatttgttcggtcaaatctacgtcattaaacacatctgtctagatatctgaggcaaccgattccacttgtaccttcgttgctactcgtatctctcttcattcttactctgctagctagctagaaccaattaagcccggattaaccatccattaattctacaggcagcccacctcaaattggcttcgattgaagtcatttctatcaagtgtggctcggcccaattgtccttcatacttgccaagcttagcccactgcgcctttgttacccatccgccgagccaccttataccgaatcaggggtaatttcttattcgacccttttctaaattctatcttaaaattgacgtacactaatttttaaaactcatcaacatacaaatactcccccgtctcatcaacatacaaatgtgtcacatcatcacccattagcaattactcccccgtctcaaaatataacaactttagccctcaagatttgtcccaaaatataacttctctatcaacattctcttcccaaccaatcacaactctctaccatttactttttctacctacctccactactcaacaaatcacaacactgcatcattcacttctacctagtagtactttcttaataaccgtgtccacctctaaaaatatttatattatgggacagatgtagtattatttagaatattttaaatcacatgcaagtgtatcacatcatcacttactagaaattattatctagaatattttaaatatcatgcaaacaaaacataccatttatatttttattgtatttttagaactcaatatgcaaacaaatatcaaatcattatctccacatcattttcacattatttaaatatatacatctaccatttctataatatatacttcatctgtcccaaaatataaactttttgctctcaggatttgtcctaaaatataacaacttctccatcaacattctcttctcaaccaatcacaaccctccaccatttacttttcccacctacctccactacttatccaatcacaacccttcaccatttatttttatctactttcttaataatcacgtccaactctaaaacttcttatattctagaacggagggagtaacatgaattaattcatcacatattccgtagcaaagcgtgtggtatcaactagttttagctaccaatctaaccttactattttgagtttgcttaagactgaccatattccataaaggcaagataacatcgttaactaaaggtaaattgccatttttgctcttagtcatatcaccctgttatatgaaagatttgtttatttggaaacttttgacatatttataacaaatttggcataactttgaaagacttaagacaagtttggcatatttagcttcatttttgtcaaatttgacttcaattgatgcttgcctggccaagccagcaggggttttgcttgtttggtttgccatttccgcccgacaggaaaaggtgttgttgggtttcagattattattgctcacaagtgttaattggcaagcttatacggttgtgctgttgagggctatgtcagggttatgaataccacatacctaatagtagtcgactacatctcggcagggcccaccacataccatgtcctatacgaaaacaacctgcggatatggagagagttccggataaagaaagacaaccagagttctacatggaaacgaccaggactactcggattgtatccatattggtttccctagttctacttggacaaggggacacctataggtataaatacaagaccccctaaaaagagaggggagacaagacaatcgacagacgatcaacacgatcgagacccaccacaatcaacaaccaacacaatacacgagacaacatacaagccaacgtatgccaagacacgccgccggatatcaacttcagggataggcatggctattcccctacggtgtctccggataccgtcaggagagacgaaagcgcttgtggagattatggttaccccatatctacatggcggttatattccagctggatatacggtaccaaatatagatagaatatctttatgaggactcgggttaggttctaaacttgtatgtcaagaaaatacccgggatcctagtcggttacgattgtattttatctgtaattccatattccgttaggatatggattgtactttgtattacggatcccttcccctatataaggagggtccgtgtacctcttggggcacgatttcttttctcccaatcatacaatcaataacacactcggcggaatcatccccggacaggagtagggtattacttcttgaataagaaggcctgaacctgtataaaattccttgtctccaaacccatccacttttctagcttgatagccaccccttttattattgccgaaatcttgtttcgacagttagcgcgccaggtaggggcagcgtcaagttctcgccgactaagtgcgatgggtttcgtttctggcatcgacgacttcgccttccctcccgggcaggcgttcaggttcggcagcctcaacttcatcaccaacgacttcggcaagatctctctccttgactcggattcaaaccagttggggagagaccaggtccccatgcgagagagctcattaggcaacaagacgtcgacgggacagcggtctttcgcacctcccagcagaacgcggttgcagcaatcactctcctcgacaccctcctcaaggaagacgcactcaaccaagccgatcatgttgtcaacatcttgaaccagacgaagaccatgatcgctgccttggttccagccaactccgcaagcacccgcaccccgactggtagccgagtccctcacttccgatcccatgatcatcattagtcaagcctcagaatcaccggtacaggatctactcgcaggagcaggggtcacgacgaacgacctgttcactcgcctcccgaacgtcacagggagcgccgagctgaacggcctcgctctccacctcgccagcgtcccgttgaccttcgcgacacgatcaaccagcaccgtgcagcacgaggtcaccgccattcaccaaatcgctacgacgacgacgtggatggagtagctgccttcactagtgacctgcgtcgagtggattggccagccggctttaagccgactagaatcgagaagtatgacggcaccactaatccagagtcttggctcaccgtctacggactcgcaatccgcgcagcaggaggagacagcaaggccatggcaaactatctacatgtggccctagcggactccgcccgatcctggctccacggactaccccgtggcacgatcggatcatgagcggaacttcgtgatcacttcatcgccaacttccagggcacctttgaacgccccggcacacagtttgacctctacaacgtcgttcagaagtctggagaatcccttcgagattacatccgacgcttctccgaacaacgcaacaaaatctccgacatcaccgacgacgtcatcatcgccgccttcactaaaggcattcgccacgaggatctagtcggcaagttcggacgtaaacctcccaggacggttaagcagatgttcgaaaaagccaacgagtatgccaaagccgaagatgttatcaccgcgtccaaacagtcgggcaccacttggaagccaaagaaggacacgccgaccgcaggggggagtggaagtaacaaccacaaggatcgcaagcgtaagcccgaagaacttgtggcgaccacctctccatcttcccgacaacatccccgcgtcaacaccttcgacaagataatgaactcccaatgtccgcatcatcccaactccaaccacgtggccaaagattgcttcatctacaaacagttcgcagagcaatacgttaaaaacgcacggaaacctgcagacggagatcagggcacatcaaagaagaaagatgatgaaaacgatgccccgactgattttcaagatcatcgcaaagaacttaaccacatcttcggcggacccctggcttatgagtctaagagaaaacagaagctaacagaacgggagatcaatgcggtccagcctaacatgccccaatatcttcggtggtcagagacagcaattaagttcgaccgctcggatcatcccgaccgagtggtccacccggggcggtaccccctggtactagacccagtggttcgcaatgtcaagctccgacggactctcatcgatggtggcagcgctctcaacatcctttttgctaagaccctggacgatatgcagattcctcgcacggaattaaagccgagtaatacacccttccatggtgttattccaggattgtcagctacaccactcggccagatcactcttcgagttaccttcggcactcgggagaattttcgcacagaaaatgtttgtttcgaagtcgctgatttcgagacagcatatcatgctatactcggacgaccggctctagccaagttcatggccgtcccgcactacacctacatgatgatgaagatgcctggtcctcgagggatcatatcactacggagcgacatcaagcaagccgtcacatgtgacaaagaaagttgcgagatggctcaaacccacgagaccactctcgcccacgaagagatccgactggctgcgaccacggcaagcgagggagaagtgcctgcaaccaagctgacaaagaccgaagaaagtgatgccaagacgaaaaagattcccttagatccctccgatcctgacaagactactgtaataggcgctgagttagattgtaaataggaaagcgcgctcatcacctttcttcagaataataaagatatttttgcgtggaaaccatccgatatgcctggtatccccagagaggtgattgagcactctttacatgttaaggaagacgccaaacccatcaagcaacgactccgccgttttgcacaggacatgaaggatgcaattaaggaggaattaaccaagctattagcagcaggcttcattaaggaagtccttcatcccgactggctggctaacccagtcctggttcggaaaaagacggggcaatggcgcatgtgtgtcgattatacggacctcaacaaatcttgtcccaaagacccttttgggttacctcgtattgaccaggtggttgattcaacggccggctgcgagttactcagcttcttggactgttactcgggatatcattagatccgactaaaagaatccgactgcttgaagacctcatttattacgccctttggggcctactactacatcaccatgccctttggattgaagaacgcaggagcaacctatcaacgcataattcaaaggtgtttttcaactcagatcggtcgcaatgtcgaagcatatgtggatgatgtagtcgtcaagaccaagcagaaggatgacctgattgcggatttggaagaaaattttgcaagcattcgagctttcaagatgaaactaaacccggaaaagtgcatcttcggagtaccgtcagggaagttgcttggatttatcgtatctcagagaggcatacaggccaacccggagaaaatcaacgccatcctcaacatgaaaccgccaaactcccaaaaagacgtccaaaagctgactggttgcatggcggcgctcagccggttcgtctcacgactcggcgagcgggggatgcccttcttcaagctgctaaagaaaactgacaatttccagtggggatccgaagcacaaaaagccttcgaagacttcaagaaatctctcaccactccaccagttttggcctcgccacatccacaagagccgctactgttgtatgtgtcggcgacctcccaagttgtgagtacggtcctggttgtcgagcgtgaagaggaaggccatattcaaaaagtccaacgaccaatttattttgtcagcgaggttttagccgactccaagacaaggtatcctcaggttcaaaagttattatatggtgtcttaattaccgtcaggaaattatctcactattttcaaagtcacccggtcacggtagtcacatcgtttccactcggggatatacttcacaatcgcgaagcaaatggacggattgcgaagtgggccttagaattgatgtctttggacatatctttcaaaccacgaacttcgatcaagtcacaagctttagctgatttccttgctgagtggaccgagtgccaagaagacatgccagaggaaaagatggaatattggaccatgcattttgatgggtcgaagaggcttacaggcactagagctggggtcgtcttaatttccccgactggagaaagattgagctacgtattgtggatacatttttctgcgtcccataacgtggcggaatacgaggcgctactccatggattaaggattgcaatttctttaggcattcgccgattaatcgtccgtggagactcccagttggttgttaatcaagtcatgaaagagtgatcatgtctagatgataatatgaccgcttaccgacaagaggtacgcaagctggaagataaattcgatggactcgagctcacccatgtccttcgacataacaatgaggcagccgacagactggccaattttggttcaaaacgggaagcagccccttctgatgtgttcgttgagcatctttatgaaccaaccgtgcccataaaagaagcaattgaagccatggatactcaaggcgtaagcgtgattgaagccgactggagaaaacctctcataaaatttttaaccaaacaagaactccctcaagacaaaaatgaagccgagcggatttccagacgcagcagactttacattattcatgaagctgaactgtacaagaaaagtccatcaggaatactgcagcgctgcgtatctttggaggaagggagacaattgttgaaggatatacattctggtatttgtggtaatcatgctgctgcacggaccattgtcggcaaagcttaccggcaaggttttttctggcctacagctgtgtccgatgcggacaagattgtgcggacatgcgaaggttgtcaattttttgccagacaaactcatttgccagcccaagagttgcaaaccatcccgttgtcctggccgttcgcggtctgggggcttgacatggtcggcccgtttaaaagggcagttggcggttacacgcatctctttgtggctatcgacaaattctccaaatggattgaggctaaaccggtcatcacgatcacagcagataaagctagagattttttcatcaatattgtgcatcggtttggggtacctaatcggatcatcactgataatggcactcaattcactggcggagcatttaaagacttttgtgaatacttcggcatcaaaatttgttatgcctccgtggcacaacccatgagtaacgaacaagttgagcgcgctaacggcatgatactgcaagggatcaaagcacgagtttttgaccgactacgtccctatgctggcaagtgggtagatcagctgccgtccgtactttggtctttacgcactactcctagtcgggctaccggccagtcgccgttctttttggtttatggtgcagaagcaatgttgctaagtgaagtggaatttgaatcactacgatttcggaacttcaacgaggagagccatgaagagggccgagtagacgacatcaaccgactagaagaagcccgagaagcagctttaattcaatcgactcgatatttgcaagggttgcgtcgttatcataattgaaatgttcgatcacgagcctttttagtcggtgacctggttctgaggaaaattcaaacaacacaggatcggcataaattatctcccttatgggaaggaccgttcataattgctgaagtcactcggccgggttcttatcgactcaagcgcgaagatggtactatcatcaacaattcttggaatattgaacaccttcgtcgattttacgcttaggcatttcgtttgtatctttcctctttgactgctaacttcaagtttttcctcgaagttttcagtcagggggctactataataataatggagtgtgatttttatcaattcaatttacttacttgatgtatcattgccctgtttgatttcttggcttagttaatgaggactgaaagttttttaacaacttttgcaggtttaggctcaacaaggtttgacaaaaacttttaagaaatcaggagctaagttaagatatcaagcacagcataaattcatcagtattgtacaaattgtgcctccatcatcattaatcatcaaaattatcggtacattaatcagtattagtcttttcatcatcagaattatcaggaccagtcggtcgaagatcagtgtcctgaaatctctcaactacatcagcagcaattttgtcagccgctttctgcgcatcactgatgaggtcaagagcagcttcttcgctcgtcccgtccgcaaagccatcaatggcatcaacgtcaactctcggataaagggatttggtcatcgccaacgccatacttgctcccatacttccagcttctttgatgttcttgaaatatgtatccgaagcaactctcagcttgtcgaaaatttcaaaagcatcaagtgcactcgggccgttgttattgaagaacatcgcttgaacaattggggcagcagcgttagcaacctcatcccgggctccttcaagttttttgatcttgccaactaggacatcaaattgagcttgagatttgatcttgcggtttgcatcaacagattcacattaataagtcagcatatggaggataatggctttttgaggtattgattgttgataccttcaacttcctttaaagccaggtctctctgtcttgccagctctgccttgtcattttccagagtttggatctgcttctctagttgagatatcttggcagcttgcactacattaacttcggttaatcaggataacagagataacagcacaaatcagttgggcagagtttgcgcaaaccttttgatgagccacttagttcaaaattggattcctagagctcagcaattcgattcctcatatcatgctcattttttctggcaagctcttttgtctcgtgcagcagactcctggtggcttcgagggtcccgagatgagggactagcctctctaaggttgccgttttagcttcgttcctaagatgaatcctctgcaagacagtttaattagcgcctagattaaatggcaaacgagatggttgagatcaggcgccaaagagcttacatttacaatgcgggtggcttggctgagtgcctttttcagcaagcatacctcctcgtcctctttttgcttatttattacgattccttgaggctgcatgttgtcatcccaccacttgaccagaatcggagggcgtgaatcctcagctgcttgtatgcggggaatttcttcttcgtcactgatcattggccctaatgtatccactgacagaggttagacgattgatcagagttatttgggtcgacatagtctcaaacaaagtgttttacctgtaatgatttctggacgaggatgagtggactcggatgcttttaaaggagatctagatctccggtcattgctggcgtcttgtccgtgagggttgtctgcttgggtttcgacttctggaatctcttcgtttacccctgcatccgactggtttccagtcgggggctcctggccagcaccgacttcagcttcggccggctggttcccagtcgggggctcgttgctgggttctacattgtcggttgctggctgattgtcactcggatgatccttagcagttggtccggtttctttggaagaacttgtgtccatgttagtcgggtcagagtctttcccagacgggtctatatcagatggtttcctgcaaatttgattatcagcattattgccgcaatgggtgtgcatcaatacaagagggatcgttatatgagttgcacctggaagacttcctgatctttggcgcggagcgactggatgttttcttccttggagtagtctgttttggtagtttcttggtcgtctctcggtcttcaggcctcctggtggcatcatctgctttgtcgtcgcttataaccagtttcctctttcgagaatctgactggccgattggatcaaaagcacttggttgagtttcagaccgaattcttggtcctccgctcccttgcgtagtttggtggcggggagatcggcgttgagcgattgggggatccgacttcatcaaagcaaattcctaggtgtaatatcctccattgttaactgattcaacaagaaaacaaaagcatacttttgaggaagattgagatgtttgagtgcataccggtggaggagggttgaatgcattgaatggcacaacgggcagcagatgtgaatagctgacaacaatagcgtttgagaagatcttgtacattctttctttcatgaccttaaagtcaagagaatctggatcttcccgatttggatcatgcttgccatcaaactcaaaagctgtgcgggatctctctttgattggagctagtcgacttttgatgaagtcccgagtgatctgttctccttgcaagccttggtccttcagttttagcatgcgttccatcaattccactgcctgagcagcttcatctcccataggcaatgagttccatgtgtcctggtaaactagaggaagacagcagtactcggggagtgcaggctcaggattctgaacatagaaccagtttgcatgccagcctttgtttgaggtcttgaagggcatggagaagtatttttggctcagtgttcccctgagctggaaaccagcacacccaactacgcatggtttgctcttatttggctggggcttgaggaaaaagatgcggcggaacaaggtgaaatgaggcctaatgcccaaaaaagcttcgcaggcgtggataaaattggcaatatgcactatggagtttgggttcaagtgatgcaagctaatcccgtagaagttcagaatcccccggaagaatctagaggttggaagagaaaatccgccatagaagaaatgagcaaataccacgatttcatgtgtgtcgggggtcgggaatgcttcgccgaacgccgggcgccacccgataatctccttcgctggaagaacgccgtgcgccaccatctccttcaggttatcttctgtcacatcggagggcgcccactaactctcgaagctttctctttcttccgccatgaatgtgaactggatggtttaatttggtccgagatatggctggagaggaatggggaatcggagcggtggacacggggagaaatttcgtgaagtttttgaggatggtttggagcagattgatgaaccctagcttcgtcggcatggttctatactgtagcacggagtgtggaatggcgagagtctcggcggggaagacgaagcgacgtttggacttcggtatttttagggtatcgggagtactaatgggcctaggcctgtacagtacttcagcccaattatgttttcagcgtggcccgttgtgatccctagggacttaggcgctttttgctttggcaatatgtgctcacaatgacacggcccgatgctgttaaaatcctttttaacacgattcaataattctttggaattattatgatgcacatgaaaaggtgcccgacagaaaggtgttataccatttttgtaagcttttttaggctacaagagctgttgggttaatttgagatgactggtttattagtagtcattctcctagcatgttatatgcttattttgattatggtaagggttatagcctaggctaataaacttcttaattaccatgatctttatcatatttgggggatcattttaagagtttcttactcggattcctaccaaatatatctatttttggaccttttgagtgtttatcactcggcccttcttgtatttttttgtccttggtatattcaagttgagaggcagtcggctgggtatcttactaagtaccatgcgtgctccgctataaaaccactcggttcttgactatatgtttagtttttcaactaatcacatagtcgggggctacacctaattaggtgcatctactcgatgcaccatgttttattttcgcccttcacagtcttttagcactcggcaagccggagcaagttgaattgaagcactcggattatttgtttcgagcagactattttggtcaactgcgaaggtcacgggggctactgtggagattatggttaccccatatctacatggcggttatattccagctggatatatggtaccaaatatagatagaatatctttatgaggactcgggttagattctaaacttgtatgttaagaaaatacccgggatcctagtcggttacgattgtattttatctgtaattccatattccgttaggatatggattgtactttgtattacggatcccttcccctatataaggagggtccgtgtgcctcttggggcacgatttcttttctcccaatcatacaatcaataacacactcggcggaatcatccccggacaggagtagggtattacttcttgaataagaaggcctgaacttgtataaaattccttgtctccaaacccatccactttcctagcttgatagccacccccttttattattgccgaaatcttgtttcgacagtgctatctctgatctcgccggacacggattcgaggaggaaggctaccatgttgtcaactacgagtcagacctttagactgtcatgtcgataacagttagataggctaccccacatattgtactggtgtgattatggtgaataaaaagaacctccggctccggccaataggatatagggttattacctaacaactcaggggcccaaacctgtataaaaatccctgtctccgtttcttttacctcagtctcgcgtatatcctagcactgacgatcctcatactatgcaaataccagaattacgacatcaaacgtcgacagtggcgcgccaggtaggggactttggtgcttcagggtttcgacgagatgggtttaagagatggattctccaataacaagctactcgacgacttcggctgtggagatctaacccgaccggaacatgtcttccgacgagatcggaaccatcatcgtcatcgacaacttggtctatcgagatcacccaagcctcaagatacgcggcgtaccaaaagatgtcagatcatatgatgtcgaaggagtacgcaataaggtaattggtagattggtttttcaaattgatctactaatttcgtagatatatccggcatatatctacaaaggtacgcaatattttatatacaatttatcgtacctattcagatctatacagtattgtcaggtctatactttattatgtttacctagaggatgtttcttatacaatatctatcgcgcgagtgtttccgacgttaaccaactacggtctaacgctgggggctcgctctgtttttcttctgtataaatcatgcttgtttacggtttatataatacctgatatttacatctactcgttatatcctgataatactagaagatccatgcagttttttgagtacatactcgatattatctgctatatattttgtcttctagaaaatattttttaggaacaattgagcacacgagtaggttgtcgtcgagtacactccattatcgagaacattctcgacaaatgcggagttatcgcacacaacctgccaacgaagaccgacgacctatctcatagcaccagccatggctggactactcgagaaaaggttgttaacggacaattcctcgcgaacgccgtcggcttgatcacccgacatgattgcgaacggacatccggatatgctacaagttgggtgtgtgattcatgctggccacatgatgtgcacatgtaacaaaccaactttagcgcccctataggtgattaagagactcctactcctagttctcgaaccagtaaaacgtagtgatctctcttgcctcacttcaagtggtcgagttacgactactacctggttctcgaccagcggtgtagcgtttctcccactactcccactttaagtcgtcgagttacgactactgcctggtcctccaccagcgatgtagcgtttctcccactactctcactttaagtggtcgagttacgactactgcctagtcctcgaccagcgatgtagcgtttctcccactactctcactttaagtggtcgagttatgactactgcctggtcctcgaccagcgatgtagcgtttctcccactactcccactttaagtggtcgagttacgactactgcctagtcctcgaccagcgatgtagcgtttctcccactacttccactttaagtagttgagttacgactactgcctagtcctcgaccagcgatgcagcgtttctcccactttttccacttctagtggtcgagttacgactactacctggttctccaccagcggtgtagcaactctcctactacctctatttcaacaaagttgacagcaggtacacagtatcgccaagtgttttacctagagatcccttaccacgacgacacctagcgttgaaacctatcttactgtccctttacgccgtcttgacaaggcctccgaggaacctaagggaacttcggctggggacgcccagagccgataaggctttgtcggatcctgtagagacaaaagaccatgtaagatcttgtcgtataagagttctcgccgtgcgtattaaccaagccatgtaatcggaaattgacttttccaacttcacggctgggggctaggatcagtgcttgttcaaccaaggcaggtcaagggtccaagagccttctcctccgagaacgattctctgatgacaaggctgggggctagggagagtgtatgactctacaaactgactgatcgaagtcggtaagagagaagacgctcgtacacaaaacattggttggtaaatttaattcattttcaattttccatacatattataacatgtcatcctttgagcgttcgctcgggggctatttctatttgatattcttttctgagtattgatttcaggaaaattctattcgacattatggaagactccatgtctctatggttctataccaagatcgactaaggcgagtacgacaaatgttgacaaggctccgtcgcagactctacgccttctcgatcgttcgagaacggttgctggatctcgacaaggaatacggaatgaagagatggtgtacctgccgagataaaatttcttgacttcaattcaaattctcgattacagcaagacggaagacttagtcgtacgctatgtacttccttggttgacatcggatattgactcagacaaaccctttaggtgcccgcacgaggctgacaaaggaagtctaaacgttatctctgaactcaccgagaacggtcacatgagctcgataacagttactccagggtctgcggttgagaatataaatacgttcatttgcattgaagtcgggggctactgtcagggttatggataccacatacctaatagtagtcgactacatctcggcaggacccaccacataccatgtcctatacagaaacaacctacggatatggagggagttccggataaagaaagacaaccagagttctacatggaaacgaccaggactactcggattgtatccatattggtttccctagttctacttggacaaggggacacctataggtataaatacaagaccccctaggaggagaggggagacaagacaatcgacagacgatcgacacgatcaacacggtcgacacgatcaacatgatcgagacccaccacaatcaacaaccaacacaatacacgagacaacatacaagccaacatacgccaagacacgccgccggatatcgacttcagggataggcatggctattcccctacggtgtctccggataccgtcaggagagacgaaagcgctatctctgatctcgccagacacgtattcgaggaggaaggctaccttgttgtcaactacaagtcagaccgtcagaccaccatgtcgacaacagttagataggctaccccacatattgtactggtgtgattatggtgaataaaaagcaactccggctctggccaacaggatgtagggttattacctgacaactcaggggcctgaacctgtataaaaatccctgtctccgtctcttttacctcagtctcgcgtatatcctagcaccgatgatccccataccatgcaaataccagaattgcgacatcaaacgtcgacagactagctagatgttaattggagagacaaatctcagcaaggcaacgtacccaaaatccatcttccgggtttctatatacaaattcccaaatggtatgaaagaaggggaaaaaaggaaaagataatggtatgaaagaaattcccaaatgtccaagcatgcccaaactaaatattagataatttcttccagccatatacagcagtactccaatcaacgattatttctccaagtgaccggctcctgtaaccaccagaagcctgacacacaccatgactggagatggcgcgcaagatgaacaaatggcgatactgctgatcaagacggcgccatggaacctgctgatagccaagatggtgcagtgatcaaggaagcacgtgcacgcgacaagaagaagcgcggcgataggaagaaactagagaagaagaaatggatggactacaacacaagggaggcatcaagacagcgtctcaaccaatagaccgacgtgggctacgagatatggttccaaatccccgagtccacgggccggcctgaatgggccaagtgactaggccttaagcatgccagacacgcgcgcgagagagaggatgcgtccgtagtacaaggataaaaccgtaaaaggttaaaaaggatagaacacagactagaattacgcggaggcattggtggcagtggctcgatcctattggatcgagagaaagttgtatgcatattcatctactcttccagttaattgagcgagtcccaagagatttctaacaatctagaatcagagctcgtcagtgtggaaacactcttggctcggttgtaaaattcatgatcaaggattggagatatgctctttcgagtatattccgcgaaaaggcaaattgccttgatctagttgactgagtccggaatgagggattcaggccttgattcgtcatctgcatctcacaaggaagcgatgatgacgcaggatttgagtctggatagcaagttcgatctgctcctgaaaacaactggggagaatgagaagaaaagggtggaggcagaggagagatcttgagcccacttcctggatatcaagagggtggaagagaagtctcaagttgacttccatgaactcaagaaggcggtcaaagtgaggcttcctcaagtggagaagtaggtgggaagttatgtgttggggggctttgagtaccaaggtcgaacacctagagggcaacatgctttgttaggatcagggagacaaggcgtctgccatggcagtcatgaagaaggagtacgacatggattcagcgttcttatagcccacacctctgatccatggtacgtgcaatctaagtcttaactccttgttccttttggcgtagattttagcagatcgtcaatcaagagtatctggaataccaattgggttggccggaagtgtccctcttatgacatgttcacagttcaacggtgacaacctgtagataggggtggacagaataagaccgagaccgagaaagtcggttagtagttcggtcttagctattgaaagaccgaaatttattcgggcaattcagtcattagcctcggttgaccgaagctcaataggccaagtaaaccaaaccctagaggcactcagccacagaggaaccgcactctccctgtctcccacaggccacaacgccgcgtcgccgcctcgcccatccatcgcgctcgagctcacgcagcgtggacccgcggtcacgtcgcctccgcctccatcacaccggcgctgcctccaccctccacctccatcgcgccgctgcgccacctccgccctccagccagcctgcctccacctcgccgccgcctccaacgacatcgagcccacctccgccttgatgccgccatcgcaccaccttcatctccagccagcgcgcctccgcctcggcgcctccatcccgccggccgcctccgtctccatatggcaggtctcggtgtcagcaggaatagggacaacaggagatggcaggattgcatctggtggagatcgacgggatccaatcatgaagcttgatttgccttttcattttttttctctctgaatctttttaatttgctagtcgcgtgtgcaaattctgagatgcttcatctatctattgatctattgagttgcttttttatttgtcgaccaaatatttgatgtttgttttttgtgattttttttgttttgaccacagatcatacatataatcaataaataacatcaacactttatatcaatatatactagcatatatctattagtccacatggccggcaggggtgaatccaaaggtgggtaccggaagggggtcaagccctccttccccgttggatccccatgcaggaggggagaggaagacaagtagggggttagctagaggagcaagaagaaaatgagctccctcaaagtaatcttggatcctttcctgatgaaaagaatacaatattaccattcatccactaatcatcaccttagacatgcaaaattatattgattagttttacttaggtctacatatatagtgaacggggacgaaggatcacttgtgtcccaccagacctgagatggggacttgttctgttgttcccccatttgatttttcatgaagaatcaacttaaccatccctatacgaatggaaaattttcccttgcgaaaacgtggaatagggctccattgacatctctatctttgctagtgaggcccaagtgcacatcaaaagaaggcactagttttttgacatgaatagcaagggtgcgtttggaagttaggttcacatcttctactctctctcgtttttccgcgcatctgtttttaaactgttaaacggtgtatttgttaaaaatatatatatatgaaagttgttgtaaaaataatatcaatctatttttcaaggattttgtaagttaatattcaattaatcatgtactattgagccaccccgttttccgtgtgtataaaggagagcttcccaacccctcctcgcaatacacaccctaagtgaagatttggggtcgtaaggtgagttttgatttggcatattagcaacacgtaaaacaatacaagctattagcgtagattaatcgagcatacaattttttgttaaaaattgtaccatttagaaagcgtgcagccccatcgtttggtatattagagaaaaaaaagcgaaacgctatatttacaaatgaaaaataattcgtgaataaaacttttatatacgtattcttaactatctaaaaggaaagggtgaaaaataaactacgatgaaaaaaccctaaaatcagctttaaatttaatgttaaaaatttaaattttaactgataagaataagtataaataaaaagacgagcagatgctggtgttaacgaaaacgtagcgttattgtttgcttactcttaattttaaaataaataaatctagtatataatataaatatgtacgaagatatttgtttgttttaagagcaagttggcttatagtttatattagagttaacatgtacagtaaatgagctataaggttatctccttttttctcctcctctctctatctctcacatatgcattttatgtatttatcttaaagtatgtgaatagctagctcttgtataagagccaacaaccctctcagttttttaaattctttttcctccacgtaaatttatagttgacttatagcctattattatacttggtgaggaagcctccgaatcgataaggcaggtaagtactgctccagtacgtaaagtccaccttattattggcaccatcgtcatccatccagcaagccaaccggaataactactactgctgctgctgttgcgttggagtaccaaaggaggaggaggaggaggaggaggaggaataatcttagagtctactagactcacacactagctttagcttagctaaaagaagaaaaagaaaagagaggcacaataataggttaggcatggcggagcagctgggcggcgtgggcagcccgcagctaagcctgagcagctgcagctccttcctttccatctccagcgccggtaccagcgccgccgatggtgctccccatctatccctcggcgtgggcggcgccgaggagctggatctgctgctgcaggtgggcataggcggtggcggtggcggcggcggcgacgaggaagaggaggagcgcaagaccatccggatgatgaagaacagggagtcggcgctgcgctccagggcaaggaagagggtaagaacctctaatccatttcctcatactatctagtatagtactagctactctattaattaatctctcggatggatagatggagtagtatttggttccacactagtactagttagctaattgcatgagcttaattatgtgcgcggatggatgtataggcgtatgtgcaggagctggagaaggaagttcgccggctggtgaatgagaatctcaagctcaagaggcactgcaaacaagttaacttcgtattcccttccctaatacttttattactaataagtcgattcatcactctacatttccaatccatcttttatgtatatatatgtatgtgcatagaatcctttgattttactacaggtatattgtaataataatgcactatatcctatgcagcttaagacggagatggctgctctgatccagcagcctaccaacaagcagagttcccaccgaagaagctcatccacttgatcagaacgcagcagcttaagcctttaattaattaagcataggcaaggtagcgggcagccattggattggggaccattatttaattgggttggctgtccagctccagcaagagtctctagcaagtaacaacaactcactctgatccgccggcttggctttccatgcattccggtagtacgtaagtactctattttgttactgtgtcgatcatccgctacacatggatgcatacatgcatgcttaattgtttgtgtcaccggctaacttttgcatacccttgtttgcttgcttgctgcaagacccaaattaatataaattgtatgagactcggattagctgctatcaattgctccatccgttccataaaaaaacgaatctataaccgaatgtggcatattctagtactatgaatctgaacatatgtatgttcagattcgtagtattagaatatatcacatccggtactaggttgactttttatgggatgtaatgagtatagtttcatgcacgcctgcacttgtgtgttgcctataaattcagttttgcatgcacttcaccaatgaattactgatcactttcttgggtacgcggtgatcatgtgtttggccatccatccaacgcatgccttgccttcgtgttcgtgcatatcccttctttctatgaagtagttaagaatagatcgtaagtgtttttttcataaaaaataaattatctgcgcatcatcgtcggtttcattgatctcaactcttacgtacaatgaatatagataggagtctgtctagattcgtcattcattatacatacgtttgttttttttttggacgttttgggacgggagaagtacggtggagaaagggtgtagcaacatgttgctcaataacggtgcgctgcttctgggaggaagattatatatgatgtcatgtggagaagaacagttttgctatacatatatatatgacgggtgtggctacatgcccctgccccttatacgcacggatctctcccttcctcctcccctctttctctttctgctatagtataccataaaaattttaaaaaagttgagaaaaatttatgcatagaaatactatatataaagaatatttgaattcaaattcaaatttaaatcagatatataaacttttaacttatatgtgtaaatttgaggtgtacaaactttaggtgtataaattacctaaattttgggtttctaaactttatatgtgtaaatttgaggtgtacaaactttaggtgtataaatttattaaaataggaaaataatatggtgatgaaaaaggaaaccacgtggcgagagggggacagcgccgtctttccgatatactccctctgttttttaatagatgacgccgttgacttttttctcacatgtttgaccattcgtcttatcaaaaaattttatgcaaatgtataagatataaatcacacttaaagtactatgagtgataaaacaactcataacaaaataaattgtaattacgtaaattttttgaataagacgaatggttaaacatgtgagaaaaagttaacggcgttatttattaaaaaacggaggtagtatggtgccacatttttctttaatcgttttttagatggtgatttaacaggctgatttgcgattagtttgccatgcttttcggattgggaggtttgcggtcagaataatccgtgcagtttgattctccgcgtgctatcttttttgtgtctttgcttaaaaaatgtgattttcttgaccatatgagaaaactacaatgtaggatttgagatttatattagtataatttaaaattattactgcaaatataacaaacttgtagttaagattatggaattcacagtataaatacacgttgaaaattttaaccgtcttttatgaagctgtgagattatgccatcgttaaaagtgcgctttgataaaacaccatcttataaatgggattcactaaaatgcaattctcaaacagtgttatgtactaaaataccatatgcctcttgcatggacgaaaatgtgcctacctttacttctctctcacctctggtgtgacaaggaaacaatggtggtggcgaggcacgctggtgagaagatagcagcctcttccagctcatatgctaggggcttcctatctcgcgagctcgtgccgggaggcaagtcgtgcgcaggggctccccccacccttatctgtctccacccctctattttctctctcatttatatcttttcctcggcccctcgatggcagtttgtggatggagtggtgacgataccaacggccaagttccttgcatcgggcgaacccctcctcctccctctagcaaacccttatttcttactccgttagggacaacacaagagtggagcgggctacgatgctatcaagacctaccaacaacgccccttcagcgagtccccttcctcctcccttcggccaggttagctctttcttcagtctccaccaccctaccccactgtcccgctgcccccggcctcgccggcgccaaaaggagtcaacagaccagggcgaccgtacctggccggcctcctccccctccccttcacctcgctttgcctccgccaccatgatcagcccactgcccgctactgaccttgcggctccgtggcgccgccgccgcctcatcgcccacccttgttcgccacccaccgccggtccggcgtctcccaagccatccctctagacccgatcccccacttctccctccccaataccaccctctcctttaccccacctcaccctaaccctaacccccctcacgcatggcttgttgtgacacggtcggaaaacgggtgccacttcctcgctcgcccgtgtgtgcgaattaggattcttgcctatgctgtcagcctcttttagctagctcacgcgccatctaaccttctcgagcaacaaagaccaatatgtgggccctacccttgcatgggactcgcatgtcatgatcaaatcaaatggggatccaccatgacacgccgcagatcagggttaaaatttagatatccgtagacgaaaaataatcgtcccattcttttcatgggacttgtatgtcaggaccaagtctgatggggatccaccatatatagcatgccaggttgatgcagggggcggatcagggtcggtttgaatcagcgatggcatccaagataagtttagccgtttagggacgctaaagatatactactatttcgtgagttgggagacatggataacacagactgcccacgtactttattaaaaaaaacattccaacctcaaaatcgagtctgtttatttcgatcggtacatatactcactcatctatccccacacatggggtcatggcgtatatgcgtgacacgggtgcatatgatttttaccctaaaaccaactgaatttcccatggcaattagatgcagatcatcgatcgatcgatcggtgcaatgtcaacccggccccgttctagctaggtcgatccagtccaaccagctagccattgcgtgccacacgtactcctcttaattaatttgttctatgcatggcgccatggatgatgttgtcgtcggagatgaagtagtatatagctagggtgggtggctatgatgatcggacgacgagggtgtggtggtgatgtgaatgttgggattccacctcctcatcctgcgatgcacatgcgcgctgtgctgctgaagcaccagcacggagccgcaggccgtgaagtcgtcggaggccagcacctccccgacggggcccagctccggacactcgtcctccagtagccctcccatgccgctcgtcatggccgccgccgccgagccgccgccgcccttccccaccacgaacagcgagtacgtccccaccatggcgctcaacgaattcaccatctccgcgccgttgctcacgtacctctccgtgtactccacctgtcccgccaacaccagcctcgcgtacacgtccgccatgaactcctcatccgccatcgcctcctcgtcctccaccgccacctccatggcgccctcaccgccatggctcttggtggtggctaataattgttcatcaatgccaatggtaatatcatcctgtcgcgctggaaggaatctcaccaccgtcacgctcacccacgggtgcgccgccagccgcgtcgcgtacgctaccgcctccctgtcgtccggcccgcccaggaacaccgccaccacctggttcttcaccacgtcttccgcgcccttgtcgccgcccccgccgaggcgccgttccaccaggaccccgacagtgcagggcaagcgctgcaggatccgctggttcagctgccgcctcccctctcgccggcacaccatgcgcccgtcgtaccgctgctccttgtggaagggcacgatcaccagcgacgcgcgcgagtcctccacgccgttgcgcacgtctgcgtccatggaccccaggctggagatggcggtcatctgccgcaccggcacgccggcgtcgtaggtgaaggtgttcaccgccgcggccacctgctcgatctcgcgggcataaccccactcgtcgtcgtcggcgtcggcgtcatggtacagatgggtgatggcgtacttgcgcgcggccataagctccaccaggtggaggaggtagacggccagcggcgcggtgcccttggaaagctccgcgagcgtcagcatggtgtggacgcccccggcgccgtggacgcagaccagcacgcggagctcgtggtcgaccttgaggtcctgaaggcagcgcgaccggtatcgggaggcggcgcgctgctgtcggacgatggccgcggcagccgggcctgccatgaaggtgttgaggatggaggagaggagcagcaccacctgcgccgtctggccccagatgccggcctggttgccgaagttgatggcgaggatgtcacagtagcccttgacgttgagcaggaagcccagcaccagcgactccctcgccgagatgcccagcatgcggcccgcgagcaccgtgccgcccaccttcccgactgcgccgagcagcgtcgtgaaggcgacggcgacggcgaactgcatggctgtgaagctgccgacggcggcgaagtcgagccttgcgccgatggccccgaagcagagcggcatgacgagctggtgcacgggataggtgaggcggtcgacgagcgtgcgcgccgtgggcccgtcgcgcggcatggcgaggccgatgaggaaggcggtcatggaggcgctgtagccgaacacctgctcgagcagcgagagggcgatgatgagcaggagcatggcgcagagctcgtacttgctgacgtagcggcggccgcgcttgagcctgttgagcagcctggcggccctggcggccgcgagcaccgccaggcacgccgtgaaggccatggacatgacgatggacatgtccgggaaggatggggtgggctggccgtcggggccgtaggcggtggtgccgacgaccatgatgctgaagacggagaggctagccatgtcgttggcgaaggcggcgccgatggcgagctggccggcctcggagccggtgagcttgagctcggtgacgatgcggatgaggaccggggaggcggtggtggtgaggacgagcatgaagagcgcggtggaggcgtagagcttctcgggcttgaaggggccctggccggggtggaggaggccgtagaagaagggccccgcgagggcggcgagcaggaggcagagccccgagccgccgcaggcgatggcgagggagcggcgcaggtggtggcggaggtaccggaggtccatctccaggccgatgaagaacatgaagatgatgcggacgaagtagatggtgtcgctgagcgcgctgccggcgtcctgcatgcccagaggacgcaggtccacggcgcggccgagcaccgtcggcccgaccaccacgccggcctgcactgccatgctcgcaatctcatatatatatatatatatatatatatatagcttccatctcgatctctctctctctctctgctggaaatttaattatcaatccaatccaatccgcatgcatatatatatatatataccaggatgtgcgagattatgcttggctgcccaacgcgtcgaagcgcgcaatggaagatgccggagagcgccaggacggtcgccatgaggccggtcacggccatcacgccggccatgaagtaggtgccgtcgttcacctcgtcggagcacttggcaccgtcacctgccatgctcgtcgccggcccgccggaccgatcgatcagcacgctacctacctacctacctatagcgggctatcctatatatagcctgccttatatttatcagttaaaatttgaattatcaactttaaatttgaagctaaatttgagggggtttttttgaattttatttttcagtctttacttttagaacgctaataacacgtatctaaaagttttattgataaattactttttatttgtaaatataccgttttgcttaatccccttaaattgcattcctagcttccatccctttcgtcaacccaatctaggattcactatagccaacataattgtgtacgtgactgtaggtttactggtgctcaagttaagatacacagttgtaatcgactatgcagaaataagatatcaagggtcctaatgaattttacctatgaaaccctctaactcatgggaaggataggaaattttttttcattgaaaactttcgttacctttacgttgttcgtttcatgaaatgttattaaagggattccttcaactttttcattaaaataggattagagaaacataatacttaatttccctgtcgtctttaattgttgcaatcacgggtacttttctaagtctactatctactatatattatatatacttatatatacttaaaaagtaaaacctgttttcgtcgtccgtgaaaacaaaaagaaacgatgagaaaaaaaccaaaaaaagaagtccgactcccattaaaaaaaacttccgactcccttggaaattccgtaaaaaaaagaaaagagatttctttatggaaaaaaatcaagcgcgaaaaaagtgcgaaaattttgttatgtccgataaaaaaaagtgctataaaagggtttccgtctaccgtaaaaaaagaaaaataatagtgcaaaaaaagatttatgtccgattaaaaaaaatcccgtcgtccatccccccaaaaaaaacaagcgtgaccattttttctgtccgattcaaaaaaagaaagttgggaaaaaaggttttccgtttctctatctctgactctatctcttctctgcttcttaaaaaactaaatgtgtttccgtcgtccgtccgtgaaaaaaagcgtgaaaaagaaattgagcgaaaaaaaatcgaatccgattatacgtgacgcggtaaaaaaaacaaaaaaagggagaaaaaaatgaaaaaaaaagagaagtccaattcaatctatctatatatacctaactaaaaaatttgtatggcttccgggttatagttttcgttcgtcgaaaaaaatatttccatcgcacgtgcgatcgatcccatttcaacccctctccggtggcaaaaaaaagaaaagaaagaaaaaaataatgagagaccgcatcaaatttggacataaatcatagagaaaacactgctacaagaatacaagaatacaagatcagattcaagaacactaagaaaacgccgatgccggaaggggagggtttcgttgtcgttgccgaaccgccaccgccgtcgcagggatgtcggtatgccagggcgcagccacgttgttttgagagatagagagcggggggaggggaaatgattttagggttagggtttgggctgttgaacttttatataggtcgaggtcaatcaggaccgtctatcagatcagacggttccggcttctcccgcgtcacaccgaacgccaatcccaggccgcccacacggaataagttcactttaggtagcttaagtttttcttcccgattctattcctaggccgcccacactattgggccatctcatggaccacgtgtacgctttgtatggaataaggtcactttaagtcccttcagctggactttttttattttattatgaatatattttcttaaagagctcatatcatgtaaaactaaatcttaatcatgtaatatttttatatttgttataattttaatttacacgttgcaacgcacggatatttttttctatgtaaaaaaaagggaccatgacatacgagtacgagtgagagatatatgccgcacgcacccgcaggctcatgtttaaacgagctggcaacatattgtcaattacaggtctaattgttttatttgggtgattaaatttgtttttatttacataattagtttgctctatttaagctttttgaaaattgctaaaatttgagaataacttttcctacttcatattatattatttttagctaatggaattaacagaaaattaattatatatttttatctttttaacaaaggtcactgcaattttatattttattatgattatgattatgattcctttatattttttctcaccaatatacatgattaaaattatcttcacccgttgcaacgcacgggcatcattgctagttaaaaaaaaagttgaaataggagataatgtgaggccttgagattaaaaggaccccgaaaacgagacagatcgtggccgttgaagagggacacagacaccgtggatctgaacgctgccggtgtttgttatccacatttgcggggcgcagcagcaaaagcacaagggcaaagcctcgccgccgtcgccgccgccgccgccgccgccgccgcggcgatcgccacgccatgtctccctccctcttgcttacctctaggggtacccactcgccggcgccacggccgcaaacccgtcgagcatcacaactgctcgtctctttcccctcgcgctgcagccgcttcgtcggcctccgcctcgcgcgcgcagccgccgattcgcaggggcccaacggcgctgcccctggatctggatctggtggggacggagagggcaaggcagccaatggtgccgacaccaaattggtacggtaaacaaccaacccttccctctctcttaaatcttaatccccttgacttactactactgttccctaatccctctcctgttctccccaattactgttccttctctgtcttaatggatagatagatggattggttactccttttctttcgcctgcctgctaccgtctgcattctcacaggctggttggatgcatgccatgatagaacaggagagataatttcaatttactaacaaataacatgcaccgcataatttggagaagtttcttgtgttaattttgcatcaatcacatggtatgcgttctccacataaacttgtaatggtttgcacaaaaataattcgcactagccctcaactccaagtcgactacctgagaatatgtcggagaagcagagatagttatgatgtcctgagcattttatacattatgagatccagaataagacacaagtagtcaagcactgcataggtcacatgatgaggcaatttaatttaattaccctgagatctgaactataggcagatgaactaaacaaatcaggcttacaaaacattgagattatcttgcagaacatttgggaatggtaacaggacatggaggttgatcctataccaagacaccatgtatatatacatatataaatgatacaccaccaactgcaattctatcagtcggtttcatctgaattacactgtgcaatgaatagatatatcatatgtatgactcatcatgctcacattttttctccattagtgggccgcttgttaataatatataagttgatgaaatattgttaactctcactgatccatggcatcaatgatctgtctaatactgcacgagcgactgttgtctgttgctagggcagctggtagtcaatggattgttcactctccacaaaacatgttgagttgagggcttttatgatatcttgcctttgttgatctgttcctacacaaaacaacttgaaggtcctatatgtaagaaaattagcaaggattgcttgacaattgttgatagccttatagctcagggcagaaagttctggcagaaccttatattcaagaaaattagcaaggatctcttgacaatctttgatagacttatcgctcagagcagaaagttctagcacctctacttctacatccattgctgtagagtagtttccttttcatccctgcagagtgtgcacagagattctcaaaagtcaaaatactgttctgtacttctgtgacctgtttttttgagtgtcaagctgccatgcaggagttcattagaagcagaaccatcatgctagttggactagactctgtttgtagttgtatcgatggaaatatatgcatgaacaccctttcgtccacatgtctttggttctcaattaatccattgtctattatcatgtttggcaccaacgaaaataagctatactaatatcttcttgctaatttagctataatattattctgacaacaatccatattttaaagctatggctataatattctgacaacaatccatattttaaagctatggctatgtgtttttttcattcttacagccaaagaaccggagggacatactcctggaatacgttaaaaatgtccagccagagtttatggagctcttcataaaaagagctccgccacaggtttttatcatcttacttccctcctaagtttccacaaactgtgttttggataattcataaggatgggactgggtcaatccatgggtaccaattgacccactatagttcaaccagatgaactaaaacacaacatcaaagttcatttttagatgatttggttgaactagaggcaatgggtacttatgtattgacccacttccaaccctagatatatagggtggtatgctgatgatttcttgaaatactttgatatgatgacatttccctctgtccatttttttttctgaaaaggttgttgatgccatgcgccaaacggtgactaatatgattgggactctgccacctcaatttttcgctgtaactgtgacaacggtaatgggatatcatatgttcaggtcttgacgccggtttttcttgtatggcattatgtcatactactaattattagcacaattcatttgtacacttgagccatgaaattgtgacatgtttatttacctttttcatcgacacaggttgctgaaaatctagctcagcttatgtacagtgttctgatgaccggatacatgttcaggaatgcgcagtatcgtctggaattgcaacagagtttggagcagattgcccttccagaaccaaaagaagaaaatgtacttttccaccaatgctgagttgtggacatatattccttacagggacatatgattaaattgttgccatgttgacatgtatatatctgcttagtaatctagagttgattatgaaaactcattttttgatcatttgtttgtcttttgaaaggttaacactatgtgcaacttacattaattcacacaaccaaatctatgagtggataaagtcaagtttttgctggtagtaactttacattattaaaactgcaaatattttattttgtcttattttgcatggcagcatttactcgctgttgctgtgcatggtttaaacctccataaagagaggtccaagtagtgtatccctagaaagtaaggttaggaagcatcaatcaatgataacttgataagtatgtagcaatgatgcttcccggattcaaagtaaagaggactgaaattaatctgatctttagagtgtttctattggttgaagagttatttttttcataggaaagcttgttgatgagtgatcattacctcaggagttcacagcgttatctaacatggaaaactaaaatttgtctttctataagaaaaccaactcagctattgtaactattggtggtttccagctactgttttggcatcctagtgtttaattaggctttgagtaggagcgatgaaagatgcaatattcattttggatgttagattgattgaggagcacacatccatgcataacataaatgttgtcactaacactaattgtaaaatgtctcacgtctctctcctgccagggcacctcagtgtgccatataattcactggcttgtgtcactggtcagccacatttggtattgttttctaaccagtactttgcattgtcatatttgctcattgctgtttgacattgtaaagagattagtgctagaggttattgacttgtgtatttagatttgtttactttaatgtcatagctttcagaatgaagtcggtcaacattttgtgctcctggtgttttgatcatttttctgcaagtgttcttaacagtacattacaatgtggtgtagcttccctacttcgcacaaatagtaaatactataaaaaaagcaaagatgaggttgtttaatatgcatgctggcatttgtaggattctgcagattatgctcctggaacccagaaaaaggttactggagaagttatccgatggaacaagactactggtcctgagaaaattgatgcagtaaaatatatagaattgcttgaagcagaaattgatgaactcagccatcaagttgctagaaaatcatctcaaggaagtaatgaactcttggaatatctaaaaactctagaacctcaaaatctgaaggtatatcttgatcccattaccctctgctgcatccatcctaagaatcagaatatatatagttaatactgactttatgttaggatgatcaatctttttggttggtttacatgcgtgataattcatctactattctgaaacattgtaggagctggcaagtagtgccggcgaggatgtcgtttttgctatgaatgcattcataaagcgccttttggctgtctcagatcctgcacagatgaaggtgagtgtttatttacttctttctgtgttcatgttaattgattttgttcagaaccatgcatacctccattttgttgaattgtgccactcattcaggtttgcttccattccatttagtattttctgataggaaatcgcagcattttataaattgttccccaagtttggaatgttactgcaccttaaagttagtcactttgttttgttttgttttgagtgcagacaacagtttcagaaacaagtgctaatcagctagccaacttgatgttttggttgatgattgttggctacagcatgcgcaatattgaagtgcggtttgacatggaaagagtattgggtgctgccccaaagataggggaattaccacctggagaaaacatatagcagggaggaaaggggcgtaagagtggggaagtgatgattagttaaaatctagggttactggccggccaagataactgtatttgcgtggtcatattattttgagtggaatggattacagcatttgtgcaaagacaccaatccacattttgggaactaagatgagatgctaggcatagccatttctgatatatttctcggggaggtatagacgacgagatacatagaaacaatagaacgggacctgatgctgtagttttgcaacctgactattgttggtaaaatacaatcaaggcaactcatattaccatattgtactcccatgttgtatgtctagttcaccaatcaagttgagtctgatgtgagtttgtttagaatcttgactaattttgctacatgacacataagtttgtgtaatttgatagcgtacatcgtaaaaacgtgttatggctgttggacaccttaaaaaatgtgttccttgcacaggaaaaaaaattcttttgaatagatattgatacaaatacctcgaaacgggttgggatacatattcgttattactatagataagatcttttgaataggtattgatacaaatatctcgagataggttgggatacatatttgttaatactatagatagagtatgattttttttcatccaaatagataaatctctaaatataggcacttcttttttcttcacttttgcatttcttaattttgtattctgctattctgacaaatattttttcattcttgcttatcttatcttactttcctagttgttctaagtaatacacgcggtacaaagttcgtgctagggaatttctttgagtcatcatgtttttcttcatacaaaaaatgaatatgtgatttttcaacgaaatgaagctttttttttgcttagcctatctgaaccttttgtataattggaattaattaaaatataataggtattttgtttcgtctagaaacatagcgtaaaaatattcctcgacttgcataaaatctggagtactatgctagatgccattttcagctcaattggagagagaatttttcttagaaagacaagtgttcatagaatcatagtgccaaaagcttctaatttagtgcaagagcaaagatttaatatgccaatatgacgcactcaaggaatgtacttggggtgacgacacatttagagatgcataatttttaaattttcacttcaaagcctaaggggtgaaaatggagcggatttgaacggatagtaggtataccatatcttaaaccatatttcttgagtggattcgaagcggattgtttcggatgttggaaatggtgcatattcgatttaaaaacggattgaatttatcagatattacgtgtataagcaatcaatataacatcgagttagcaatgcaaggaacaaacaacacaataatcgatgaacaaccctcgtaataattatattttttttgagaacgtcgtaataattatatgcataagtgttaaacaatatgaatacttcatagtataaaacacacaactatgcaagtgtgagatgagattatgaaagcctcgaattaaggagtcttggtaaattgatgactagcaaaatttacatagaatcttttagaacatttaggccggataaaaatcaatttcattgtctgtcttctctgcacacggcacgaccttatatgaccctgtaccataacgtttagcggaaaaagctttcaactaatacaacttattataatatatttctccaaattttagtgcccacatattttaaaaaatacgataaattgttattactacttaagatgagaggggtgatgtttttttaagcctttttaatatttaattaaaaaaaataaataatccaacaatttattttcaaatataaacttttggtcagtggcaagaaaacactagcaagcctgttgctatggcgtgattaaaagatttaaatttgtaaataagttttggagaggatttattttaaaaataaataatattaataaaaggttaaaaaataataaaaattcgagagcggtcggttccttggaaacgaagggaacagggaaagtatgcagaagcaagtcaccgcccaagcgaagaagccaacgcggtggaaagtggaaagaaaagcggacaaaccaacccgaggcgaccggcgactcggcgaggcaaggaaaagaaaaaaaaaggaaaagaaaagaaaagaaaagagagagaaggtgtggtggtggaaggaaccctagcggcggcgaccggctccgatggcccctccaccgccgtctccgtccccatctccggcgagcggcgcgcagtacgcgcaccagttcctgaacacggcgctctcccagcgcgggccctccgccctgccctacgcggaggacgtgaagtggctgatccgcaaccacctcgtcgccctcgccgacgctttcccctcgctccaccccaaggccgccctcttcacccacaacgacggccgcgccgcccacctcctccaggccgacggcaccatccccatccaccacgccggcgcctcctacaacctccccgctgtcctctggctcccggagccctacccgcggtcgccgcccctcgtcttcctctccccaacacgcgacatggtcatcaagccccaccaccccctcgtcgaccgctccggcctcgtcgccaacgccccttacctccgctcttgggttttcccctcctccaacctcgtcgatctcgtccgatccctctctcacctgttcggcctcgacccgcccctcttcaccaggagccccaatcccccacccccttccccttccccgccgatccctgccaccccgctccctcgcgtccacccctcctcctcctcctccccctccccatccccctacagattccctgcctcgccccagcttgccgcgcgccccccacccaccgaagaccccgctgaggtctacaagcgcaatgccatcgctaagctcgttgacatggcctatgccgatgccgccacgctgcgcccagtccgcgaggctgaggtcgacactctcttcgccatgcaggctacgctgcgcagccggggggaggtggtctctgatggggtgcgcaagatgggggaggagaaggaggcacttgagcgccgcctgcaggatgtaatgatggccacggacctcatggaggcgtgggtcatggagaacaccaagggtgctgccggcgacactgaagcggacgaggcaattgagaccgcagatgtactgtctaagcagatgcttgagtgcactgctgcggatttggcactcgaggacaccatttatgcgcttgacaaggccattcaggagggttctgtgccatttgatggctacctcaggagcgtgcgagcgcttgcacgggagcagtttttccaacgcgtcctgtcaaccaaggtgaacaaggcacaacaacaggctcaggttgctagaatggctgctcgggcaccacagtatgcatcataggaccggtgaggggtaacttgagtatacttactttgatattgcctttgtctaccaactctactatagctgtcacagtgtaaagttcgtttgctctttgcacatcttttttggggtggatgggggttacttactagatattggatggatgatcccatgtcaaataagaaccttagttgggagtgctgcactggatcttgtgtacgatttctgtacttcaatacatatcttcagttttgttctttgtgataactccatgtctcaatcttcatcgcaaaacttttatcaaagattacaaatcttgaccttggtagaaaatttcagatgcctgggtgttccccatcttactaattgtagtcattgccattggtgccgactaattggtgccagcgccggaacaggcaataataggcccttctgaactggcacctatgggctttcctgcactagtgaattgtggtaattcagatattggaggctgatatacctgaagttactgatactttcagaatgttcagttatatttcttttgtatgactgcattgccagctgtggaaacctagcctatttgttagaactcaaagttgggaagcactaagtaatctaattaaaaattagtaatttctggcttgcttaaatgttatgacaatggaagaggcaatctaactacctctgttgtaaatgttggacgctctaatgtgatataggtatctcaagtttgcttagaggtttgtttgtggtcattgtgtttgtaggtgtcaggcgcgaatgtaatcaacaatttttttggtgtgtgggtgtgggtgtgggtgtacttggggtttcttccctatacgcagctctcctacgtgttcaagagaaaaacgtttgcatataggctttctggccactcttatcaatattaatatatttataaattggcttagtagttggttctagtttggaaatatggttcccctgagcacagggcactgcacactttggaccgaatgtgacatattctagtactatgaatctgggctgtatgtctagattcatagtactaggatgtgtcacatctggtactaggttggttttttatgggacggagggagtaggttatttattactagatgatctgcacgatgcaatgcttacatcatggagtaatgttctgtaatttctggacaacctgaacatgcccatccttagtcggtggtgttggtttttatggttcaaatcgcagcccagattttgagctaactctggttctgtttgatctcaacacatttgtagagccaaacagaatgggtttcttgcagatttagagtgtgagtttacatatgctgcttgtccttgaggtaaaaaacatttttaaaatgtattgcagaaaattacattgaaccattgcaggacaaaaagttactgatgttgccctgttgctccgatgagattcgagtgagcatgccttttgctccagtatagatagtctgagtaaaacctagagttatttagtgtggtattaaaaaaaagttgaactcgaggaggcggcagtggtgatgttgagcccccgagtgaggccgtggacggtgccatagccgcgggacccgaggccgatgcagccgtagagcagcagcccctgccggtatggcaggtacggccgcccctacatctcctccgcctgcgtcctcctcacctcgtacatcctctcgtgcgccgatctcctcctgctccttcccgttgttcctctccctcttctcggcggccctctgccatggacacaacagcgctcacacacagcccaggtggaggaacagcaggccaacgtcgctgccgtagcggtggtgcagggtgtccaatgagcggtgtgggagctggtcgacgaggtggaggtggctgacgaaaggaagcaacggcggtgatggcagaagcttcccttttccaagactcttgattgtgaagacgactaggagcaacgctatggcgaggatgacatatgatcattacatcttggtggatttttatcccaaaggttggatttttactccgaatgtcttggtgcttataaatcaattagagcacattccatgtccttgttccattatctctacaaaaatgttcttgtagccaatcaccacggggcggtgactttcacagatctattgtgtgtctagaatattctatggtagagttttttttctccaaattggattttcacatgcatgtttgatgaactcttatgccatgtagttggggttatttatgaagatcaccatcaatcatcttcagttggattgctgttttcaggctattgtgctggtgcagttgtgcagcagtgcaggtatgcttgtgagttgtgtcaggttgatctgggattacattcagcaatacttctctctcatttcctggtgaattggcaatctatcctaactgttgctggttttccttctcaggtaagatggcatacagctcactatgccgggtatttgcaatatcgagcaccagcattatgtgttgtgaaattccaaaatactattacagttaatcacccttcatatattttttcaggtaagagcacctttcatacaaaaacacaatgtgcccggtgaaagataaaacacaactacaggcttttttttaaaaaaaaaaaactatcacctgtactagtgcagtaaaattgcactttgatgcacccacacaagattcagtgcaaacccaaaaaacagaagagaaaaaaaaattcctctaatcccattttatttgtaaggaggttgaaatggcctggattagtccaggctagcttttgcagggaaacaaaatagagagtacttgagaggctaggccctgtagccccatcttttgaatacgtgttagtgatgcatattttctcttgatttacactgcagatctggcttaggatgataagtgtaccttattttatctacctatctgatgtcttgcatcatagttaattatatgaatgaattgacaactcgatatttgtctacaccctgcattttttcccgtattcatccattgcctgactgtttacatggatgcatgtagaaccttgtgctgttttggttcataagtttagtagatagaatcttatgatgcagaatgaaatttcccttttccttggatgatataaaagtaacatactctttggatgtgagcaattagacatgtcactagcgccccaacagatcagctcaaagtatgttcccacccatgtttgtaagtaaaaagattgtccaggtccattttctttgtttagcattccttggtattatttcccaaattcatttgttcagcatgggaaggccttttttgtcaaaatgcgtgatggtcagtaatgcagagcttttattttgtaactttattggcacagatggattctaaccaagaatttgagaatattagttaatctctttctgtgtaacatgtttattcaatagtgtttgtttgcatgttcgaggtatgaatttacagttgaggttatgcatgccaagaagtatatattttttggggggtttttttgcctggtgcattctaaccagtggcttggagcatgcttaagcagactgtgctttagcccagtctgtacaccggaaatcattatcccgacatacatgattttattcagactttatcattacctttagagatgattatttcatacttccaaatattcatttctgaatgttatacctgctacatttagagttcgatataaacgtttgcagttcacatactatccaatggggccttgaaaaaaaaaagagcaagaatcaatgacgaagcaatgcttcttttcctcttgtttgtaggttgaaagaatgacttgatttatggagctataattatattgaaaagttcgttttgtaattcaatacaaagaagagtgtgagcatgactagaagatctctgtggatttcttacaaggtatttattttgcatcggtcactatgttaggaacctttagtggtttatatagtcatgaaagtttttgagccagtgcatcaaatatcttggtccattaagtgcctgcacttctctaaggaaatctacaggatttatctaagctgcaaatcagaatattcaggattaataaagtaaaaattgcatttctgcagcaacaaagaaaagacttcgaggttgtgattgaggatggcaggtcctaagtcacagggaacgtggaacgtgggtgagttcctcgtcccggaacaaggaacgggaacgaagcggaactttattctgaaaacggaggggtcgtcgttccaatacgtggcatggcgatgaaggaacgagaaggtggtaggatggaggaaccaagtacgctgagctaaaaataaaaggggaactcaccggatcaacgcttcaagcgacgagcagcgttgttgctccttcgttgctcaccgccatcatgccccgaggtgcctccgccagcgcacgccgccgccgtcgagcaggggagagggctgcactgctagtcgcaggtccatatataagaacagccggcaaaatccttgacacatctagagggaagaaatgataaatggatctttgttccgagcagatcgaagaatatgtatgttgggcaggtaaatattcagataccctccaacaagctacggtagacttctgtgaaatggttcatcatgtaacactgtccatgaaacactactgcaggagataagggggaaatttcagcaatccaacttatttactcaccgacggagcaacatttgctactggccaactattaagtagaaaatgttttcaatggaagaagaaacctgcacacttgtgactcaaaaatcgtagtctgcgggtcatgaagtttcactacaaaatacaaactagctattttgaactgactattgattcacatattagaaatgatcaatacagaaattttacatggctgtagtgcatttaaatatcatttttagggggtaaatatagtgctcaattttctttccatatttatggcaacttttcaattcctaatggaacttgcatactgatgtggatgtctttgcagagagaaatacgctcgttacatgagatagaggattttgttgggaggcaattaggtgcgtacgagtataactctaagaaaggtgtcacaaaggtgtggttcattgaattcatacttttaaattggtgaattgtgaaagagatcaatgtgtaaatgatgggttgttgccgtttcacttgaaacaagctgatgttttatttcacttaagaattattaggaaggatgtggccttgagttaacatttaattatgttatgtaggaagaaattgttttttttttcatgctacgccttctaaagcccatgcgtgcgcagcgtgacaccgcacatacccttatattatgaatcaatccagttttccggagttaggatgtgtttagttcacgccaaaattgaaagtttggttgaaatttgaacgatgtgacggaaaagttaaagtttgtgtgtgtagaaaagttttgatgtgatggaaagttggaagtttaaagaaaagctttacaactaaacacggcctcactcgttcaccgtcttcggtttataatcgggcgtgggtttcatcacttctaatagtagcatgatgactatccatgatgactatccgctactgccggcccgcctattaaagtcctccgctcacgcagtttgaattcatctagctaaagtatgtataagtatttctcggttcataggacaatgctacgtagggccaatttgaactgaataatacagtattagtatacattgctccaaaaataattcgaagtggtctcaggttaaagaaaggcaaattctctatccttctaaacttatcaagctgtttacgcagcagcaaactggcttacacagtaaacgaaaaccaccacaagaaacaagggagcctttagaataaataaaacggctacacatagtaataacactagcaattgaacaatgttggtagcaagtaaaaatggcatctcctagcagaccgacttgaacataaatacctacagaatcacccgctcgttcatttaatccgtagtattgac

SEQ ID NO: 56507 - DNA, 2468 bp, Oryza sativa
  unsure (1)..(2468): unsure at all n locations
tatgcaatggctgcacttatcatgacattcacaaaccgctccgacagaatcatgcggggaaaagaaaaccagaaaaatatggatactgcccttctctattactcctaccttcacaagcatggccataaaaaatcaacagtacaacatattaggttgcatgcctcaaatcatcaaatcaacagggataggctatctcatatttttctcaatacgaccggatctttcaaaaaaaatatttttctcaatatgaatccccatgactgtaggctagtgagcctactgaatgccttgctcctgcatttccctaacagattcttcttttaaggtgagctgactagcgtgtgatactcaacaaatgacggcgggcaaatttaacaggttatcgtaatttgcattgatttgacactatacctcttaagttaagagccttacccaagaaaaaaaattataatgcagaggacaagacaatttataaactaataccagggtgtaaaagataggaacatcaaacctctgttttgggttcctcatgcaaaaatgaccaaggtcctgatttccatagaagcctgcgatttctcaaattattaagataaaagcataaaagagcatccattagatcaattacagaacatgaaatacaaggctccaaaagggaaacagacataatattaaaaattctttatcgccaattgttatattcataaaagtgatgaaaattgggaagatacccttatacaatatactgcccagtgcatggatatacatcaaataacagaaatttgtcctatccacatgaaactattagttatgttctcctaaataaactgcaaaatatgcgtggcaattcactgaacagtcaattagtttacatgctccctgaaaggttacaactttcatatagaaaataagttgatcttcaagataacatgcaaatatgttacttattgtggcagtaacatatttcgaccgctatagacgtcacattgcttacttaacatagtgcttttagcaaatacagtcaccctaatcaattgccaaataacctagaacatagggcatgtgtagcaagtttattcccaagtctgcaagaactataatttgcattttcacagttgaaccacatccacttagttcaataaaatagcagggcacacacgcgcgcgcgcgcacacggagagagagagagatcacttacatggctatggtttacggttacagaacaacacaagatattcattcccaaaaaggcaaacatttttaactgcaagatcatgtatgcatgcttgtctttttacaccggattagaacaacaaaacaagaaatataatcacctgagaatgcccgaagccatgcgcaatcccataagtgttgtcaaaccagcccaaactccagcaagtccaaaaacagatggagcatataacaaaactaatgatgacattatcccaacagcaatctgtatagccaaaagatgacaaagaaatcaatataaagtaaagaaaaaagagagacaagtgtttccataccgtagcnnnnnnnnnnnnnnnnnnnnnnnnnnnnnnnnaatgcagaccatcaaatatgaatgccagagcattaattggttgactggcacatacaaactgaaatgaagaaaaaacattagaataatagatgtgatgtgataactaaatgataaagtagggagatgtaccaatgaacaagatttgacaaccattaggaccacagggtcactggtaaataatcttgctatattactgaatgaggtaaacaggccagcgaataagcttaatccactgactactcctatctgcaagaaaatctccatttttctatgttaacaagaaagggcgattgcatctatgaatacatgaaaaacaaagcttcacaatagaaaacagagaaatgacacatgacctgcaaagcaaacattgctatcttctggaccctcttgtagtccaatattgcataggagcttgctatcattgcctacaaatgcaagtaaacttaagtctgaacattttgattgcacaaatcatgatatatcattgagctagaggaacaatctttgtattagtagtattcgctagaagtttgagggctcgatgtaaattacaatttataaagaaagaagtatgtgaaatgaagccgatttaaaagtgtggataccatgtacaatcaaagatacacacctgggcagaaacagctaaagcatctgcaagcaaagataccgcaagccatacttgtagcatatctgatgagctgccatagctgttgggccttgtcgagcagccattgatgtccctatggtcatcgttaataaaatcgagagggttcttcctaacagcatgccacctaagcatttcaaaaacagatgatggaattatagatggtggtaagtgcaataaaaggaaaaacaagataagaagtatgaaattataacatggaggttctcaggatgcatatcatag

SEQ ID NO: 56508 - DNA, 1060 bp, Oryza sativa
aagtgtaagaactctgatttagcatgcacaacaattgaatataatgagagagggggagatagaagaacgaaaaagacaccagattttagatatccgctaaactctaactggtccagccttggaggaagtagaacagctcttttacttagagactggagaagcaaaattgtaataatgtacctatgtcatggacggaataaagttagaactccacttgtaagttgtaactagcaaaaatgcttgatatgtaacatatgaataaataaactgcataaacatcagatgatgtgctaacagccacaaactgttatggcaagaccagaatcacatatggtaatttaaatgtgtgtgctgaattgctgataaatgaaaaacaaaaggaaagctaaagtttattttctgctgcatttcattattttagaaacatgtctataagtaaaaacagttggtatttggaaccaaactgagttatttgctgctatattcatataaaatattccctttttttacctttgttgttttacttggattccatggggctaggtatcaatatagaacttactgtgatgcaactgtagaaattgcagctccagttatgccaagccgaaagacgtaaataagtaaaggaagaagcactacagctgaaagatttcccaaacctacatgttttaaaagaacatggtacagacatcatatagtgtaatatgagagatatttgatatcagagaagagtctggaatcaaatgaaactggacgtaaagtatgccctttattgtggaaaatggaaaaaaaagatattggaaacattattgtgattccacaaaatatttgctaggactgctaaaaggaatataactaatgcaaaccaatgtaatcatgtggttgatgaagagtagttcttggaagttacctataaaaaatacaggagtcttagtatccttgaatccacgaaatattccctgaactgctaacataatcacatttgcaggtgctcccaaagtctcaatgaaaggaaaagttttgcaggtttatgcattggtgaggcctgcaaaagcactaa

SEQ ID NO: 56509 - DNA, 1564 bp, Oryza sativa
atggttgtaacctggctctttgcaccattcctatttaatccttctgggttcgagtggcagaagattgtggatgattggactgattggaataagtggatcagcaaccgtggtggtattggtgtaccaccggagaaaagttgggagtcatggtgggagaaagagcaggagcctataaaatattctgggaagcgtggaattgttctcgaaatagtgcttgcattgcgcttctttatctaccaatatggtcttgtttatcacttgaacataaccaaacacacaaagagtgtcctggtaatttgctatcttcatttaatatttcttggtgttttcctggtctatgcttattagcacaagctattgaaccaacttttgaatgttatttaatggtctttccaggtctattgcctgtcatgggttgtcatctttgtaattctgcttgtgatgaaggtaatccctagcattcatattttttcttcagtgtttcatcgcggtgctcatgagcaacattgtggttagaacacagggggtacccttttttctgtatgacaattataattttagctgcacagagtatggtagttttcttgctatattcctatggcagtaaatgctaaagatatgcctttgcaatacctgaggaccattgcggtcaagttgctttgctgatgataccagttgttagaaacctgttgtgttgtgcacacagactgaaccttggtttactcatgtttgcagaccgtgtcagttgggaggcggaaattcagcgcggacttccaacttgtgttccggttgattaaggggttgatatttataacaattatcttcattatttataatcttgatagcaattcctcatatgacagtccaggacatctttgtttgcattcttgccttcatgccaactggctggggtctgctgttggtaagtggatatcaattgtttttggcctgtaagcggctggtttggcttgcttgagctgatgatggttgttgggttcaggttgcgcaagctatcaagccagtaattgtgcgcatcgggttgtggggatcgatcaaggcgcttgcgaggggatatgagatcatcatggggctcctgctcttcaccccgatcgcgttcctcgcttggttcccgtttgtatccgagttccagaccagaatgctcttcaaccaggccttcagcagaggtctgcagatctcgcgaatccttggcggccacaagaaagaccgagctacacggaacaaggagtagtagcctgtctgccattcactggacatgtattctgttgtgtcttcttccctcctgttgctgctgtaatttgttactcctattctactactccacttatcttgattgagagacccaaaaaaaaagaaaaagaaagaaagcgtgcattttggtagttgctaatcgccgcgctgctgaggccgcttattgtgcggcccagggagcgatgtgttgtagaatagtacagtagaatgtgtaaagttgctgtttggtagtgatgtgatgtgtgtgtatgaaaacaaacttgggaagagaaatgcaattgtaagacaaaatacc

SEQ ID NO: 56510 - DNA, 907 bp, Oryza sativa
gatgccaactccagcggcagtgacgtcgaggagcatgtcgaggtggagcgccgcctcgaccacgatctcagcaggtttgagatggtctaccctgccaggggtgacggtgtcttcttcgaggaggaggatgactatgagtatgaccaggaagcccatgtggctcgcctcgaggaggagaacctcaccttgaaggagaggctctttttgatggagcaggagcttggcgacatgaggcgccgcctggaggcactcgagtcgcgttttgcagggactgatggtatgcctattgagaattcagatgcagttgcagttgaccatgacaaggagatggctcatcccatacttgttcagagggatgatcttaggactgagattgctgctgatgcagcagggtcagacaaggctagtgcacaagacaatgcagaggaggttgctgatgcagcagtgtcagagaagatcgtgcaagacaatgcagatgttgtagttgcagggtcagagaggactggcgaagagatcggggttgatgcttcggagatggattgatgggagatggacactggaatgcaatagcggttatcagtactgtacatacataattgtcgatgacagattgaggccgcgtgatgtggacttgttttgggaggcttacaattgtatgttgtcgcataacaagtggatcatcgtatttacaatgtaatatgtttctaccattctgtgctatctttggtgtttctttgcgtatttgttatgatgataccacacagcacaacttgtagtagttcttaccttctgctgctgctgctgaaagaggtagaagcgactagatgaatttgttactacatcaactattaatgtcattataatggtatcagatggtgtcatgaacctgttacttaactatagatag

SEQ ID NO: 56511 - DNA, 1428 bp, Oryza sativa
caccgtgtgggaaaaactcatgccattgaaacgtccgtattggctccttcattatatcttttgttggtcgcacaagtggcttgatctgcaggtcagacataggacaccgagtaataaacttcagatgaattaacaaagaaagaagtaacgatgacaatttcaccaggaacctttacaggcaagaatatcctaaaagtcatccggaacagtacaagttttactcttaacactggggctttaagggcaaaacttacccagaaatggctggtagctcatagctgcaccgtaaggcctaaaagccacctaaatttcccatggtcttagaacttaaatttgggggtgccaagattagcacaagtgactaacttatacacattcttaactttttacagatttgatgtcttaaagatcacattgcataaggtccttcaacttgcaaaggatatggaaacataatgtactgttctctcaagttcaaggatccaggtagaaatatatattttatgaacctagcaaacaacatacgcatacaattatatgagtttatcaattgacacagcggcagagccacctcccaggctccgtcactggtgtttctactgtcctttcctaggcaacacatgtaaaaaattgccggttgctagtaaacgttcttcgtcgccccagttagacgatgccgctggctccgccactgaactaacacttagggtcctacaaatcctttggtataccattcactctatgaatttgaatgcacaaacatactggggcaacatatcttataaaagagaggtgaaacaagttgaaaacaatacctccacgtagtagcttactatcaattttgttgctaagagaaggacccagaacattgtgtacctagaagaataacagtcctcagagagagaatggtgcaagcataaacaacaaaagaatgttttatagaagtgaacatacttgaaaagggagaatgctccttcatgcattcctctaccaacaaacaagcgaggctgtaggaaaagtatgtttggtatcttacacctaaatggtatcaagaatcaacaataagaataaagctgacaaaggaaaactacctgcgaccaccacatcatgaatgttacaactttaagatttgatcgctcaagagctcttctaaggactgggaaaagaaataacacagccgacagcatgtttggtgctaaatatatcacaacagccaagatgtataatgatggttgattctgaccatcaccgagccaacttttaattgttcttgcaagacctgtaggattctcccaggtgtatgcataattactggtaaaatcacaacccatgcagcagctgatatcaacttcaagatgtagcgcagcttgccagcaagagacatgcttcttcttgctttccagctcaggatgatgtccagaattgctg

SEQ ID NO: 56512 - DNA, 2576 bp, Oryza sativa
  unsure (1)..(2576): unsure at all n locations
caattaacctgtaaagataaaattaagaagctccacatcctgtcaaagctgcggaagatgtgccaaaatgaccttatctcaacaaaatttacttttcccatccactggccactaccaactcttctgttctcctggaccacaagttttttaaaaaaaatcagtgccaagaataccctatgaagacgtatactacaaaattgttttggtttgttataaaaaataatatagacctgttttaccacctatgtgattcatgaatggaatactaacagaagtattactaagctgaaggttcttcatgaaagtaatataggtaggtatgtatcataagggacttactccgctcacttcatcatgataagcataatctggggtcttaaaaaaatctgcatcagctctcataggccatcctaatctgaaacaatctcttgacctgagaataaatgcagaaataatcacacaggtttccttagaaaagtagctcataaatttgaaacaacaaactaaaactcataaaagtagctcagaataaattaggctagtgcttaccaaaagtactcatttagatcatcataatttctccaatgtgagtgcttagattttgttgtcttgctcctttcgctcctttcactactttcactcctttcagcttcctatgtaaaaggcttgagtgtataagttgatggagctggaaacagagatatactttttttgggggggtggggggtaccttctcgatgactttgtatattggagtcacaactttcttcaaaaacgcttcttcatcaccaccgtaagccggtttaacattttcacctgtcgttggactcacatttccagccaacataccgtatagttcaaaagccatctatgagaaaacaatattacacagtcagcactcaccaaaataatctcatcacaagagttacaaatacagaaatatcccatcataattgacatgatggggaaagatgaattccatccaagatatgcttcctcatattatcaacgtgagcagaatgtgattctttgtgtatggcaatagctgtgtgcaactctcatatattgtcaggtaagtcaatgttattatggccaggaacatcatcagcattggagcctggactccattaagatccagctaactactttgtagatagaaaccaaatatggcaaattggaaatagctttgtacaaagaaaaaggtccgataagtcaattttattgtgaccagaccatcattgggtattcaggtaagaagcttgcgcaactttaagatccaggcctactagcttggtaaaaaccatatactaattttaaggggaaaaatggaagggatcagccatacgtgatgatagatgtagcatagacattccggcataaatctcaggttagccgcctcaccccagatgagaagataaagacccatatagaggagcttacgctgctgcacttcttgttgaatagttggcaacctggaaaggaaatgaccatctgatagtgatacatcaagcaagcttgagagaccttgtgcatattcgtatttttagattaaatatcgtaccataagctgcttttgcggccaaggtacttgcaccatctcttgtagttcttaaatagcttcttcatgactgtgtccagtgctcggtcatccaactgaaaatgtgaggaaaaagaaaagagtaaacaccagaatgacacaagcaccaccagaatgacacaagcaccgatatggacgttgagtaagagtgagaccttgggttgttggtcgggcttgggaatctgccttatatggacgttggcaagtaagagtatgaggtgttccctttggttggacacgttatctttctgcagagtgatagttgaattgcaaataagtgacagataggtgaagagaaggaaaataatggttaagttagtgggtgagcctgagggcggtgtgattacctgaaatccaaacatcgcctgaagccaaccaagaagatcagcatcaggctttttttcatgatccttgggccacggtagtcctcttgtattacgaagagcgtgaaaagcagcttgaatctgtaaaatgaggagaataaaaaatgcagaatgagttggaaaagatacgtaagattaagataggtagggtttgagaagaatgggaacctcaggatatcgcatgatagcctgattagcgctgtcagggtcaagcgggaggatgttgtaagggagataaagttttttcttttcctcgacttggttgtgtgtctccaaaatctgcaagagaggttatttattacaagttagtagaagaagaaaatgaagaaatgcataatcaagttatagttaagaagattaccgcttgatcaacttcaattttctgggagacattgacggctttgaggacctcaaacaggacggcagcagtttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56513 - DNA, 893 bp, Oryza sativa
ataaaatagttgataagtccagcaaaccaaagaaaaattgtgcagatttggtattcaactgtatatgagtatcttgtgtcctgttttgattataattgttcttgttcaaatctttgcacggtcatttgaatagtcattcttcttctgaacaaaatacatatatacgtcgcacaagtttgtgtgcatccatagaaatgcttcaatgcatagctctctttggcaaattccatcttcaagatttgatgttctaattaacatctgacttgctgtctctttaattggaaaacttgtgcactgcagtgtcttgactccttactacaaagaagatgtccttttctcttcccaagcattagaagaccagaatgaagatggggtttctattcttttttacttgcaaaaaatctatccaggttctctcgaaatgtcaaaatatcgaggtttacatgactcaataattcccttgaaatcctcctggatatcaaaatattttttgtttctcggtttccttgtagatgaatggaaacatttccttcaaagggtggattgcaatactgaagaggaactccgtgagacagagcagttggaagatgagcttcgcctttgggcatcatacaggggccaaactttgacgagaactggtattttctcctcaattctctgtcatagcttttacattttattctcttgagaacaactttcagatagtaatgtgtttaggagtttgattcattgacagctgttgcacttccttacagtcagagggatgatgtactacagacaagctttggtgcttcaggcttttcttgatatggctagagatgaaggtatttcttagtggctgagcctgtttcttgattctgaaggctgtacacttaattcattggttttgcttg

SEQ ID NO: 56514 - DNA, 4574 bp, Oryza sativa
cctcctgatggccgcgccatggaccgacctggctgcctgaccccctagcctcttcttcttgcacagctgcagcagcaccgcaagcgtcgtctcgtcgcccaccaccccaatctgcaaggccagcagatggagcgcctcggggtagctgccagcgtgcacgaggcctgagagcatggtgttccaggacaccacgttcttgacggcgataaggtcgaacaccttcctcgcggaccgcagatcgagacatttggcgtacatgtcaacgagcgagttgtccacgaagagatccccttgcaagccccggcgcgtggcgacggcatgcacggaggctccggccctgacatcctccagcatggcgcacgcgcgcagaaccacgacggccacgacaccgtccggctgcagcgcgccgtcagcgagcatctccctgaagaggcgtagggcttgatcggcgtagccggatcccaggcaggccccgatcatggaggtccaggacgcaacgtctcggtgggcatttcgccgaacagaatcgcggcggaggcgaaatcccccaaagtggcgtagagggagagcagggagttggcgacaggcgtgtgaatggaggcgggcgtcttgagaagataggcgtggatcatgtggaggaagtggtcggaataggagcaggaggcgcggaggagggagaggagggaagcgatgttggggtggaaggcagcgtgggcgtggcgcatggcgaagcggaagaggcggaaggtggtggaggaggaggaggaggcagggaggtggttgaggagggtattgtaggttagagaatccctgggcgtggagcggcagcgcaggtggtggagcgcgagatcgaggcgcgaggagcggaggtagtagcagaggagggagttggaggcggcggcggagagaggccgcttggcgacgtcggcgtggagctgtgaggccagagcgcgagcccagcctgatgatggctgctgcctggacaggagccccaacaacgccgggaggagcgccgccggcttgccgcccgcgtaccgccggaccgcctcctccaccaccacgcccgccgtcgccatatttttcgtttccactcctcttcttacttgttacactacatgggcagcatatcttggtaccaaatacaacttaaattaaattaattttgatccctgtcaaatttattcgattggagcattggagggagtactaaaaagcaatgtataatagtttgttaacattggagggagttctaaattgaaaattaatgtttttgtttttgtacctaaaaatgtgtacaagcgagttgttaaaggttaatatatatacatgaagagcaactaagaaaatgatgaaaatcaatcagtgaaatcacccatggccttccaaattaagggggaacataacatgggaatccaaccaagagagagagagagagagagagctaggcaactagtagctagaatgagcagatggaggaattaaggttgggagttgggaggaggcgtggtggtggtggctctttgcttgtcttcccatggctgggactgggaggcgacgtggtcgagggctcgggtgacgtctgtcatggaggggcggaggttggggttgtcgcggaggcagagcgaggcgacgacggcgagctggtagaaggcgcggcgggggtagcggccctgcaacgccgggtcggccagggcgaagcacctcttgcggtcgccggcgaggtaggggcgcgcccagtcccggaggaggaggaagcgctggtggtcctccgactccgagtcggaggaggcggcgtcgaaggccctgcgtccagtgatgagctcgaggagcacgacgccgaagctgtagacgtcggacttgacgttgagcttgccgctcatggcgtagtcgggcgcgcagtagccgtaggtgcccatgacgcgcgtggacacgtgggtgtcgtcgccgacggggcccagcttggcgaggccaaagtccgacagcctggggttgaggtcgtcgtcgagcaggatgttggacgccttgaggtcgcggtagatcaccggcggcgtcaccacctcgtgcaggtagcgaagccccctggccgcgccgaccgcgatcctgacgcgcgccgcccaccccagcgccagcgggggctcctgcggcctcctgccgaagaggtgcgcgtcgaggctgccgcgtggcaggaactcgtagacgaggaggcgctcgccggcgtcggcgcagtagccgacgagggagacgaggttggggtggtgcagcatcatgagcatcatgcattccaccaggaactcgcgggttccctgcgcgccaccgtggcagagctgcttcacggccacgagcccttggccgccttcctcgagacgccccctgtacaccctgccgaacccgccctcgccgacaacgttggactcgtggaacccgtccgtggccgccgacagctgcgccagcgtgaacttcttcgcaccgcccgcccccgccgacgccgcctgcgcggcctggctgcacgggctgccgccgtcattgctgccatgccagcaccgcaggctggggttccacgagaagcagctcatcccttccttcattcatctatcctatccattcatgtcatcaacacaaaagctttcatcctcgactcgacaaaaccaaaaatttggaggacacacgaggctcttcttaattaagcaaccagacagcttaatcgatcgatcgatgcttaaactacatctatatttagatacagcccaggacgcgcaattcatccaggacagagcacagggcattcttctgagtgttgttagctggcatatgtacatatatagatacataaatttcacaagaacattattatgtgttcacggcagaatagatcagattatttttgtaagctatatatcagtataacaataacaaacttttggaacagagttataaagtggaggcgagcttcatcccctgcttcaccaaaaagaacatctgtcgcaaactcacaaggaaacacagtgatcatggggaaactgttttaatccctcgaggagatattccctcgttctttgtatgtcacttaaatggttataaaaaaatttaaaaaaaatgggaaggtgtattaacatgtgatataacactccataaacatacaggttcaaattcaacttctacatctcgtaacgaaaaaaacaaattgaataacagctagttaacgtatattcagagttaaatttatttttttcgttgcgagatgtagaagttgaatttttacttgcatgttttgtggagtgatatatcacatattaatacattttcttaattttttttcaaattttttataaccatttgagtgacatgcaaacaacgagaggatatcccctcgagagggatcaaaatcctcttccgtgatcatgccattgccatacaaaatgcatccaacaaggcgcaactgctgttacaagcgcaggcatcttataatacaccacttcttttaaaaaatgtaattcggtttcttataaagtcaccacaccaacggtttgtggcagggtagcaacacgatgcatacttattaaacacacacaaacctaaaggcgagggatatagtttaagggcagtccaaaccctccacctaatatggtgtctatagcgttaactacattgtcatgtaggacttttaacttatgtggcactatattaattaagagagagagagtgaagagtggaagaaactgggtctcatgcaagacacagcttcaacacgagaacctatgcactagacactatcaagttttgcattgggagagaataatgtcttcataataggcgaagaataaatatgattggcagagaagagagatgatgtatttattaatggcccactctaagaaatcatgggttgtggggtgtagtttctattgtgatgtcttattgacatggcactatagacattacttatagacattatgggttgggactgccctaagcatgcaaagtgaaagctaaactggaacacagctgctcaaggccagggcaaagtagatgcctggatcaaatagttcattgcctggctcgtgaatcgtgattttgtcctgctggcctcctctggggttgatgggaacagctccatgtaccttgtcccaatggtcatcttgtccttgcatatggctgtcttcgcaacccctgttgttgagaactccatagagggccttcccatctagacggtacgcggtgtgcacattttcctccgtcaactcatactctacaaagaacttgatgatgtcttcagcggtagtaaagtagggcaggccacggagcttgagcacatcaggtggtgttcttttctcttgaagatgaagattaagttttttacgtaaaacgaggtggtattaacgtatgattgattgagttttaattattataaacttgaaaaatagattaatataatattttagagcaactttcatatagaaagttttcgcacgaaacacaccgtttagcagtttgaaaagcctaccacaaaaatcttaatcttcatccgacttttgttggagaaaagaatgggacctcaatatattccatgttgctcg

SEQ ID NO: 56515 - DNA, 4108 bp, Oryza sativa
caaatgtcaagatcgccgcagtcaaaggggagccctagtagacggacccctgaaaagttctggatggcactattagctcctgcactaggtaagttggcctggtagggctagtagaaggcattggtgccatcagcagcactgttgcccatggctccaaaaatagagaggggttggttccatcatcctggccctctttgatacatccaagggactgcctgcggtcactgcgaagtatggattggattccatcattcgtagcctctttgatccctcctacccatccaaacccccctccccccctcccatcattgcccatcattgcccttcagataatccagagtcccaaaaagagaaaagaaaaaaaaagagaggagaagatccccccatctctcaatccccatttcatataaaataacccaaacataaagaaaaccgcgcagataagaaataccagtaatctaaacaggacttaaggctaaaaaaggtgaatggagtcgaaatgcgaacgcattagtggtcataaacaaaaactaattaaatgttgacagcttatgaaatgctcaaactactagataacacatatcattagaaaataatcttacaaaccacattggtgcagttatcaatttggatgtaagtcagctattactgcctctgatttatttattttttgggggaggggtttggttttgtagggagggggggacgtacatgtatcctaaatactaggcatatgatatcatatcatatcatattatgatagcaaagcaaagtgacctacttttagatggggactaagaaattgtccctaaaagaatcgagaaattgatgagatcgcataagcaagcaagtaagcgtggattcgtagtattgtgaaaaaaaaagaaagcaatggatgaatcggcgggatggaattgcaggataagagagaaggaagaggaggaggaggtgccccggtacatggcgaagcccgctggaggagggggtggggtggcggttcacgatagggaggggaggaaaccctagagcgagagggagtcgtcaagtcgccgcctctgcgattgtgttgcaatgcgcctcgcatcgcccaagtagtcgtctctaaattctaaatacaacctatacgctatatgcataggacgaggaggaagagctcatgaccgaactgcatttcttgttgctgggtctggattaggcctattacttctattttatttttttctctagaccaaaataaccctgcctaattctctcctttctcccacgcccaaatcgcgcacttcccctgttgaggagggaggcgacgtcgcccgtctctccgcgtcggctccggcgccgacccactcccctcctccgccgccatccatctattcgcgccgcaccgcccgctcaactcttccttcgcgcaggcggcggcggtggcgcaggcggcgtcttcctccacctgatccacctccacttcctccggaccgcacaagaataagaagaagaagaagtgcaggtacggtgcaggtgcagatccaattgcgagctcacctgctctgccctgcccactaccaagtagtagcctcctcctcctcccctttctccccaacatcccatcccaaatcaaaggctactagactagtgttgggggagatccaagagatggcgcggagcccctgcgacctccgcatcctcctcgtcgccgccgctgcagccttcatctacatccaagtatgcctatgcctatcacaatctgattcttcttcttcaacttcagatcaggatcccccctctcctaaccaccactctactactctctcactacacataatggcttctttctccttgtttcaggtccgccttttttctactcagtcccactacgccgaccgcctcgcacaagcagtcagtctctctacccccccccatctcaatatactccctccgtttcaaaatgtctgacaccgttgactttttagtatgtgtttgaccattcgtcttattcaaaaaatttgagtaattatttattcttttcatatcatttgattcattgttaaatatactttcatgtacacttatagttttacatatttcacatttttttaataagacgaacggtcaaacatgtgctaaaaagtcaactgtgtcaaacattttgaaacggagggagtatatatttttggtctgctcaaactcactaattgcaatttaggaaaaatccgaaaaccaatgcaccagtcaactccgctccttgatcgatcaagtcagctctcagcaggagaagattgtcgcgttggaaggtaccacacatttatcacactaatttaagccttgcctctactattcgcgacctataaatgttgtgtctctcatgttttggtaacaacagagatgaagatacgccaagacgaagaacgtgtacacctcaagattttaatccaagatctcgaaagtatgaaaatgacctttcttatctttcacctatggatttcagccacaactgttcctgctaccaagtgtttgctacgttacttgatttttctcgcgcctcctaatgtttccattaaaacctaaccttgtgatactcatactggagcctcatgcacatcgacctccatgtgacatgcatggttgacaacacaacaacatatgacccgatgtttcttcttgaaattcacatgttttttttcctataaccaatagaactgaaaattagtatgtcttctggaaatatttttacaactacttattttttttaaaaaaaaatggaactacgaaaatgatgtcaatccatcagttagtcagttgtttagttaaacaatcattcataaatgcccaaaatataatagtggaacatcaggaccgtacatatcattctagttgtcatcttcacgttgaatacaaaataatagtttcataatcctcccatctaccccaaatatagaggttatgtttctcattaccatttgacatgtcactggcgtgtggctctgggtcccacatgccattctcatatgtggtagtgcctttcagtttacacccattcgcaacgtgctgaactaattttctcaaacataaagatgacccatcgtatgatctcaatcctcccagctgccatctacatatttaacccgtcattgtgattttactttaccacatgctactttttgtttctaactatttcttcaacatttcttttggatgcagaaaggagcgtgcagaccttagtaaacaacaatgtggtttgtacagtgctaatattgctagcattcctctgctatatttgactaatatgatctgtttctataagcaggctcctgttgctgctgttgttgtaatggcttgcaatcgaccagactatttgcaaaggacagttgaatctatcctgaagtatgctttgtgccttcattcctttattttcagaatccagattttttttggtctgttattgttttttctaactcctaagttggtgccaaaacccactcagtcgatatcacctgtgaaagttatgcatggaatcatgctgcattgtaattgccacgctgctcatggtgcatgaatgcataatgtctttttctcagaaattgtccatgcgatgtcacaaggaaaattacacattttacttcctaatccatatatgaatcccattgtgagctccatgtagcttaagttcgtataatacccttctgacctaatgattcttaataatttttccaggtatcagacatcagtggcttcaaagtttccactatttatatctcaggtactggtcttagcaatttcagttcttgctctcagtctctctaagtttgtggatttttttccattgctcattgtaattgcaggatggaataaatggagaagtgaagaaaaaagctttgagttataatgaaataacatatatgcaggtgtggaactctttcttcctctacacttatttgcctaaaaataagaagaaatatacttctgtaatattgcaagcatagctggagtattgtctgaggaccttttccaagtaactacataagatgatatgttgcaaaagaggggttaaaaagaaaggaagaaactgtagcctgccaagaggttttaagtggacctagattgaggttgcccttga

SEQ ID NO: 56516 - DNA, 1803 bp, Oryza sativa
tttcctgctgttatgaaatgattgtaaacatattatcacatgtgtacttttatagtgattttgaatgattgtagcttcccccctccacataacataggcatgcagcagtccgatatttgtaagaaacatgggaaatatttttcagctaagactctcagtggtatgtgttgcagcatttagatcttgaacctgtgcgcactgaaaggccaggagagttgatagcatattacaagatagccagtaggtggtcctccttgattgatgtatgctgattgaagatagtgatgataccactgatccttgtcctgataactttcttatttcagaacattacaaatgggccttggatgagctattcatcaaacacaactttgcgcgagtaataattctggaaggtgttacaccttggatgctcttataactattttgttctttgatctgtcttctttccatcccatttatggttaataatttgctaatagatgatatggagatcgcccctgatttttttgactacttcgaggctgcagctaaattacttgataacgataagtatgttgtatattatatattaattatagttggaaagccaaggatttcatctgcaatgtatctaattgctttgctgctattcctgtcactgtggtattgaaggacaatcatggccgtttcttcctggaatgacaatggacaaaggcatttgggttacgacccaagttagtactctgatagacctgtataaaagttctgttctgcattaatagggaaagctactcattttcctacataaacattttgcagaagctctttaccgggcggatttttttctgggacttggatggatgttaacaaagcctacatgggatgggctgtcacctaagtggcccaaagcatatctttactgttgcctactaatttctatattagcatatacaatattttccatctacatatatttcttccttaacaagactttacttattgggatgactgggtgaggctaaaagaggtacacagagaccggcaatttattcgcccggaagtctgcagaacatacaattttggcgaacatgtatgttggctacttcatcaatgcaaaaattaccacatttctgcacactagtagccactggatagtaatttagtctttgagccagtaagtatggatgacttgaatttacactaatagattttcatacctccttttcaggggtcaagcatggggcaattcttcagacagtacttggaaccaatcaagctaaatgatgcccatgtatgcaaaccttccatcaccttttgttttgcttaactgttgcaaattctttagtgcagagatttaccattttacctcttccttctttgtggctatagatcaagtggaattctgaggacctgagctacctcaaggaggtaagaatttgtttggactttgaaacagtagtttgcagcaaatgcctaatatttatgttggcaacaccaggacaagttcctgatccaatttgggaaagacgtcgctagtgccacccctctccatggatctgatgccgcgttgaaagcccacaatatggatgcggatgtaaggatccagtataacgatcaggaagactttgagcggatagctcgtcaatttggaatatttgaagaatggaaggtttacttctttgaccccatttttattcataaataatgctcttgtcaaagtaggtcaagtgacaattttgtgtctgatgttttcagtggtgattgttaggtctagtagaaaatgtttcagtttgcagttttgatctagatagacatcagccc

SEQ ID NO: 56517 - DNA, 1097 bp, Oryza sativa
tataccgtactatcaaataagcacgcccaagcaatacactgcgagagtttgatctatccttttttcccctatgactcctttctacactagatgatgccttattcatcggtttggatggtcaggtcctgtatgcccaaatcttgatataatccatgcacatagtcgagcacggactggcaatcaccaccattcttcacctatacacacaacacaaccaaaacgcgaactcagtcactaggggctaggggcttgtttagattgtagccaaaataaaccttaccaagttttggtaataccaaaattttggtggcaagatgacaatattgccaaatttttagcaggatttttttatgtatttactaaatttggtaacaaattaaacgtagacattttttttggcaactttaaccaaaaatggtatggttgaaaatgacatcaaagtgaataggccctagggtaaccacaacaagctgtctgttagtgttaggaggcttggcgtaaaagatgtacccggatgtcgagagatccaacagcgtgaccaggtacaagctcccaaaatcgaccttgacatacttcagaaacatcctcgcacgcagttatctggtgagcaaatacaatacatacggaaatgtctcaaagaagctttgggcttgccaaaatgaactgaataatatgcaaaaccaaaccgtgtacctacctgtctgaagcacttggtaagagctgaaggtggcacattgcctggtgcaatttgcagaaggatattaccagtagccttaaagagtggcaaaacaagcatgaacactgccactgaaacaattcccaggcacaacacttccgcattttcaacccttaaaagcagtaggcataaagtcattttaggattaagtgccaagctaaaagtgaccgtaacattagaggggcacagaaaattcgtcagaatagatttaccccaatgaaagaaaccaggaagctagtatcaagcctgcactgatggaggatttacacatgtcaactaaaaataactaacttcgtgactacagaaagagcaaatattataagggaagaggcacagtgacatgagagtatctcatacctcc

SEQ ID NO: 56518 - DNA, 710 bp, Oryza sativa
tgttttgtatatgatttactttcacttacaaaccaacgaaaggaacatctgatgcttattattttcatataaatcaaatgggtattttccttgatctttgtaagtttgtaattaggatgtactatgcgcaatgcctctcataaaatggtggcttctgaaacaaaaaccaaactaggcttaagatataacacggtgtcttcttaaaaaattcgaacaatacattatgtattatttatcattgttgtcatgccatacctttggcaatctcatgctgttgatattattgctgttattattctttatattatgtcatatgcattatcatatcttttgtgcagactacttgaatcagtacatggtggaaataatagaagatatgaagggattacaccacttgatcagcaagaccagttattcactaaagctattgattttcctgtaaaggaatcacatgcatggactgaaaaggttatatcttttacctgcttatttatttatctatgtttagagcagcctgttgctttatactgtatttatacctttcctattggtttcagataaaaagacttcaccttctgctcacagtgaaggaatctgctatggatgttcctacaaacctggatgctagaaggcggatatcattctttgctaattctcttttcatggacatgccaagtgctccaaaagtccggcacatgttacccttctcg

SEQ ID NO: 56519 - DNA, 1473 bp, Oryza sativa
cagttatccatcacttcgggttgcctatattgatgaagttgaagagccaagcaaagacaggaacaagaagatagaaaaggtttactactcagcgttggtgaaggcagctgtaaccaagcctgacgatcctggtcagaaacttgatcaggtgcttcgaaaatggattttaatttaatcattttttatgattatggcttcatgtgattgcattagtacgtctttattagtcacttcgttagattacaaccctattcgtaggttgtagttggactggttatgaaggttaagaaagttttgaatttgatgaatctacaagagaaactcacttgagtacccttccaattaagtgttctacaaatacgaaagataatgacttgtgttggtggtaaactggtaatgcggtaaacataggagagaatagcttaagagctaaggatttaaatctgcacacacaccttatattttggagaactggcattaactaaaatgtcttacataaagtaccaaatggagtattaatttataacgaatcgatgaatttatgaaattcctaatcatggatacaatgtttggagcagatgcattttctgatctggtggtgatacctactaatataaacttttctttgcgggaaaagggaacatataaaacttacttgaattgcatcatttgctgtgtaggacatatacagaataaagctaccaggtaatgcaatgctaggtgaaggaaagccagaaaatcagaaccatgcgataatatttactcgaggtgaaggccttcaaactatagacatgaatcaggtaaacagcactgatgcttctagttttgcaacattttctattctgtttgcttatgtaggcaagcataataggaacattacatggaggagactttgaaaatgagaaatctgctgcaagagtttctgaagaaacatgatggtgtgaggtatccatcaatacttggtgtgagagagcacatattcactggcaggtatagctgtgaacttgcgcttccccataaatttgtgactatgtatactacttctcatttaaattaccctatgatcgcatgtttgcttttgcagtgtttcttctcttgcgtggttcatgtcaaatcaagagacaagttttgtcactattggacaacgggtacttgccaatcctttgaggtgattcatcttactatggatatattttttttttagaatacgcaggagatctgcgtatcatttcattaagagaggaagacggtggaggaaaccccccaccaaggtcttacagagacaacaccaaacacaaagctcacgcagcaaaaagctcacatagagaaacacacacaaacgaaatttggcttttatgtttgtatggatttggctttaatatgcccatgttagtatgtgtatttttttgattcatatgtttgttattccttcatttagtaacagaatttggataattgcattgtaactaagca

SEQ ID NO: 56520 - DNA, 763 bp, Oryza sativa
gaccatgtggatgtgggtggatgcaagattcaagacaagcatgaatctctctctttattactgcaccggccggtgttgtcgatcttgctagccaccgatttcactgctcaatacacaatgccacagctagcagctactgttgggtgtaatggcatacttaacgcagtcgatccaccaagctcacatacgcaggacattttttttactctttgaatttactgaaacagccagtacaccaagtacactctgtttttttttatttgacactgttgactagtataattttaattttggtcaataatattttttttctgaattacgatgttttgataaatacaagtagtagtatatccagttctttagcatgcaaattgccaaattacatagataatgatatgttttcaaatgttcgtatttttttaaaaaaaagaagatgagcagtcaaagtctgtacttgcatagtacgtactatctgttgtcaaacaaacaaagatgaacggggggagtaaataggtacaaaatcacaaacattttcccgcgtttcatattatttgaggtagaaatgcattcatgtgtaccgtgcagtgaaaatggcctcgtcgtggtaccgaatcaattcaacgattttgatcttgggtttttttttttttttgggaacgcgtggtgtgtgtgcaggggctgtacggacagggggaaaggcggatcgcagtcccgtagctgccgcagatggggtgcctcccggcgtcggtgacgctgttcggcg

SEQ ID NO: 56521 - DNA, 1020 bp, Oryza sativa
aaaagccggatggcatctccaaggtcaagtgcttcacctacacggtcgaataattttcagaatatacatatgaaaaatacagagtggcatacttgggtaaatctaaaaccacctcacctttcttagcacaattgaggacgtaatcaacactgacttgatctatatccacatcatccaaagagatcgcaccaggaggcattacaactttcttgatcaagttaccagaaagcatgtagttgagcaatacatgacggtcacggcgataacgttgcatcagctcaacaacattttctctggttaagttgatatatagaaaaagcttagctcacaattgaacatgcatatactgatctataatacctattctgaaacgatcattactcgtccatatcgtgtgcaggggagacagcaatctgagttcagaaacactgttggaagcaccccaagtcgctttcagccagcatcgctctcctgcaaaacaaaaggggttaactacatgaaaaagtgctggggtgcgtaaatcggttggggctgaacagtttatgttgaaaatagctagtgaatcatgaatctgatcctacaatcggtccattttgcctgtacaaattcacaaactctcgctattaaaaaggaaatggaaatgacagccatgcagtggccaactgatgattcattcaagaatgcacaaactgagatgatccatgcctcctctcagaccggccaactcaacctccctactaaatcacatccgacatccaccagtgacagaactgagatcgcattggcccgcagctcccaaatcatacatacccgatccatccatccaaaccgaattcgccacaccacagcgcccccgcatttcaaacaccgcaaaaaccacaccaccgcaacccaaaaacaagtcgagccgaaacgaagaggaagcgcatatccaagcagctccgcccaccaccaccaccaccaccatccaaggccggagggcgagggcgagggcgagcggctcgggggctgggtggatct

SEQ ID NO: 56522 - DNA, 1134 bp, Oryza sativa
aggctcaggctatcgtccgagacaagcagctcctgcagccgcattctcctcgtcggactcatccccatcctgtaaacttttctctattctaagctgcgaaattcccttattttgttttattctgagatgaatttttttcctaattctgcactcgtacgccttggtgcagggagatgtgtagcttcgaattctccaccatcgaaaccttgcttctcttggacggcatagagctaccggaggaattgtacgggttctctggcaatgtcgtgtatgtcagcgccgctgtgatgaagaaagtttctgggatgcaatcagttgattcaactgaggcaatcgctatcattcacatgcctaagtatttccgcgaccttgacagcgaccagggtggagctgttcttgatgagtggctcggctctgcaaagaggattttggttctggatgggattcaggtaaaaagaagtgtgcaatattccgttattatccatagtaaatggatgtcattttgtgcataagacggcacataatatgttgtttattgtttattttaagtttgaactagtccatttgattcctcttaagcaagggttctaaatttttactgtgtccataatggttctatcctgcaggaccctggtaaccttggaacattgataagatccgcttgtgctttcagatgggtatgtcatttactactaattgttgaagcgtctctgattgcatttctcaaaacttgatgtttcatggtctcatggatcacaccatcctattgtttcatataaagtagttatcacagcttgttttacttctcaataataaggtagaacttaagtgataaaaaagctaatactactggtagtatgtagaattattaggtttgcacttgtttttacatctaaggatgatagtgtaatgctattaatgacattttgaaagcaaaaggttagtacattctgggttagaaggctagaaaccccatacgtgttctacatttccacaaaaaattatgctcctattatacagcatcagatgaagtttagttagcagttagcacatgccaatatgccatcacacaaaaatatctgcatggtgtgtagcctcccagaaatttatactaactcttcaaccgctttcagt

SEQ ID NO: 56523 - DNA, 1521 bp, Oryza sativa
gcacccacctgagatataagcccagatacccaaattattattttttccattataaatagagtcaatttgaacactggcatgttcttgatccatacatgactgaaacacaaacacaagaatacgacaacacctaaaataccacatgaaaatgcagggtcagcttggtagggctctttccgactgtttcccattttttttaaaaaagaaggaattctgcagtgatcatgtggcacggacacatggtactggtctatgtcttgtctgtgatttacaagggacttcaagaagatccttactccctagtgttaaacttagtaagtgctcagcaaaaagctaggtattgacagtagcttatgatttgtgcagttgacttgtgtgaagatcaggtgcttcaattagtccatttggtaaagatgtataaaaatatagaggaaggcgtgcaaatctgcagtcagggacttctaaatgccaaaggaaagagttagggtgcaggatatggaaataacatgcattattattggttcagttctgtatatatgtgctttgaatgaagtttcaaggttgaaatcaagaaaatagaggacaggaacaggaattcgtaagtgtcttaagtcacctattgacaatatatcagattgctccataaattgaatatgcaccagaaagtagaactaacaacatcaggatatacaatcttgtacaagatgtagagctagcagggacttttctggcactcacacgaggctcgatacgcattagccttcgctccaacctttgtattctagaaagcagggcagcttcgacaacctgaatataagagaaggcaataaataaccagatcatcttggcccagtatttggcaggaggatggtactctcaataatcgggtgaaaatgcaagcatagcatgacatgttggcaaatgcatgatggcgataaaaatgttttttgtcagcaatatatgttaaatgatttaatataataactaatgagaccaaaaaagatattgtacaatcaaaaagaacttttaaaatcaaagatgataatcctattcttgttcaagattccattcgaccgttaagagaaactaggaaaactcatggatgacaatcttattcctatgtgagttgaaaacaaagtaaaccttccatggaggcaaatataaatgaaacaattgacaaggaaaatatcatcatattaagactgttccagaccacaaatatggattaatataagaatatccatatgcctgatacctcaagttgaaatggcattgctggtccaccattgatatttcttggatttaaccgtggcagtaatgaatctaagaaggcctttcctcctgggctactcaagtcagataaaataattgataagtttcataacaatagtgatgttcaccaagtaaaatacaatttatattaaaatgactagtgtacaaactgacctgttgtaattgaatataagaacgcgttcatgcatagcaattgctcgcaaggaaccaagatttactaatatggct

SEQ ID NO: 56524 - DNA, 1122 bp, Oryza sativa
atctaaagtagacaagggataggaaccaattcatgctcaaatccaaattaaacaaagcaaaagaagactcaaataaataaccgagcatgatgattttatgcatagaacaacatttttcacgaaccgagacaaaagacactaatgcaactgactaaacaataacttaatgcatgaaatagatgcatagtcatactgatacgcataaacttaccccacctgaacatagacacgacctaatgcatatcacccgacaattcccgaccgactgccgaataaattccgaataaacttttactaaatccctagactgtcccaagtcgagaaatccaattaaataagcgaccaagatttttcccacaaatcaaaagaacaaaccccaaaatgttcccgaaacaaaatccaagtgcaaaagggcatatgcataagaaaaaaaaagggttcagagggctcttaggtttccagttggcttgtcctacggtcaaggtcggctctgataccaacttgtcacacccagaaattctcgaaccagaatttctaagctgaatgtgcattaaatccctgtccaggaccagccaaggcacacaaacgacaattgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaaaccaacctctctgagacggctccaactgagaagaacttcaactctggtgtgggggaaaagagagcaagactgagtactacccactgtactcagcaagtcataccggaagatgaggtatgatgcaggatataaccaaaggaagctaggggttcttttgcataaagcaggcatttcaaagcagtagttgaaagcagtaaaacagctgtagtatacccaagttatcaatggcataaggtaaccaatatgtggctgaggaataggacccatcccacattacattgtaaaagaatgcaacattgaatagaaatgcaggatgttggtaaattgggtacaatatgatcaaacgtattgcatgacttgccttgctctcgaactgatgagacctca

SEQ ID NO: 56525 - DNA, 2588 bp, Oryza sativa
caatatagataagcaaatgaaaccctttagggaatgtgcaaatggattgctcactttgtattaagatggagaaagaaaagttacatcatcagcgattgggcatgcaaaaccagcagattgaccgaacaaaaaaccaaatacaaccaggcgactatacttcagaattactgaagacacatttttctaatcaggttgctgtactagctgtgcggttcggataaagtcaggacaaataagacaacctgaagcacttggaatatctgttgaactaaaagataaggtgcatccatctttttatgctttgttgtcactattaattaagtatatcatgtttttactgtttctgctacagtttgcttgccacttgatccgcctcattcctcaatttactcagtggtttcaacagtgtctatgttctatccattagtaacacacgatcctacccagttagtattctttacaagtcaattgatgttcctgcaaggtttcatggccttcagcttcacaatttcttttattcgttacaaaagtatcacatttatttgtaatcaatagtttggatggtactatctaaaacaactgatttggagatgaattgttgacctgttaggatccttaaaggttcccttcgattttggtaagatagagttgtattgttttctttaattagtgtgtgaattaggtgttctagttgtgtgcctataaaacattcattattctgattcttctatttggcataacaaaaactgaaatggtgatatgttgcatgtcttattacttcctttttcagggctatgcattgttgtgtgttggttttccaacttctgatgttgaagttgaaacacaagatgaagatgaggcaagcattaagccaccttgttaatagtagtaactgtcttatctaaccatacagaaggaactagactgtattcttctgaattcttatgataagtcctacatgttccactaagcacataacacctcaatgtataggtctactggctccagtttggaagatatttcgcacgaggacctgttgtaagtattattaaatttgtatttcacaactcatagtttttatgcctaggaactcccgtgtagacaatttatagcataagcgcataactgttgatgttggctgtggttgtcaacaccactgttattccaattccactttaaacatgaaattatatcttctagcttttctcagaaagtggactgctcttttttttcaggaaagggatgattatgcactggagcttgcaatgggtgatgagtgagccgtgtctaaagaggtgacaccaccagaaatttcaatctctacattgtttaatctgttcatttttccccttatattctcatctaactctcagttctcgtccttcacagtggtgtttgcagtcgggagctcatgttgtcttaaggactttctttgaaagtggagaaaggggctttttcctcagctcacaattttccatcttcagtgctgttactctgttagcgattgtttggcatgtaaaaaagtgtgctttcttgtaaaaataccattttctagttcgcacctgacagacgaagaacaccatggattacatgtaaagttgtaaactgaacacctaatcttgagtgcgaataatgaataatgatcaccggagttatgagtttgggaatgatatgctgccatgaaaaccttgaattgagtgaatttgaatcttaaatttatattcaaagcaaatgtagtttcaaatacttccgttctatacaaccagtttgaaaatgagcttctagagttcgttgtagctgagaatttgtagtaaactagagtactgatgcagggcaagttggttttatgttcatgttgcctcacgttacaccgttgtccaattctgcgtggaaccaacctgagaatgctcaattctctgaaactggagtagccgagatgaattcagacaaatcctctgcccaattaggccggaaatcagccaacttgttattcttcaccgaattagtcccacgaatgaattcggcacacctcttcccatcaactaaatcagactgcttaattcatgtcagcaaatacggtccacaaatgaatttcccaaaccaaaatagcaaatacccacagaagtctacgattggatccactagtgaatttggcccaacacatccatcaacgagttcaacccaccctcaaggaattcagcacaccaacaaatttggtcccagttaactccatcagtgaaattggcccacgaaattcccgcaaacaaattcggcccgctaaaagatttggtccatctgctacccattagcgaattcagcccaagcataaattcggccgtcttattctcgacatcgtattcagcccatgagtagatttggcctcatagattctcgtctacaaattgagcccaagagtaaattaggccgactaaattctgtcaactaatttggcccaaaaataaatttggtccatctattttccgtaaactaattcggcccatgagtagattagggctcatgggttcccgtcaacaaattgagcccgagagaaaatttgaccctctaaattccgtcaaccaactgggaaa

SEQ ID NO: 56526 - DNA, 801 bp, Oryza sativa
tactattgagaaggttactagtttataagctaaaaaggtcaattgcacaccatgggatatggtttacaagtatatatgggccatattgttagtgaagcagtctttatgcaagagcacctatggtatcaagagacaaatgatccactggcaacgaacactagtgatggatcatcctacttcatgacatgcttaactggaactacacatcaccatttccacaaaatagtaaaggctaaccaagattttgcaccgatctccttttcagatgaccgtgtctgacattatgaacagaaaaggtttgaaatcatttcataaaaaactgtttatgcttgaggaactcacttgcttttggcttatttgggctattaagagaagaacattttatatcagagtagacctcaatcagtggttatggaaacacatagggttattgcagaatgtagaggtacttagggcctatcataaatccataatgccaccacaaaatattccaaatagggtaacctcaagtaatagtactgcttggctagagctatacctgtctaaataatacccatgcataacatgtatcatgaatcgtctctgtaatgcctagtatccgccaagttgattttaggagctccaggatttcttccacttcctggtagattgaagcaaaaatgttaagagaaatacctgcaactgatagtgtatctagacagaggaaaattacaaaagatgattttaagtactggcctctgtaagctttccctcatccaagatatcaaaaacactgccgagcatttactcatacagtgccac

SEQ ID NO: 56527 - DNA, 728 bp, Oryza sativa
tcctgcagccctgcaggcctcaccaatgcataaacctgcaaaacttttcctttcattgagagctttgggagcacctgcaaatgtgattatgttagcagttcagggaatatttcgtggattcaaggatactaagactcctgtattttttataggtaacttccaagaactactcttcataaccacatgattacattggtttgcattagttatattccttttagcagtcctagcaaatattttgtggaatcacaataatgtttccaatatcttttttttccattttccacaataaagggcatactttacgtccagtttcatttgattccagactcttctctgatatcaaatatctctcatattacactatatgatgtctgtaccatgttcttttaaaacatgtaggtttgggaaatctttcagctgtagtgcttcttcctttacttatttacgtctttcggcttggcataactggagctgcaatttctacagttgcatcacagtaagttctatattgatacctagccccatggaatccaagtaaaacaacaaaggtaaaaaaagggaatattttatatgaatatagcagcaaataactcagtttggttccaaataccaactgtttttacttatagacatgtttctaaaataatgaaatgcagcagaaaataaactttagctttccttttggttttcatttatcagcaattcagcccacacatttaaattac

SEQ ID NO: 56528 - DNA, 717 bp, Oryza sativa
agatcagcagcaactactggccgtcgccgttcaacaagtggtgggacaacaaccggacggcgtacaacagcagccggtacggcagcttcacaggcgcggcgtcttcacggcgagcgaccagctgcagttcaacgcctccgacatgggcgacgagggcgtcatgcggcggctcacgctcgactacgacggcaacctccgcctctacagcctcgacgccgccgccgggcgctggcacgtcacgtgggtcgccgtcgggaggcagtgctacgtgcacgggctgtgcggcagcaacggcatctgctcgttccgtcccgggccgacgtgctcctgccccgtcggctacgtgcccaacgacgcgagcgactggagcaagggctgccggcgctcgcccgacgtccggtgcggcggcgacgacgtcgtcgacttcgtggagatgccgcacaccgacttctggggcttcgacgtcaactacaccgccggcgtcacgttcgacgcgtgccggcggctctgcctcgacgactgcaactgcaaggcgttcgggtacaggccgggcaccggcaggtgctaccccaagatcgctctctggaacggccggattccgatcaagcccgaccaaaccatctacctcaaagtcgctaggagtgtcaagcaccacatgatcaaccagtcgtcgtcatttctgcacttcgatggacacgcctgcaccgtggacgaacg

SEQ ID NO: 56529 - DNA, 2562 bp, Oryza sativa
cccacaacatgaggtgtgtttagttcacaccaaaattagaaatttggttaaaattggaacgatgtgacgaaaaagttagaaatttatgtgtgtaagaaagttttgatgtagtggaaaagttggaagtttgaaaaaaaagtttggaactaaacacggccatatttcccatatacaaccatgccactgtacatgctgccaaggagtaccgatgttcaatcaaaattcaagacagattcaccaaaccttttattttttccatctagcatctcacatgcttaaccataggccatattgtaccagaaaaggagtgaactacgcccacaacacaggtacatgatcaagaaggagaatgtcacacagttgctgcagattctaaaacacaaaaacggaagggaaacatgaggcttaggtagggagttgcatatagtgattgccacggctactgtcagtttgtcatgcatgagtgctgcgcaagatcccatggatgtaaccaccgaccatgaccaaggagacgagggaaacgacaccagctgggaatatcttcccggacttcttgaagcgagatcccatgaccgacaagagggcagcagatatacctagaatgcaaagcgagacaacatcagggaaagactccatgttgaagtaattccatgccaaggataataaggaccacaaggtccacaacataggtggctcagaaaatgattttgcatacctaaaccaatagatgatgcaaagacaggtctcactgggagttgagtgtggacgaagtacaggaccagggctgatatgcctcctgcggctaaggatttctggcttccactcttcatgtaccccatcgctccaccggctacagaatttggaatcacaatagtcaatttctaacaaaaatgaagctctcttttgatggcaacaaccaatgcttcaatataatctatcctcagatgcaccttgaaggctagaacaggctgtcaggctctgatgtagaacctcacacaggatggtaacaccacacagtcattcactccagtagatcataacgctattattgaaccgatgatgcagctaaaattataacaggactatcatctgctagtttcacagacataatcacaatggagaaaaaataattcaaaattttaggatgatcactcttgtgttaattttcttctttttttttttaggatgttcatttttaggtggttgtttagctgtactccatttcattcttcctaagagaaaatttgtgcacattgtgcttgcctgtaggccaaaatttgtgcacatcctgtgaccagtgatatacagagtgctaatgcaccatttgtgtttgtgtctacaaaaagcacatgctggtagttgtatcatcattgttctgatacaagctggacttgagaaaccaaaactcaaaaagcaggctgctgaatctgaatgttgcataggtgttctggttttctacagttggaaattatcaagtacccagtcaagtccaacaattattgatctcatcaaattagtaataattcgacctgactaataaggatttaattttattcacgagaataacctgacaagtatgtgtgttctaacttattgggaactagttggtgaaccagaagttgaaatgcacacaattaccccaatggctaatcactttgataaagaaatgcagtagctctcattctccaaaatcaaactactcgaatccaaggcgtttgcacactacagtagatcagtaggagtactaaaaatgaactggtcgtggcattactgcatttttacctccgacgagagcggcgtaggcgagggtgatcttctgcgacatggagagcccctgccccatcttctcctcctccccttccccctcctcgtcgcccccaccaccccgcggcttctcgctgtccccgccgccgccgctcccagagccgtcgcctgcgcctccgcctcccgatccgccgagctcgggctccctggccgcgacggcgacgaggaggcgcgcggaggggcggagcgagagggcggccggggcgcgggggcgcagcaggaggagcgagcactgggagatcggggaggatggcggcgcgagggcgagtggcgcgagtggtaaggtcgtcgtcgcgatggccatggatgagctcgagttccaacttcgagtgctcgagatggaggtgatgtgatggggattttttacggggaggttggtggtgtgagactgtgggtgggcccccggttttctttttcttttcttttcttttcttttcttttcttttatttccttttctttcttttctttttctttttggaattcctttttttttccttttctgttgctggatttttgggttgggttgcatctagaaggacgattcgtttcttgtggagcgcgtgggacgcatgactgcatgtgcaccccctgcatcatacgcatgttgcccaataaagaatttcaccacatttctgaattatgattttaaaattaagtttaattttttttccctggttacacggagcacacatacgcacacaccgtcgtacacgtataccagtgaagaatataaaaac

SEQ ID NO: 56530 - DNA, 900 bp, Oryza sativa
catcgcagatggatttttgtcgcttttgtacgtgctgtcttaaagtaataaaaaataaaaaaaatggtaagatataccaatatgtgaaagtcattccccacagcatcaagtaattgcccatctgcgttgccggcggcctttgggctgtcaattagtctgtagtactaacgatgtttagctcttttgagtacaactactttcaccggggtgcttgactgccagactgttctggctgcaggctgaggctgctaagagcaaaaataatagtatagctcacttcttattattagcatatcttaaagtcaacatatataatggattagttataaggttggctataattgttttctcttctctctagctatccctcacttatacatttaatgtatttgtcttggaatttgtgataagttagctcttgcatgaaagccaacacccttaatttttcactatctctcctccacctaaactcatagtaagcttatagctcattattatacttgctctaactgcactaatccaccggtcaagtaccaaggagctacctccatccagtgggagtaccaagaagcatgttcacttgccggcagtgacagtgaagattaatggttaaataaatgacggtacacactatctcaattgggaaatgtcactgtcagcaggctagccacattctttccccttttaaaccagtttttaagttggaagttggaactcacgcctccagccctgtggggttaggatacacgatgaatcgagtccatggcttgcacttgatcgtactcacctccctgtgttgcgttgctctttcggcgggcgagggcgatcgccgcagcgttctgtggcgcggcggctccatcgccgtggaggacgccgccgacagcgtcctcgtgtcgccga

SEQ ID NO: 56531 - DNA, 6504 bp, Oryza sativa
cttatatcacttaatttctctaacttttcctattgaatttagatagccaaagtaacaccggaaaacaaaaagaaatagtgactacaaaaactatgtttggcaaaattcaaatgaattagggggcatatgtatatttcaaatgaagagtcgtgtcaaacaaatataggaggctttccctgctttaaatggttttcgagctattttcatgaaaactgacaaaaccgctcaagagaagtttttgatcagtgaacggttttgtaaaccctgactgcaacccatctgattaggaacatagttcagcttttcattctctacattagaaggaaataactcataattctattatatacacctacatttatatgaaaagcatataattttaataagtggaaataagtcaaccctaaagagatgtagtttgactaccactatgggtgtatatactgtgtattttctgtagccataaaaccatatcatcctagaactaaatgttgcaacttgcaatagacttatccaaatctttgctcaattcctatccattggaatcaacttatctatatatttactcaatttctacctgcggaatcaacttatctagatcattggcgttgacaattacaactcacactgaaaggattactgattggtaattgtgtaattgttggcaccatagttgggaatcggagagagggaaaaagggttggcaccagtcctctatttttttttctcaatgtaccgagaagaaagggggcttagcaggaataataagatgaatgattgcgatctgtagcccatgtaagaataagaacgaaattttgcaaagacaaatgaaaatcaatgaaagtactaaagggaatggtgaaaaggaaacgcaaaatcaagtgaattacaataaggaaaagataattcaattacaataaggaagcgataattaaaaaatcacttattaattttattcgtcacgcgacgtcaaggcgcatatatattcccactatcctccacgcacgttatagggaaatggagacagaaacacgacgtgtcactatgcaattttagatgcgccaagaaaaaaaagaagatcaaattttggtgacacagccttacaatttcaagatatgcctttgataggatggcattgacttttcacattacaataataccctagttgaataatgtattaatgcatttttctcatgtctaataagatatttttaacatcatggtagttactcagaaagcgaagcttgccgcactgtaaattaatcgtcaatattaatactttgtttgtactccatccattctataatataagacacaacccatccattccataatataagacacaaccacttttcttagatgttccataatacggagtataaggcatacatgcaagcatgaaatataactatgacatcttctccattaaattattacttttttaaatcctccactctcatgctatctaatcttattggatgcatgcattatatttattaggatgatccaaactacaagatgataataattatttcttagtttttgggttaagggtggttgtaccttatattttggaatggggtgagtaataaataatagccctccaggagtctggtacaccgtacaacaccaaacgataagaaagtgatttcatctcctcgttacgtgcatgtcacctaaatggtcatcaaattttttttaaaaaaaatagcaagatagattaatatgaaatataccactccacaaacattcaagttgaaattcaacatctacaagttgaaacaaaaagaaacaaatatgtaagcgaatgtacgataaccattttaatttgttccttttttgcaacttgtggaaatcgaatttggttttgcatgtttgttgagtgatatatttcatattaatctatgttgtcaattttttttcatattttttaatgactatttagatgacatgcaaataatgagacgatatcccctcgagggatgaaaattcatttcccggcacgatgtttatttctgtggagtaatgactttcacgcttggtttggggtgtggctgctaagaaaattggcatatatgatatattcaatgcaggtgcttccattttgttttcttgtttatgctgggagttgagaaaatcttagtccataatcaactggtcaagtgccgaggaattgcctgggtctcattgactctgttaacttgttccattggcggctgtaataagcctgggacagtgagaattagtaaaagaaatgactgtttaatttgcagctaaacagtatctcaatttcgaaatgtcattgtcaacaaccatgttattttccctttaaatcgttcggagctcacgcatctaaatcctaaaccacctgggttccatgatgagtcgtcgaatccatggcatgtgcttactcgtcctagccaccttcctctcttgcattgctctctcggcgggtgatcaccggagcgttctgtggcgcggcggctccatcgccgtggaggacgccgccgaaaacgtcctcgtgtcgccgagcggcaacttctcgtgcggcttctacaaggtggcgaccaacgcctacacgttcgccgtctggttcaccgcgtccgccgacgccaccgtcgcgtggacggccaaccgcgactcccccgtgaacggcgtcggctcgcgcgccgagctccgcaaggacggctcgctggtgctgcaggactacgacggccgcgtcgtgtggagcaccaacaccagcggcacgccggccgaccgcgcccagctcctcgacaccggcaacctcgtcgtcgccgacgccgccggcaaccggctgtggcagagcttcgactggcccacggacacgctcctgccggagcagcccgtgacgcggtacaggcagctcgtgtccgccgaggcgaggggctccccgtactccggctactacaagttctacttcgacagcagcaacatcctcaacctgatgtacgacggaccggagatcagcagcaactactggccggaccccttcaagaagtggtgggacaacaaccggacggcgttcaacagcagccgccacggcagcttcgaccgccgcggcgtcttcacggcgagcgaccagctgcagttcaacgcctccgacatgggcgacggaggcgtcatgaggcggctcacgctcgactacgacggcaacctccgcctctacagcctcgacgccgccgccgggcgctggcacgtcacgtgggtcgcggtccagaggcagtgcgacgtgcacggtttgtgcggccgctacggcatatgcacgtacagccaaggcccgacgtgctcctgccccgacggctatgtgcctcacgacgcgagcgactggagcaagggatgccggcgcacgttcgacgtcaggtgcggcgaggacgtcgcgttcgccgagatgcggcacaccgactactggggcttcgacctcaactacaccgccgggatctcgtttgacacgtgccggcgtctctgcctcgtcgactgccgctgcgaggcgttcggttaccggcagggcaccggtgagtgctaccccaagatctctctctggaacggccgggttatgagcattccgtaccaaaccatctacctcaagttccctacgggtgccaagaacctgaacccgtccttgctgcacttcgatggccacacctgcaccatggacgaacgggacgctacggtcagcagctcgtaccttcatggcaggcgcaacacgataaacttcatctacttctacagcttcctcgcggttgtgttcgtcgtggaggccatttttgtcgtcgtgggttacctgtttgtctttcgagctgactccgtggcggcaggacgggtcggtgatgaagggtacagcttggtgtttagccatttccggaggttcacctacgacgagctatcagacgcgacgtgcggattcagagacgagattgctaagggcgggacgggatccgtgtacaagggtgttcttgaggatggccggagcatcgccgtgaagcggctggacgagatgacgcaggccgacgaggtgttccggtcggagctgagcgtcatcgggcggatcaaccacatgaacctcgtcaggatatggggcttctgctcggagcacccgcaccgcctcctcgtctccgagttcgtcgagaacggctcgctcgacaaggccctcttctgcgacgacggcgagagctccggtgtggtggtgttaccatggcggtcgaggtacaagatcgccgtgggcgtcgcgaaggcgcttgcgtacctccaccacgagtgcctggagtggatcgtgcactgcgacgtgaagccggagaacatcctgctcgacggcgacttcgagcccaaggtgacggacttcggcctcgtcaagctgctgagccgcgacgccggcagccacatggcgctgtcgcgggtgcaggggaccagaggctacattgcgccggagtgctggacggtgggccgcccgatcaccggcaaggccgacgtgtacagcttcggcgtcgtgctcctcgagctgctcagggggcagagggtgtgcgactgggtggcggcggcggacggggcctgggatctccagcggctggccgcgtggctcaaggagaagctgaagcgcgacgacgacgaggaggaggtgtcaacgtggctggaggagctcgtggatgcacggctgcgcggtgatttcaaccatgtgcaggcggccgcgatgctggagctggcagtttgttgcgtggacggtgaaccaaacaggaggccgagcatgaacgccgttgcgcagaagctcctctcgctgcatgatactcgctagagcatcagtgcatcatcatcagccatctgcaccatgcatgagcccagcatgcatcgatcacctttcctggaaggctggaaccccaatgcatgggactgtgtgtgtcataccaaaatgaaaaaaaaaaaacggatttgctataattgtggccacagattttctgtccaatcgcagtcgattttttggccttaggatggcatgtagattcgtgcttatgtgttgtatccgcgcgcgttttacggctcttccacagcttttgcctcgtcaattgactccgtgtgtgttgtttgatgagggacatgctgatttgaccgatggatgagatacgtgtagtaagttacaccataattacatcatatttacactacaattacatatgtaattttaaaacttacatatgtaattttggtatttacatagtaagtacactattttttggtgaatacaatgtaaataaatgctgactattttttgagggaaaaatatggcaccataaatatagctactccccaaaaaaaattgcttagttagactgttcagggtgtgaaactgtgagtgtagtagtgtacattgtcccacaatttatttatttatcaatattcactaattattctcaaaataaattaaaaatattggtgtacttctttatacgacctagtggatggttaagcggataaaatatataaaagcaagtcctacttttgtggattaacggatacggagtatgcaacaatcaggctgatggagtgtttcgtggggaaataggataatgtactgatgtggaagcacatggccccatttcgctgaagggaattcaatttttaaaatactgtatgcatctgcttgtgtgttatatatgtaaagagaggaaacgaagaacggaaaaataatatagagtaagaattttttttttcatttttagtggtctaatagaggctgagggacgaaagcgactataaagccctcaaaatcaatctaaaaagtaaaattggttgtatcttataattcgcgcgccttccacggaaattattggattaattccaaacggatgcaacttgatggcagaaatattggcactaagttgacattagcacactaaaaccaatcgtcgacggttccatttcttttctccaacgaattagcggtgttaactattatatgattgcgattgcgatgcatccagctggctggaataatgcaatgcaaaaattgacaaaacaattatgacaggatctaatcagaattactccctccgtcccacgataacttcatttttggatttttatgtccaacgtttaaattaaccgttcatcccatatgaaaaatttatgaaatttattttgaaaacatagtgacgcataaagtattattcatgttttatcatctaataacaataaaaatattaatcatataaaacttttaaataagacaaagagtcaagcgttgtatccaaaatctgaaaaatggagtcttcgtgggacagagagagtagtaatctaaagcacatttgtttaatacgcaacctagtttagtactaggtcgcactatcttcaggttgatctactagtacatggatgatcgatgctaaaaaaacgactttggttaatcgtgtttgtcaacacgaagaattgatgcacatatgtccaattagatggccacaacgtccaacttaacgagtcactttcgagtatgaatta

SEQ ID NO: 56532 - DNA, 1605 bp, Oryza sativa
ggcaagctaatacacttcagtggaacccgtctaaaactcacaataatgctatgttaggtcttattgtatgttgatgatacatagcaccgtattgatcgttcaaggctatagccaccagtaaggctatgcatgtagagcttctttaaaagtaccaaattttatgcatgtagagcttctttgaaagtaccaaattttgggggaatattgaatgattagattactatatggaaagaattcatgtgttcctttggaaagaagggatgagtctcttaaattcttttgaaatttcttagagtgagtttcgaaggatttttaatattacgtttaacttttttaaaataatttcctttgtgtctaatgattactccctccgtcccaaaatataagcattttctttttttttggaagtcaaacattttcaactttgactattaatagtaaaaaaaattaaaaaagattaattatgtaaaattgatgaaggatgactaatgagcgaacgttcgcttccgctcatcctcgtgaacgggtcaggctggggaggatcgaagatacgtggcgatgcgtgagaggttgtgtcgctacgtttttctgttcttaatttccttttttctcctttttacgtgaatcttttcaatttcccgttatttttttacgttgattctcccgaagcgatatgtatcatttttttgtttttgcattctgtttttttcaaattacttttttttttctttatagtcatttttatagcttttttaatggaacttcatattatgaattatattttgcatgtataaatttcagtacaaataaaaaatctaagcatcaccggatttttttttcaagaaataaaatcgatttgatagtagggaaaagtgattggttggtctctaactaccatatacgagcttaaacgagtcattagaacgaataacgacgaaacctattaaacgttcgtggaatgcaaacgtttgacgactagacccacccatattgatgttactagaatttatcattaaacaaactatcataatatgtaactctttttatttaaaacgtattactatattttactatattgttaaacaaagtaaagtagcatctctgggtactgctgctaacgtgtcaaaatgaaatgtttatatttctccacttgaagatattcatgtcaaagtggaagatcccacgaagtcgtgagttgaaagtaatatacttgtccttaattgataaggtctttggtttcttcttcgaagtgggaacgaattatttgaccgaccaagttaacgaggccctacaataatcataagacaaattctgacgttaattgaaagcaacaatgctgtacggctgtacccgtagcacctgacacagtgaaatgaactggaaatatagaaaccaaaatcggaggataaataccagaaagatcatccaaatcaacatacactgtgcctagcgacgttgggaccattcattgttgagagaacatggtaagttgggccaaggtaattggttatcttaacgtagaccacgcaccttcacaatggcagccgaaagattcagaaggcaactcataattacatatcagttatgatttggggctgcaggaat

SEQ ID NO: 56533 - DNA, 1054 bp, Oryza sativa
ctaaacacaccttatgttgtgcagtactactataatactcaatgcggccggcagcaacaggtggcaagtcgtctccggcggccggtcagactgccgcgttgggctaattcgccggttgacactgtcagcatggtaccggagcggcagtcgagcagaggcagcgaaaaaaatgctagtataggaatccatcactgcaaaattgtaagcttcgtaagatctggaacaaatgctgtttgtaaaatggaggaacagccggaatgccagatacaagaaaaccatcctcaactttcatgcatctggcactgtaaaaccccagtgccgaaactgaaattaggccctgtttagatgggactaaaacttttaagtccctatcacatcggatgtttgaaaattaattataaatattaaacgtagactattaataaaactcatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaaaactctaaattagtgtctaaagacagggactaaagttaagtccctggatgtaaacaccaccttaacaattaacctggatgatatcattactagacgaacacaataacattgtcaggcaatgatatgcatgatgtacaatgatatactactatcatagctgctgaaactgaaatttactagtaacaattaacctggatgatatcattactagacgaacacgataacattgtcaggcaatgatatgcatgatgtacaatgatatactactatcatagcagtttgctgttcgagtaaacaaattcatgacagaatagactagcacataaggaacagtacaacgataataagggcataggttcgattattagtaaggttctagggtgcgacaccatctaaacaatgaacgcgacgcctttccttccttccccctccaaacgtcagcctccac

SEQ ID NO: 56534 - DNA, 1135 bp, Oryza sativa
cttttggtggcagacgccgctgcagcagctgctgcggcaataagcatgattgcttgagcctgttgatgacaatgttgcagataacgaattagcataaactttcaacagttagtcggaggatataacgaagataagtggggtgaatatgaccttctctggcggcactgagtcataaacacatactgatccaccatagaaaattgtaagttgcgaaggattaggtggagggctcgacattggaaatactttgggcctgattatgacaaagcgaaattagtaaatgtgcaagaaggtaataacagattgcatagttacacagatattggcataagtgggccgttcttgactaattgcatacatgagtacatggcaatacataagatgggcatccaagggtaaagtgccatataaaattggaggccaacctagctaactgatgtataatgtgcaattacaccgtaggccgtatttccagccttttttagaggtttaatgagctttactatgcaccttgtctgcagccagataaaggcccatctccttcataaataattattctactctctatattctacttgatgagaggattatctcttggtcagtacgctacgccaacatagccctcccacagctgccagtaacacaagttatacccaagtcaggatagataccattatcaatgtttttggtacacacattctgagtctaatagcatgatcaagattaaaactcacaagatctaaaatctaaaaatagcaaactaggcctgcaactttatggtccactctgaaatatccaacatgtgcagcatgatgggactgattcagagttaataatctgtccaaaggttgtccaagatggacggaatgtactgaaattttttcttcaaagtctcagcataatctagtctaaaagaccaggttacaggctcaatagaacatctagatttaaaaacatcttacatagttacatatatgtggtttacctattcagaaaatgctgaaacatttaataatagccacgattcatattagccattaccaggtatttttaccttcaccttacttacttcaaaacaaacactgcatctattgttttcacagcagcctagtggattatatgggctgcaggaatt

SEQ ID NO: 56535 - DNA, 1153 bp, Oryza sativa
gggtcggtatgcagggagaatttacagaaacttggcacatactctaaactaccaagtaaaaaatgcttacgcgtactgcttaggatcattaacatatgcatatgccgttacacgtcgttcaaactttagagtacgtgtgtacgcagaacacgcagtgcaatattattttacagaacaccagcaggatcagcaagtaataggagttgaaaattttatcagtcaatccaaaggaagcggatgagtctatcaagtttatgacagcaagtgcatgtatgatgtcatgtttgacgggaacgttaatggagtgcacacactcaaatattactccgtttcaaaatgtttgacaccgttgacttttcagcacatgtttgaccgttcgtcttattcaaaataatttgtgaaatatgtaagactatatgtgtacatgaaagtatatttaacaatgaatcaaatgatatgaaaagaataaataattacttaaattttttgaataagacgaatggtcaaacacgtaataaaaagtcaacggtgtcaaacattttaaaacggagggagtactcaacgtgtcatcttgtactacaggtactgtaaataaacatgtttcctagagaaattgctagcatattaatgggctcttggccccacaaaaggttgaggctttgaatgcggcccatcaaaatgtcactatacgagttggtaacttggtatgacggtatctgtctgttcatgtaacagaaccacttgtgacacaagttgaaaattttcaattcacaaggagggcgaattctgattgacatggtaaacttttcagttgatcaacgccattgccggtgatgtaagaagcaataaaactgtttattctgagagggaagaagaggaaaatggaagtcgacatacaaatacacgctgttcttttttttttttagaaccaatacacgctgttccatgcatcgcagcggacgctatcatcgtaccaagctaagttcctctcttaagtttcagttccattgacttgctcatattcttaagggtgtgtttggatcccagccattgaatgccatagctacagtattttcgccacgctacagtgttttctgaggcggacgaaacgtccgccacactcctgtggcgagccacgccgtggcgtggcatt

SEQ ID NO: 56536 - DNA, 3547 bp, Oryza sativa
ccctctttgcctgaagctatccagtcctaactgatcaatatggcggtcagaccaggtcaccaggaattcttgttttagcgatcagtaagtataatccatactacctccgttttttaatagataatgccgttgactttttctcacatgtttgaccattcatcttattcaaaaattttatgcaaatgtataagatataaatcacacttaaagtactatgagtgataaaacaactcataacaaaataaattataattacgtaaattttttgaataagacgaatagtcaaacatgtgagaaaaagttaacggcgtcatctattaaaaaaaggagggagtacaacttatatgttcatcgataattagcttatctatggtgctcacagttgtattaactctttaatttttttttgtaattttgattaacatctcgcagttggggtgtatgaatgttctgttgatctcggtcacttcgagcgtatgtgaactcacgggacttccatataataaaataaagttaattttgtcctcgtacatctatatacacacacactaatattgtagggcttctatattttttcacattgggcctccaaaaatttaggactggccctgctcctagggttacaattttgtggttattttctatgaacgtctacgtttgtaccatgttaaaaaaatgaaacctcatgacatcttatacagtttgtttaaagggacaatttaaaccatgccatacaaattttgcaaaatttatgatatgtcaccctgacccacatgtcattgactcatgtaggtcctacatgtaattaagatatggatggcatatctcaaattttgtaaatatagggtggtatggttttaacaaaccattgtttaaaaatcattaaaatagtttacttggtgagaaaggaaggggaaaatggaagcataatcagttgtagggggaagctgtagtttagtcaacaccaatcaaacaagatcatagtattccccttctaattttagtttattgactttatcaaattcttttgtgttcatcgcgtaagcgtgaagagtgcagaaacattgttttctctcacactcgcacagttgacactggcacacagaaacagtcaaatcagctagctgcaaacaaaatgaccaataaaaatatcctcacaactcacaaggtaggaaggcacgcaaaacggggtgagccattagctcatgattaattgagtattaactattttaaatttcaaaaatggattaatatgattttttaaaataactttcttatataaattttttgcaaaaaatacatcgtttagtagtttgaaaaacatgcgcacggaaaacgagactcaatctcccctatctccccagaagccttaataagccaacactccttgcacactgcagttaaccactcctagtagttcatcagcatggccctcaccaatggaagtcttgctttagcaatcagtaagtatgatcgatgtactcatatgcatcgcctattatctacatctatatcgctcatagtaacaaaattttgattaacatctcgcagttggtgtgatcacgactatatgtacatggtaatactgtatggtctcactattttttcttgcatagaaccggctctgctcctactcctagggttacaactttgtaattttttctataagtgtctgcgtttgtactgtgtttaaaaaaaatgaagcctcatggtatttatacggttcttttaaaaaatcattaaaatagtttacttggtgagaaaggaaggggaactagtttagtcaacaccaatcaaacaggatacatagtattccttcttctaattttagtttattgaatttatcaaatctttgtgttcatcgcgtaagcatgaagagtgcagaaacattgttttctctcacactagcacagttgacagtggcacacagaaacagtcaaatcagctagctgcaaacaaaatgaaccaataaaaatatcctcacaactcacaaggcaggaagacacttcataagccaagtagccaacactccttgcacactgtagctaacccctcctggtagttcatcagcatggccatcgccaatggaagtcttgctttagcactcagtaagtatgatcgatgtactcatatgcatcgcctattatctacatctatgtcgcttgtagtaacaaaattttgattaacatatcgcagttggggtgatcacgactggtatagtagcagtcgtgaccatagttgcgatttacaagtgcgccaagatcgccatcaaaatgtggtatagtagcagtcgtgaccatcacacgcccatcgccaacggcggcggcagcagcagcagccggggcggaatcggcggcgcggacgcggacgtcgtcgagatgggcagcatgagccacttcatcgagggcctccagaacgagcggcccgtgcggttcagcgcgcggcagctgcgcgccttcaccaagagctacgcccacaaggtcggctccggcgggttcggcgtggtgtaccgcggcgtgttcccgagcggcgcgccggtggccgtcaaggtgctgaacagcacgctcgggaagcgcgccgaggagcagttcatggcggaggtcggcaccatcgggaggacgtaccacatcaacctcgtccgcctctacggcttctgcttcgacgccgacgtgaaggcgctcgtgtacgagtacatggagaagggctcgctggaccgctacctgttcgactcgtcgccgtcgccggcggcggagaggatcgggttcgagaagctccacgagatcgccgtcgggacggcgaaggcggtgcggtacctgcacgaggagtgcgcgcagcggatcatccactacgacatcaagccggagaacgtgctcctcggcgccgggatggcgcccaaggtgtccgacttcgggctcgccaagctgtgcgacagggaggacacccacctgaccatcaccggcgcgcgcggcaccccggggtacgcggcgccggagctgtggatgccgctccccgtgacgcacaagtgcgacgtgtacagctacgggatgctgctgttcgagatgctcgggaggcggcggaacctggagctcggcgccggggccggcgcgcacgggcacggcagccaggagtggtacccgcggtgggtgtggcaccggttcgaggccggcgagacggaggccgtgctggcgcgcgcgacggcggcggcggcgggcggcgggagggagagggagaaggcggagagggtgtgcatggtggcactgtggtgcgtgcagtacaggccggaggacaggccgtccatgggcaacgtcgtgcggatgctggaaggggaggaccacatcgccgcgccgcgcaacccgttcgcccacctcgcgccgtacagcgccgccggctcgtcgccgaccaccactaccgccaccacggaatcggatggttcgtcggctcgtaccggcaggtagacgtgtcggaaacgaattcccgttttctgattcttccacgtttgcacagcacgggtgtgagttgtcagcaaggctgttgtgttcaaagacgt

SEQ ID NO: 56537 - DNA, 3033 bp, Oryza sativa
aagacaaaaatcatagtgtgcgcacatgaggggatttggtcccacaatctctattttacaaaaatatagcatggtaacgagggattttaacacacaacttaccgtgtacattgtaattacatacaagttataatgtaattaatcataatttactatacttatatctgataaatattttggagaaaatttatcgataaatatatagagagggaaagaattattaccttgagggaggcaaagactttttcctacgaaaattcacacatttcttttattcttttttagaaagtgattcaaaatccggtactagtaaactcataaacagaggtaaaaaataattacattattaacaaatataattgcaacaacattatgacgataaaatatgtacgaaatctttgtctcgctggtaccgttgtacaaagggagaagggtcaacattttcacttggacttagactattcaaccatgacgtccgtggactttttggcaggaaggctgaccgccacctcgctgcttcctgtagtggtgcccccgctgctcaggttcgtgctgctgctcgtcagcgtcgagctgccgctgccgccgctcatgacgtagtggaaggggttcaccggcgggacgatggccatctccccctccagcatccgcaccacgctgctcatcttcggccgcgccgacggctggaactgcacgcaccacagcgccaccttgcacatcatctccgccttcgccctgtcctcttccccgatgccggcggcggacacgacgcactccatgtccccctgctcgtacctgtcccacacccacttggggaaccactcctggctctccgcctgcgcggcgaggtcgtagttccgccgccgccccagcacctcgaacagcaccatcccgaagctgtacacgtcgcacttctccgtcgccggtagcgccatccacagctccggcgccgcgtacccgggcgtgccgcgcccgcccgtcagcgacatgtgcgtgttctcccgctcgcccagcctcgccagcccgaagtcggcaaccttcggggtgaagtcggcggtgaggaggatattcgccggcttgatgtcgtagtgcacgatccgctgctggcactcctcgtggaggtacctgatccccttcgccgtgccgacggcgatgtcgtgcagcgtccgccactccagcttcttccccctgtcctcgccgccgccgccgtagaggtacttctccagcgagccgttctccaagaactcgtagaccagcgccttggtgtcggcgtcgaagcagaagccgtagagcctgacgaggtggacgtggtacgtcctcccgatggtgccgatctccgccatgaacgcctcctggaccttcttgttcatggacaccttgagcaccttcacggcgacctgcaggcctttgggcagctcccccctgtagaccacgccgaacccgccggagccgagctccgacgagtagttcccggtgcacgccgccagctgctcggaggtgaagcgcatcggcttctcgctgaggatctcgttgaggaacttctccacggggccgatctcgatcatcacgctgtccgccgcgtcgcgggcttccatctcgcggtgctgttcggtcgcctcgtgggcgatcctagctagcatcttcttcttcatcttcctcctgtagcggcggcatcgcttgatcagagcgagcatcactactgcagccgcggttgccgagactgacgatactgaagaaaccagtgaggtgagacgaacagttagataagcaaaatcttggtcttttattttgccatggtgatagtactaattaatcttggtacttacttatggcaacagcagtagacatgctcacattcgttctctaattgagcttgtctttactctggagtttgcgtactagtacgtcattgcatagatcagacaagcataaaaatcagagatatcattgcacattttaattagcagtaatatatcttgattgtaaggtaacattgatagtttgtactattcacatttcaccagttccaccattagtttgattaattcagaattaatctgagctgagcacagttagtttgcttttgatttcctcatagaaaagaaaggaacaactaacaactctgctttgttttggagccttttttttttcttttgggtgtgtgtgtgggtgagtgtgggcgattattctttgtacggatttagccgcccggcggccggcgtgaagacaaaaaaaaatacgaattaagtttacaaatgtgccaacagatggaactacaccacgtgcttaaatttaaggattacagaaaatatatttagttcaccataataaacttcagaaaggacttcatgcatgaacaaaatcatctcagaactcaaaagaatcacttgtggcctgcatgacaggaacacatgtcaactgtgtttgtttatggtgtctacaagactcagaacgatgtttttcaagaacacgtaaaaggcttggtctgattccactgaaaaggagaagaacaaccagtagaacttggtttgcagctgaggaacacagaagaagatcacaacacaactgaactatgaaaaccaaatgaagaagagatcaactgggcacagagaaaaaaaaaaggcttacttgtctagtagaatctagataacttccttgagcttgatgttcttcattcttactgcatgtcgacgagctgtttttcgcagctaaatcattgagctcatctcatggaggatccaaaatgataagaggccccgttttgcctctctggatggagaggatcagaggatgtctgactgtctgcagctatggcctgagaattagtggatcaggaaaagcacacgtacgcgcgcaccgcgcagccgttcttgactaacaataacaaacgctgaatctttggcgaaagtcggagctctcgccaatcaccaaatcgcctacggatgcttcaggcggcgtctgctcgaacgtcgagactaaaaagctgtgattggaacatcctctgtgaatccgttgaatcttcaggtttacacc

SEQ ID NO: 56538 - DNA, 1544 bp, Oryza sativa
cggagaagcgatacgcgtatatacatacttgtgggcgtaacgtaaccgacggaatccaataatacgcacttagtaagtctaattttgggacagcaacgtggtctacatatttggggcaagcaaaccgccaccttttcttccccagcccttgcccttttcagggtgacgtggcatccttcctctcttcaaccctttcttcacggggccccacgtcgttgcttgtggagctcgtcaacgtatatacgcacgtcccgtgccttgtcgcccatgacttgtcagtccaaaaacgagacagagtcacggttgaaatcttgcttcaactgcactaaatttcgtccaatttggaccaagcaggacacgatctttggctgtgttcagttcatgtgccaaaaattttttaagtatatggacacatattgaagtattaaacatagactaataacaacacaaattacagattctatcttaaactacgagatgaatctattaagcctaattaatccgtcattagtaaatgtttaatatagcatcatattgtcaaatcatggcgtaattaggcttaaaagattcgtctcacgatttacatgcaaactgtgcgatcagttttttttccacatttaatgctctgtgcgtgtgtctaaatatttgatgtgatggaaaagttaaaagttcaaaaaaaaaattttaactctaaacacggcctttgatcaaatcgataaatttttgtacgaggactaacgtggtaattgattactagtagcagtagactaccgtggcaggtcgaataatggggggtacagttggcgagattatgaaattggataaagccaaatttaaatacgtaaagagatgatgatggggctcaatttgcggtcgagatttacaaatatttaaatccgtcacaatattcacatgcgccgtttgctgtacacatacgactaccactagtaccctttcttccccaaaccccctcccgatttctcgtttttgctctccaatttctcgcgagaagccgaagaggaagagagcgagagagagagagagagagagagagagaggagaggaggagttggttgagatggatctgttggagaagaagaacattaagaaggggggagaagtggaggaggaggtggcgcgcaagggagaggagaggaaggaggaagaggtggtggtggaggagaagagccatcagcagcagcagcagcaaggggaggaggagctcgtcggcctctcgctcgccggcggcaggtagttttccggctccgccttctcctctcgcaagtcgagtcctattcagctttgggttgatcgattgggtcgcgggagagagagtatttggttggttgttcgggaaatgcatctcgcgcgggattctagccgcttttcagttcatagtatcgccccttctccgagaactcgccgccggggagccgcttcctgctgggagccgagcggcgccgcagccgcctccgaagtggtttaccggaggggatggattttctccggtactggactcctggtgtttgaatttttgggtggaa

SEQ ID NO: 56539 - DNA, 2022 bp, Oryza sativa
  unsure (1)..(2022): unsure at all n locations
atctccagctccagctccggcggcggcggcgtcagcaccgccacctccgcctccgcctccggcgactcggcgcaatcgactcgacatgacatctgccattgacatatgcttgggacaaacgtgcatgtgtacccattttcgtgtagtacatttggatgagctgcttggaactttgaatagtatgtaaactgataggcctcggttagaatttaatatgcttgaaaaattgcagtttaaggaaatttcattcaaaaatttaaaaattttaaatcgcacgtacattttaccatggcgagatccctctgcttttgaactctcaaaatcaaacatcaggtcagctggtggcctggtaatgtaactcgattattattgggccattcggcccagcattaaaatgatgtgaagaacagcccagcccagcacacagaatgcgtcttcgtcgatgggtggcgtacctaacatcgacggcggataaagcgtaatcgacggcgtaaggcggcgggaggggaacattttccagccgccactctccccccgagagaagacattccttcacccacctacccaaacacgccgccggccctgacccaatgcgtgcgggcccaggcctatccactggatcaacgggcccacatttcatcggctacctcacgttgtacatctggaatctggagcttattaccaaaaaacctcgtgtacccaacacgtcagaattgtgacccatacgagtcacagacaactgggccccaatgcctatccggacccaccgcacagatacagttaaatcatcttctgttgatgaaagattagcagcggaaagtcgcatcgaaactgaggcggcgattggattgtatgtgtcactgcaggtgggcccgtgcacgcgaagtacaagggggtgtcccgcttgtcataggatgctgcacacgcacgctcccgcataaagcggtggacttagcagttacagtagttattcccccttcccaaaaatcgcctcagattttctggttcgaaatcctctaccccctcccatggcgtccctcttcagggctcgccgccggcgatcgccggaggacgacggcgagggggaggacggatccgcgtccgggcgggtcacccgccgccgcctgtcgccggaggagggcgcgctgtcgctggccgaggcgtcggcgtcggtggccgcggcgggggcgggggcggagagtagccccgggtggctctccagcatcgtgtccggagcgaggagggtgatctcctcggtgttgttctcctctcccgaggaggccgcctcaggggaggaggaggaggacgacgacgaggaaggtactccttgagcgccgtggagtagccacgctgttcctcatttcagatttctgtttgtcactctctccttgcttgcttcactgaactgtttcgtctacttgaccgcccgagttgtgccgctgcggttacttgcgctgttgggtgctaattacgtcttcgctgcaaagctagggtttcggcttgcttgctctaattagagtagaagtagtggaattttgataattcggggtcagtagcagagagagagtgtgcgctgacggttttttcccttagtagactgtggttgggtaagaattttgcggttttgccacattaggtggaattggggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaa

SEQ ID NO: 56540 - DNA, 1238 bp, Oryza sativa
cgcacacgaccgtacgtgcgcgcgatcacgaatttaatccacacggacattatttatgacctttaatttactacagacgcaatattcatgtaattaagagcagcgggctacagatttgtagccagttgtagcacaaactccaaagcgcagtgtgtgtatgataggtgggaccagatattaatagtgtagtatgtaactattgtataaatgagctattagattaactataaataaattggaactagtagttgactatactattgaacttgctctaacacagacctggtaagagcacaattcaaccaaccacaacgatagaggcagcagtaactgtaactcacatgtttctcgcaccaaatcaaccgcgcatagtactccgtagcttagctccaatccaacgtctccccggccgcgcggccgcccgtttttccagctaccacgacgggtgcaaagaccggagaaacgtacgtacgcgagctagctagatcggtcgccgcgcgggcggcgccgatcgagatgctgcatgcgcatgcgagaagcccccgcgcgacctgcagcggccagctgcgcgagtcgcacgtatacgaaggtccatcgatcggcacacggtatccgcggtggtctcgtgcggtgcgcgcgccccccaccacgacctccgggatgcacgagcagactcccgttttttcttcgtttctctccggacgccgctgcatgcggacgcgcgcgcacgccccgggcggctaacccgatcgatcgatccccagggggaaagaaaatggcaagaaggctagttttgtttaattcctgtctcgggtttggttggttgctggcactgcactactgctcgacccctttactcacttgcaagcaacccgatcgacgtcccaccggtcgtccctgctggcaatttacttgtgtgtttgtgtgtgttatatatatatatatatatatatatatatatatatatatatataacacacaccgtgcacgtactagcactgtagcgcacccatgactgtctttcttcaattgaaatgaattattgtcgtccctagttaattactagcaattctcaatatataattttgaattgaaaccaagttcattacgacaaaaagaaaaactgaaaagaatactggtattgtattaaatgcagtacagtgatctcgttaatttgcaaccataccttagctccacactccacgaaaactattctaaacttaactttcgagggatat

SEQ ID NO: 56541 - DNA, 1434 bp, Oryza sativa
tactctctccggcctaaaatatagatagcaatgtactagatgtgacacatcttagtacaacgaatctggacagggtagaatgtatcacatctagtatatagttgttatattatgtatatagttgttatattttgagacggagggagtagttcgcaccactcgatggaagacatttcaaccggccagttccgctgttccgtgtcagtgaagataagctagtatagccagctagctagctctctccaaccctataattaccacccgaacgatctcgccaacaagcggccggcagctcgatcgatatatcacagccaacaagcggcagctcgatcgatcgatatatcacaatggttaggctcgccgtggacgccggccttggccgaggcttcgccggcggcggcggcggcggctccgtgcccgacatgagcaggagtgttgtcggcattgcgctggtcttcgtggcgaccgtagcgatcgtggcgttcgtcgtgtttaactgcgccgatggcatggatagctccggtggacggaagcggctcaccaatccaggaggcggtactgttggcgttggcgccgtctgtggaggtagtgcttgcggtggccccgcctgtggaggtggtggaggtggcggtggcggtggcggtggttgcggcggcggcggtggaggtggctgttaataaaggaacagagcatatggaggagagagatagcggtgtaggtgatggaatttcatgtcctttgatctacacaccagtttgattttgctttgcagtgtttttcatttacatcagtcgtgaaataacaaaccctttggtaattctgcttatgtatcattatgggcctattcactttgataccactttcaaccttactaaattttggtattgtcaaaattttgtgataattaccaaaatttgacagaaaactaaatgtagatattttttttggtaactttaccaaaatttgataatgttaaaaatgacatcaaagtgaatagacctcctatatatatataaacatcgtcttacgtgtttatatgtattatattaccaacaaacacccataaattcttttgaaacggtggcttccaaagaaggcgtattatttttaggtcagaatgggagtttagtgtaggtccggcctataattattgggccgaaacgggactcctatctacgtggtgctcatacaagttgggccagaatggattcccttccacttgtaggcttgcagcccatctttttgggctgggatggaattccgatcttcgtgcagcctagtagttaggccggcgtgcaggccattcttcttgggccagggcgtaacgaggagaactatcagaaaaggatgggccaggccgaccatctcatccttttcagcccatgttaaaaataatggtacagaacttcgtttcggccttgtttacggagataa

SEQ ID NO: 56542 - DNA, 5184 bp, Oryza sativa
atttttttaaataagacgaacggttaaacgttgaatatgaatatccacggctatatttattttacgacgaatgtaatagattgtgaaaaaatcatagctcctcgaggttgtccggttgagtattacttcttgtctcagtttgaatttatatatgatcagtttaattattggatgcattttgtgctgttaatttaaaaagatatatatatggacaatgtaagaacatgaggtgcaaattatttattgggtaaggccgtgtttaattagttgcaaagtttgaaccaaaaaacgtcacatctaacttttctacacacacaaacttataacttttccgtcacatcattccaatttcaataaaacttccaattttagcgtggaattaaatacaccctaaagatacttcgataggttaaggccttgtttagttcataatttttttttccaaaaacgtcacgtcgaatctttagacacatgcatgtagcattaaatatagataaaataaaaaactaattgcacagcttgcatagaaattgcgagacgaatcttttgagcctaattagtctatgattagccataagtgctacagtaaccgacatgtgctaatgacggattaattaggcttaataaattaatctcgtggtttccatgcgagttatgaaattagttgtcacaccccaatctggcaccgccgtataatggcacctgataggagcatgtcgtaggaaaaacggcgcaaaccgcttcctacgaaaccgcgatcacagtaccagtcccaggacatagcgctggtaccacggtgacaaatatgaatcattgcaatccttaaaataaatagatgacttctttaccttaacttaggttgcagctcagacagcccgagaatgcaaccgacgacacggacgaggagaacaccaacaacagcagcagcagcggaaccaacgaactaacacccaacaccacaggcgacggctgggaaccaggacgaaaccctattcttcacttcacttcatcttctctttaaggcagaggaactatatatatatatatttatatagagcaagggtgagtactttcgtactcagcaagtcacgagaatttaggtgtttaatgcaagcttggaagagaggcaaggttgttttgcaaatcttttatttgaagacattttgaaatcactaagtgatttatttctttctaagtttgggccgaaaagagacttgcgtctcgattcgactttaagagatgtttttcaatagctcatttggtaatgtaccgacctcccgggtcagatcattacttctcggctcccagagccattccacttgattaatcggttcccagagcctttttcattttctcggactcccagagtccagctgcccagtagcacaacaatccgcttccactcgggaagcctaatctatgatgcccatagacatcccgaattacacagattcgtttcttgaccactcaggtcgtccatctgccacataggctgattctggtaacgattcccacaccacaacaacttttcacaaagcataggcaaacaaatctacgctacaggaaacacctcacatccgcccatgaccgcgggcacggctgttcgaacagttagttaacctatgcagagggggtacactttacccacacgacattactaacccggatcacccagcccgtgagatcagccacgtcgggagaccttaaggctttcatgacaaggcatttggaaagccgacacaggttcaccatatgccaacgagaggggtcccagaccaacactagattaggtcccagaccatactgtgccaggaagcccgagggttctccccgacaccaccccgttgaatccacatgtctcttggcatcatggctcccccgattaactaattactcagccaggggcgtcccattgcacccgtgtggtcgcacttgttatatgctcggatgaatttcccacaggaatcggtacttatatgcgaatacgggacagtgccacacaagcacaacccccgcatcgcgagttttcacaatccattttattttccaacacaccgacgccacatgtcgggttttcaaggcttctcaaacccatttcccaagttttcgacaaacaacggtgtatgtgggatatttggtatatgcgctcagagagcacggataccgaggtaccacaaaggtggagcgacaaggaaatcagggtagtacaacctacaggaattagtgcgactactgggtaggtccgtcggtttggcacgcaaaccgaggccaagcaagttaagtgtgtgattctaataatgcaagttgcaaacaaaataataatgattttccaattataggagcaattggtcaaagggtgacttgccttgctcaaggtcttcacgaagcttcacgaatcttcgagaaaactcgcgatcgacgaaaatctggtaaccgtaactatacgcaaacaatcaaaaacctaaacaaaagaccaaaagaaagatcctatttagactaattagtactgccattaaatagatctcaattttatggaaatactggaagttgaacggagtcaatctgagctacggattgagagatatgaattttggaagtttaattggaatttctgggcaaaggaagatatttgtggaaaaggggaaattgatttatgaaatttatagaaataatattctcaagaatattattgaccgtcactgacgtgcgggaccaaggaaatgatttatggaattttgggaataaggaattgatttatgaaaaagggaaaaggatttattaatccctttggataagaaaaggaaggagggatgggatttagacttcctttggcggctcgggtacggcccaaggaataagcgcgggcggccgagctaatgggccgggcgcgggcgcgaggaagcggcccatggccgggcaaggcgcggcccaagcgggtgggcgcgcggcccaagcgggtgggcgcgcgggaggagagagggggatgggtccgggtggaccggatccatcgtgccgggtcccgggacgggcccacgagtcagcgactcggcgcacgggggaagggttcatgcggcgcggggtgctagggttttgcggtcgcggctcacggcgtggcacgcgggtggaccaagaggtggagggcccatgcgaagcctaagggctctccgtggaccgcgcgcacagaagaaagggcggtgggggcggctgactaggtgcttgacccgatcaagcgggcccggggctgaggttgctgccacgtggtcggccacgcgggcaggggcgaaagggaaggaggaggaggcgcccgggatggacggcggatggcggcggagttcaccggagctcgtcgcgacgattcgagagagagggagtacatctgaacaatgggacggacgagagggagtgagccaccggatcggattcgccggagggaggccggcgacgacgaatcccggcggcgcttgccggcggcggcaaaagagggaaacgatgacgatgcgacgagagctcgattcctagggacttgagcatctacgcgacctcctgagttcatttctagagtcggattgggtggagctataccgaggaaggccggcgacgagcggctactaccgagtttgggcggcgatggcggcgagcctacggcgagcagcggcggcggtcgggacggtgccagcttgctattggaaggctactcgcactactacccagagctaaggagaggagagggagcgaggagggagaacgggagatgcactaccgagccgagacggacgctgtgacgagcggccgacgacgggggagcgagctcttcggcctcgggccggggaaggggaaggagacggcgcctggagtcccgcgtcagcttctcgcgcgcacgccggcttcaccagcacgagcgatggaggagggaggcgaggatggcggtagcaaggtggcaagggcacggtggtggcgagggaatgaacgagaggaagatagggaggctcggtttaatagatggcaatgtcggtttagggaggaagaaccgacattggcggtcaaggagagcgagctggcggtcatcgacgcgtgcagccaaggcggcgacaggtgatgacgccggcggtggtcgaggaaagggaaaaagaagggggaaaaagagaggctcgctccaagccgattcgggaagggagtaggagggagagggagagctcggcctccgggttttggcaggacgcgcgtggagcggctcaggcacgcgcgcggggccgtgcggctgcgtggtgcagcacggcagggcagcggggccgggcggcgcaggcgcggcagggccgacgcggcggcgaccgggcggtcggccatgcgcgagcgcgcgcgcgcggacgcgagggcgcgtccggattcaaacagcgacggcgggaaatcgacgccggggagagggagttcgacgagggagagagagagagaaacagagagaacgagagagagagagagagaaccgagagagaaggagaaacagagggagctcggctcggctcagcacgtgcaacgcacgtgcgaggctgagggaggagaaacggctgagggagggaggtgggctaagggggaatacggcccacaacacccgagggaggtaaaatagacttttgcagagaaaactgattaggagtagattcgaattcaaatttgatattcgaactcgagggtttagggatgtatcaagggaaactcaaggagaagtcatggaaaagattcaaaaggaatacttgggtatttgttcaagggagcatagggtgaggtcaaggaaatgattcggatgaggatcgatcctctcgaaatcgagagaaagatttggcaacgagttcaaggaagggagagattgacttccggaattaggatttggatgagatggaggagtcgccaacgggattcaaaaaaggggatttgaatctaaatttgatacttgtacacaagggttcaaggagacgagtaaggaaacaaagtgggagtttgatactttcgggaatgggaacaattatttggagaggattcaagggaagggattgactttcggaatttgatttcagagactcgaatcggaagaggaattttcgaggtggaggattttgatttcgatgagagggaacaacgggattaaattgagatccttggcacaacttagactcttacacaaagaacgaa

SEQ ID NO: 56543 - DNA, 3878 bp, Oryza sativa
atagagtgaggttggaaacttactgaagaacgcagcccaaggctactacttttaggccagaatggaagtttagtatagtgcgggccataattattgggccgaaacgggactcccatctacgtggggaataagattcccgcccactcgcagcccatctttttttcggctgggatggaattcccatagtagttgggccggcgtgctggccattcttttgggccaggcagcaacgagaacaatcagaaaaggattgtgggccaggccgaccatctcatcctttcggcccatgttgaaaatgatggtacagaacttcaattcgtccttgtttacggagataaatctgctctattagcctgtaactgatctcagtaaacagtacaagcataactcgtgatgagtactgaatcttttacttcttttgaagtacggaatgcaatatttagcttatgaagctggctactacacttaagaatttctgatagttcctgcattatattacattgtatacttgtggagggggagcaacttcttgagtaaacaggggccactactaaaggcgatctaacaaaagaaaagaagcaaaagctacaaagagacgtccctgcttccattgtacatgagccgccccagccgcgccgctcagctggaagccggcggcgagaaacttgagctccgactcgtatagctccgcggccgtcggcgttggacataggagaggatgaatctggattacgacccttctaggaggatgaatctggagtaagggtagtacatattcatccttctatgagggaacacatctccacataggaggggacacatcttctcttaggttaagtttttttttttggatggagagagtagcttctcgcggcgaatcatcagcagatgggtgtccgtgcgtttcgccgtaatgatccacgtatacggctcgtcgctcgcgattacaggtttattaacactgtgcgtggtcatcgtgagccaatttccatgaacacaatgtataattaatatatagttaacaaattaacactactacacgatagattttcccgtgcggtcgaatcggattttcgcgtacggagcttcggtccgtatggagcaaatcgcctgtgaaaatcgctatttttgcgcgcgggtggctcacccgcacgtgaaaatattcgcgtgcgggtgcttatgtcgcctgcaggcaaaaataaaaaatcgaaaaaaaaacaatattgaaatatacgaaacccttaccctagccgttgccgccgccgccgccctctcgtcgccgtcactgtggccggatccgccgtccgcaccgtcacccgttcccatcgccgttgccagatctgtgcggcggaggtccgccgccgttggatccgcgcagggggtggccgccactgctgtcgcgcgccacctcgtcgtcgccgccgccaccctcccgtcttcgtcatcgttgccgtagccgtggccggatccgccgtcgcccgctcccgtcgctgttgccagatctgtgcgacggaggtccgccgccactggatccgtgcgaggggtggccgccgccgccaccgttgcgcgccacctcatcatcatcgctgctgtctccgtagaggaggaaggccggggagggcggcggccgccagatcggcctggcgcctcctcatcggcccactgcccctgctcgcggtgagagagaaaaagatggggagaggaagggagaaatgagagaaagaggggggatgtgagagagagaagaggagaggatatgttgaaataaggataaggatgaaaattttgaagtgttgggagggaaaaaaattagagagaagggagagtattttcgcgtgcggtccacttaagaggttcgcacgcgaaaatcgatatttccgtacggtcttcttaagtcgactgcccgtgcggttagattaagatgcccacacgggaaaatgcattttctcgtacaggatacaacccggcgccggttcccctattttctcgtgcggttccacatacggattgcatgaaaataaaaggggacggcgtgcagaaaaatttatcatgtagtagtgtaagtgcatctcatgttttggatgtagaagtactttgtccccatcggccaacaaagcctaatttcagtagatatcgagctaattagcaataaggtcaaacagcaacgtggtcgtgacgttgtcgacatgacgtacaatcaaggacgcgcaatacagataattaagcatttaagctgatatgtaaaactagccgccgtgggaacaattgccaattagctaacttctagatggacaacgattgaatcagtcatccttagatatatatgaaaacctcccggtcaatcaagctatatatctgtaatacacgtaacgtatattgttctcgcaaagaaaaaaaggagacaagaaaataacgtaacgtaccattctgagctagatttctcaaggcaatgatcctatatacatcctgcatgcaggttacaggtatactctatttataaaaaaaaaaaaacaatctagaaagaggtgtgatattcttcagattcattatactagaaagagagaatcatgtattctctcctaagttctttttcttttgagatggagtataacgtagcaatttcgtagaaatagttagctcaccactcgatgaagatatttcaacttgacagttccgctgttccgtgtccgtttcacctggagtagtatatatatatagacagctaagctattagctccctccaaccctttaattaccacccgatctcaccaacaagcggggcagctcgatcttgatatatatatatggtcaggctcgccgtggacgcaggcttcgccgccgcggcggctccatgcccgacgtgagcaggagtgttgtcggcatagctctggtcttcgtggcggccgtagcgatcgtggcgttcgtcgtgtttaactgcgccgatggcaagggcagctccggtggacggaagcggcccagctatggaggaggtggcgggtgtggaggcggtggaggtggctgtggcgccggcggcgggtgtggcggcggcggaggtggctgtggcgcggcggaggtggctgttaataaaggaacagagcatggaggagagggcgtgttgtggaaacgatatttcctatggaatttcatgccctctgatctacacaccagtttgattttgctttgcagtgtttttcatttacatcagtcgtggaataagaataataaacacattggtagttttgcttatgtgtcactatatgtaaacatcctcttacatgtttatgtattatattagcaaaaactacctatactttcttatgggtaaaatgtactttattatacatatactactcccttcgtttcggttacaagacgttttgactttggtcaatatcaaattgtttcatgtttgactaaatttatagagaaatataataatatttataatattaaattagtttcatcaaatcaataattaaatatattttacttttttttacaaacttagtcaaatttaagacagtttaactttgaccgaagtcaaaactcattgtaacctgaaacagaggaagtacttatttgaatatatgttatccaattgattaagacaaattctagagtgtcccactacttatcgtgtgccacctcgcgctgcccaaagcacctaggcccggtgacgatcgtcgttgtcaccctagtcaccctacttatcgacagcctgaggggagttgacgtggacacttcgtgcatggcactattccattcttttctgattaagattcaaattttatctcagttttctgattaagatttagattttatcttattttacattagtatattttttaaactattaaactatacgttttgggcggaaa

SEQ ID NO: 56544 - DNA, 1876 bp, Oryza sativa
gctgaggtaatgtgggttcgtaaattgctagaagagattggtttgttgcatccaggaccttctcaattatggtgtgataatattaaagctacctatttgtcagcaaatcctgtgtttcatgctagaacaaaacacatagaagtggattaccattttgtcagagaacaggtggtgcagaaaatgttggaatttcggtttgttccgtcacaagatcaaattgctgatggatttacaaagcctcttcctgtgagacaattacaattgttctgtaacaatctcaatcttggagagttgagattgagggggagtgttagatgataagaatagttagctagatagattggttcttatcttcagtttgttgtaactaacagagagataggataagatctctcatcctttgtatgtaccacgctaggggttattcctagcctatataacatgcaggcgtacctggaggaagggtatcgcttccatcacagctaatggggttaattttgtgtggggaccataaaaaagcagctctctctctctcctctctttctactctctctccaccttttaaccttgaattagcacatggatccaaacataccaccttagcctaatgtttagcctaccaattcatgactaaacattagctctcaaaattagccctgggctaatcttccaaacagggccctagtacgccggatcgccgactaacgaacaggttgccgtcccttgtttaaataaacaaacaaatatttcttccccgttttaaaatataagaaaccgaatgtgatttactataataaacaggttgccgttccttgtttaaataaataaactgtgatattttttaatattataaatctaaaccgatcagacctaagatcggatgggatattttctagtagtataccgattcttaatagtaggaaatggcttatccgttttcggtttagtccctccttcccagtaccaaatgcggcctctgctgtgcatcggtgcatgtgccttatcgagttcttcggaaacttctgtgtgttgcgagttactacttgtttcaaaatagcactattttagaaagagacagtaaagtctaacacattcacggctaagccggcaaaattctcaattcatgttaaggacctctcaatgattgagataatttgaagaggcatttcatttggcttctacctcttatatgattcaggcagcaatccccgaaaagtaatatgattcaggcagcacacaacgatttagacaatacgcattccaaatcatatttatatattttcacgatgtaatcatgcattacaaataatcgtgcgaataaacaaataagagcaaatagttagagaagctgacagcctgcctaaccactatagtaaccaaatacgaacacgagcagataagcaacaactcgtcacgcgtcaaccgccgcagccgccgccgcagccaccgcccccgcacccgccgccgccgcacccgcctccgccggagtcaacggccgaggcgatgatggcgccggtggcgagccccgcggcggcgccgacggcgagcccggctcctgggccgaacccgctgcggccaggcctcccggcgttcgccgccgggtacgcgtaccccgcggggggcggctgcgccgggtagccgtacgcgccggcgggaggcggcggcgggtacccctggccgtagtagtagacgtcgttcctgttcttccgccgctgcctcttggccccgtccgcgcagccgaacgcggcgacggctgccacggccaccgttgcggcgacggccaagatcaccaccgcggccgggctgagggaggcggcggcgcctcttccaacgccggcgtgaagggcatggaaatccactcccgctctcaccatgg

SEQ ID NO: 56545 - DNA, 5772 bp, Oryza sativa
attcctgcagcccccctcgcgtccgcgcgcgcgcgctcgcgcatggccgaccgcccggtcgccgccgcgtcggccctgccgcgcctgcgccgcccggccccgctgccctgcctgagccgctccacgcgaaacatgtgagttacagttactgctgcctctatcgttgtggttggttgaattgtgctcttaccaggtctgtgttagagcaagttcaatagtatagtcaactactagttccaatttatttatagttaatctaatagctcatttatacaatagttacatactacactattaatatctggtcccacctatcatacacacactgcgctttggagtttgtgctacaactggctacaaatctgtagcccgctgctcttaattacatgaatattgcgtctgtagtaaattaaaggtcataaataatgtccgtgtggattaaattcgtgatcgcgcgcacgtacggtcgtgtgcgtgcagatcgatcgatctgggtgtgatacagtgtacacctacagcgcgtaagttaacgtcctacgtccatggccgtgtggctgccggccggccggccatcgatagcagcatgcatgcacagcacgtcgcaagacaacgtgtgcgcgcgcgctataagctacaggaccacaaggatcgacgaattaatgctagcttcggctgtacggaaccccctgtttcgatcgatctacctagccgcccgcaatggttatatatagattctctagaagatatccatgtcagcatatttttctatttgaaaaagattaaatgaagagaaagagagtaaagctatctactaacttggagatagtctatagagaaaaacgaggcaatagatgagagagctatagatacccatgtagacatactattgaggtggtttactattaatctagtatattgctgagatgtacatgttttatagagagcaccttactttaccattgcgggtgctcttagtgcaatcccaaccctccacctagaatgatatttatggcattaaatacattgtcacgtaggacttttaacttatgtggcactatattaattaagaaagagagtgaagaaaggaagaaactggatctcatgcaagacacagcttcaacacaagaacctatgcactagacactatcaagttttgcattgggagagaataatgtcttcataatagatgaagaataaatatgattggtagagaagagaggtgacgtatttattaatgtcccactttaagaaaccatgggttgtagagtgtagtttctattgtgatgtcttattgacatggcaccatagacactgcttatggacactatgggttgggactgcccttaggccctgtttagtccgccaaaaactttcgcaaaaacatcacatcgaatctttggacatatgtatggagtattaaatatagataaaaagagaaactaattgcacagtttacatgtaaatcgcgagatgaatcttttgagtataattagttcataattagccataagtgttacattaacccacatgtgctaatgacggcttaattaggctcaacagattcgtctcgcggtttccaggcgagttataaaattagtttttttattcgtgtccgaaaacccttccgatattcggtcaaacgtccgatgtgacacccaaatatttttatttcaccaactaaacaggccctcatgccccgtttagatcccaaatttttttcccaaaaacgtcacatcgaatctttggacacatacatggagcattaaatatagataaaaacaaaaactaattacacagtttgtatggaaatcgcaagacgaatcttttgagcctaattagttcatgattagccataagtgctacagtaacccacatgtactaatgacggattatctagactcaaaagatttgtctcgcggttccaggcaaattatgaaattaggttttttattcgtgtccaaaaacctcttccgatatccggtcaaacgtccgatgtgccatctaaaaatttcttttcacgaactaaacaagccttacaacgatgcacatgaacatatatagctagatctatgtgtatactctacgtacgtagtacaattcaattctctgatctatatttattacgacctgtttgtgcatgtatctttgtgctatttgttacgacggcaattgacaggtcatgtatgtgtacgtgcccgcgtgcatctatgaacgatctctctctgctatagctcgtactatatgctctacatagttggcagtttggcaccaaaaactaaacaacgtcgtccgacggtacgtagcacaataaaataacgcacgtaacgcgagtacttgtacgacatatagatgtgtgatgcatggtgtgcatgtccgataacaatgaggactgaacgcatatatatagcttggacatgctctcgatcgatcgtctcgagaaagtgggtacatcccttctttctatataaagttaagactaaaagctcaaacctcatgctttcacgtcatcatcaaattatgaaccgttggatgaatgcaatagatcgtttctcagacgttggatggaatgtagcatagagcccaacccattagtcaccgggtgagtctcttcgcctcctcagtgtcaaatgtagctcacataaacacattggcccatctccacacacatctacatgtatctagcccgtcaatccgtataaaagagctttgtggctgaacgccccttcagttgacatgtgctacctaatttatctataaattttgaatatgactgctaaaaagaatttctccaagaaagctattagtttcttcttgagattgtaccttctatttaacaaattgatgtaaaccaaatcccgtggcaaacgcgcggggcatcctctagtactgtcaagagtttcagagcctcaacatcgatcaataaatggaattgaaagggacaattaaaacaggcaagaaacggaagaatgaattgcatgccttaattttcttgtccatcgcatatgcatggtaatctcatgcatctattgcgactatgcgcaaaaatgtactgcatatgctctttcttttatacaattaaccaacacgaaagtgtccattttacgtacgcagctcggcaggcattgcatacatccgatccaaacgtacatgcactgatgcacgccggccgcatgctttcctaggctgatcgatgtgctctactatgcagcacgcacatggatggtgagctaccaaagctagctaaagttatttctagctctgtccctaagtcaccctgttcccgcactacacatgataccagcagtactcaacactgtttacttgggtcatggttaaaaaaactaatccatgcatcgaaccggtccatgcgcgcattgcgtacgtgcgtgggctagctgttgcagctattgcgctgctggacatttttaggcagcgaattcaagtgctagtactactagaagtacgcgtacactagttacccactatccggcaagtactagcccgatcaaatttaagtcgaacaagacgaatgttctggcctgcatgcagcagtgcagtagtaggcagtagccaactggcaaaatgtgcgtacgctggcttcttcaattcggttcatccgcccgtccgccgcccaatcgccgatgcgtgtacgtgcgacgaggcggacgcgcgcgcgcacgcacgcacgcccgcccgaccggcgccgtcgcgcgtggctgggcgcgcggtgcattgcgtttgcgtcggtgtgtcgcgcgcgtgcatgcggtgctcgggatcggttgcgtcttgcgtggttgcctcgcaatgtcatcgagagcttcgatgcaagcgtggtttcttttctgaattccatgcacgcgatggtcgcactgctgcgcttgttgccacggctgttcgcctcagttgtaaaaagggagaaaaaaagggactatccgaaaaaccactacaagttttttaaggaagaactttcaactctaactacagtataattgtaatataattccactatagctaattataactataatactatctccgttttatattataagactttttacctttgtctacatttatatagatattaatgaatttagatataatatttatgtctagatatattaacatccctgtgaatgtgtgcaatgctagaaagtcttataatatgaaacaaatgaagtataagttatatataagtattaaaataatactacctccgttttttaatagatgatgctgttgactttttctcacatgtttgaccattcgtcttattcaaaaattttatataaatgtataagatataaatgacacttaaagtactatgagtgataaaacaactcataacaaaataaattacaattacgtaaagtttttaaataagacgaatggttaaacatgtgagaaaaggtcaatgtcatcatttattaaaaaacggagggagtatatataaggaacgcgttagggagggagctcaggaggatatgcgaatagataacaaaagtcaatagcttcaagcagttgttgggatggagtcatggagattaattttctcggaccacttccagttgctcatagctaggttcgttcgttgactttgtgaaatttttaccttcttcctgtgcactctgagaggcagggtttaactttccaatttcaaagtaaaaactgctcctcggttttgccaaaatccgatcgaaaatcggtaaaaaccgatgactttcaattaacaccatacgaaaactgactaataccaatccttttcacaaaagtcgaccggttttcgcgaaattccagcggtattgcgaatcctgctagtgagaggcaatggagccgccattgcagacgaagatggagcaggcaagcaagatacgagggaaaacaaaaagattattctctccatacttttcgagcaccaaattccaccctacttactcccaattctgcacacatcaaccatgttactctccatgctttggcataatatgctcccggccggtcatctttccatgttgcatcgacgtcatactcactcgaacgatgtcgacactggctcttggagaaaggaacgacatatcacatatgtctatgatattctatcccttcatcaaaccaacaggtatacaagattatcactagctagcactgcaccatggctagagcccaatttcgctctcagctagcttggattgtctgatggcgacggaagatatttttttgccatgctcaagagatctagtcggccgatgatcaaaacgatgaaagccaccaaggcacaaaactcgatcatcatggctgtcaaaatatgcctgacgcactcgctggcatatgcatctcatccaggattagatagttgtttcagatatgattgcacaatatcctttaaatccagtcgatatgttatagcgattctgaatgacctctaccgtacttgttgtgcatgcactgaaagaactgaaactaaaatatgcaagcatgaaaaaatcgcaatcatgaaaggatcaagcatcaagtcacacaaatctgaaactgaaactaatttcgaagcgagagagattgagggagagaaaagagaagctggagaagccataataccacttgcaggtgggtctcaaaagggtttttatttttatttttgtatatagggccacatagatgccatgtcagcattaattgaccccattaactcgccacgtgagataaaaccgttattcaaactgctcaggaactggttttgatggttagaggatgctctgtagggatgcaaat

SEQ ID NO: 56546 - DNA, 1735 bp, Oryza sativa
gagcaatgctaaaaagagttttacattatgagtatagtataattatacaactatactatactatagttacttttgaaagtttttttcctaaaaaacttgcgagaaaaaaaagcaaccaggaaaaaaatatgactaaaatttttgtctatatgttattagtgctttaaaagttaaaaggctagaaaataggctacgataaaagaaaaatcctagagcaactaagtttcataattcagttacaggcttacagctttaatctaaaataatgtttcagaattcagttatggctgacaagccaacaagcagatgatatgagcctgcgcattggcaactgcccaggtcggttatttagatctaaggtatcttctgcatttgctagttcaatagatttcccattggcacaggatagcagcacaagtgcacaacacggcaattaagccccaaaaatgacagcaaccaaagcagaacaggagagaacgggccagggccacattaactgaattaattgaatgcaactatgcaaggagactttttacatgggcgacattgcattgcatttccttgtttctgtaatctgtatacattacaaccacccctcctcctagatgcccttcagatcttttgactattgcaacgtgcaataattgctgctgcagatcatggacaaactaaccgacaccacgtgattttcccggccgtgtcaacattctgccagctcctgccagcaggctgagctctgctacggaggagcaactcaccagaattaagattagtaaaggcttcaagggtatttggtacaataattacagtgtccgtggcatcaatcatcgcctgcaaaaaaattgggagtcaacacttaagatcacagcgtatatctgctcatatgccttccagagatcaaccatctaatatagccattggttgatttcaactacatgccaaatgctactactagtactatcaaaccatggcaagaacatttcttacatatgaccaccacaaaacatgcatggagtaagctgtcaatgtcggagttcttctcttttcatgaaattaatgaagtttgattgtgacattgaaatgaagaaaaagtagtctgtaactctacttactggattgtggatcaacgtgaacgaagaaactggcggcaactattagataacacaagatcagcataagtcctttcaagtagttcgcaacaccatcctgtggaaacatagaaagagcgtgtgatcaactggtgatggttgagatatcagaacctatgccaggtaattcataagagagctatagcagatagtgtgaaaatgaaataacaagaaagcctgatcagcatattactattgaaggtttactgggctaatattacaagcgaggtgggacaagataattaaagccactactgaaggtaaaaagtattacataaagtaggtcagttctagttcctttaaagagtaagcatttgttcattggataatatgaacattacaacactaaccaatagcaaccaccgaccattatgcttgagaaagacttgactgtatacttaataatgttaaaacaatcgtttagtaccgctactccgctagaacatgtttactctggaggggttatatgtgccaaggcatacaaaaacaaacacagcttgacaaactcttcattaagcaggcatcccttatcaaaataattcttaatatttcacacaataacctacctgtagcataaatgccacgac

SEQ ID NO: 56547 - DNA, 1808 bp, Oryza sativa
attcctgcagcccttactataacctaatgcaagtgatcactaatcaataacggactggtcccatccgtaaccacagcacatagtatctcccttgatgagacatgcaaagcacacataaccattctttcttatatggaagtacataacataattctcaagtggtgcttccacggcactacttgctatttatatgttcgttttgcatgccatttggttggcttcctcgccttaaattctgccatcacatcaactcttctcgtcgtttctctaatctaactaccgccctagaagcaggatcaaaggtgagagtatgtgatatagagtggacacaacaatgctaacttgtacttcttgactatacagcattgtcaaccactagtgtcatagcatatccgctcctcaccattcgattgatcggttcggttggttaacttgtataagaacttattagagccagcacgaggcaaatatagatgcctactatcattattatttctttaaaacactgtataaaagcaagcgaacatcttttttttttagacgacgaatcacatcctcattaactgcgtgttcgctcgacaggtctaattccgtgtgatgtcccctcctggctgagttgccctctctccccctcgtggtagctggctccaggattagtggtcatcctccagggcctgtttacctgagcacctccgcatcggtttcgactccttggttctcctagtctcctggcagctgtagaaggaacgaaactccagggttttcgactctgcgctcgcttcggtcctggtggttctggagtccatccgctcagagggccagctgtgttctttagccggtgttgctgtttttagggatttcttgggagtgtaggtggctctaccccctcccacgtgtttggagttgtgtttttagccgtcatagtagttcctagctcgggttattttatttttctttttctccctccccccttgggcataagctgtttggattcgatgcgacgtacaatccttttacgcgtttgaaaaaaaaaatgaacatcttcttattatcgagatctgctagatagcccgaacaactgtcaagcatcgccagatactttcttacttccatttatcaaatagagcatcacagctctacatactttcttacttccataaaaacctcttatattcggaacggagaaaaaaatagacgctgtactaaagctcttgtagctgtcacatcgcaggaaaaaaatatttgtttaagttggtacgaaattgaaagcaatagcaaaaatattaatggcatgttttcaactttctttagtaggcttataattattttaaaaaaacgaaaaagtcttttcatctagcaatttttgcatcacaagatggatcatccaggacggcagcagatgctgaaaagagatcccagtgcagggttcagacaaaggcagctttctcctcttctgctggggcaaaaaaaaaaagtttttaatcaggcgagaaaggcaacaacaagcgcaaagcacgtcaagatcacgccgctcgcctcctccgttgcaaaagacagcgactttataaaaaacagcagaaaaaggcgagacttttagcccccgcaacaactcgtcttcctcccctctccagcagcgtaggccagcgagcggcagcggcagcagcagcagttgttgttgggggtaggtgcgcctcctccccaaccaaaccctcgcttccctcgcgcgcggcgcggcgatggcgctggcgctggaggcggcgaggtcgtgggcggcgtccgtgctgccgccggagctcgccgccgcggcg

SEQ ID NO: 56548 - DNA, 1166 bp, Oryza sativa
aaggcaccggcattaaagagcaactgctgctgctgtctgtctcgacgagcgcgcgctgcacacacgcactttcgcagtcgcagaggacacgatgcgatgcgatgccccgagagggaaggacgaggaggtgaagggaagacgatgtcactgtccgtgccagtgctcctgcgcgaggagccgaggagggaacagcgcgatgcgaactgcgagcccggcgaggcctccactcctaccgtcctttatacgcgtgtgctcccggcgcgggacagttgggtcccagccgccaacggaagcaaacgccaatgctttgttcgcgcgtcctaatttaaatgcagtcacgagttttcataattcatttgatcatttattttatttaaaaattttataaaaaaaattaagaaataagttatatataaagtactactatgttttattatctagcaacaacaaaaatactaatcataaaaaaaaattaaataagatagccgattaaagttaaacacagaaatttacaactaccacttaaaatgggagaagagagtattatcaccatagctacttcgactgtttgggagcttctacaacttctatcaaaattaaaaattcttttaaattagtctagtttttttttggattttaatagctatagttacaaaatggaaaaaaaatagaaatcagatttttcagaaaatgactactaaccaactgtttttacaatcttaaactatattaaataggatctacagtctacacatcactgcctcagcagctcatcagcatagccatatctcgtgggcattgtttggctcttcaaaccaaatcgacctactactactgctgctgctgccggcttcttccacggctgaattctcccataagttgataggtgttgtggctgtctatttggtggcctgccgctgattgctgggcggcgatctgtccgcacgccaatgaatgcagcaagcggctctccctgtttgtgtgagtgtgttcgcatcggatgggacaattatggggggagaggctttgagcgtgacatgtcaaccgttcgtcagtcagctccaaggctccaagccatggcaaattgcaaaccgtataacatcttttcttgactgtcattttgcaaaatttgtttggagagtagtacagttttttactggtttaaa

SEQ ID NO: 56549 - DNA, 707 bp, Oryza sativa
ttcggaaccagcaaactctattgctgctacttcacaagttttgctacatcaccaaccatgacgttgttgtgaatctcgacatctcggcatgcgatgccgtgttattttactacaacaagtggctctccaatattcaggattttacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttagacgagttgggcaacaacatcaactctcctccaagtgaagcatctacaacagctataacattaatttgatggattattgtcactgacatcatcaccagcacctctgcttcatcgaccctgacatctctgctgttgctaatggatgattatgttttcgctgacttattatttcaccttcacggttgacctactatgcaaatgctgatgagcgtctttgtcattatcattggttgctacactgctattggctggatcaccgacatcgtcatcttcatcatgtcggttgcgtttgttgtcgtcaactacacaactttatcgctga

SEQ ID NO: 56550 - DNA, 2194 bp, Oryza sativa
tttggtaaaagtactcgggagaccatgacgaagatgattgaagcactcggccttggagtaatctagttcgagagaaggttatctttccgactgtgaaggtctcaggggctactgtggagattatgggtaccccatacccacacggcatggttatccgactagttataggggataacttatatctatgtaatatgtaacagatcatggcttgggtgttacgtttccttgtatattacggaacagcctaaagtccagatttaggaaaccgataccgtattggttaaggtttctatcttgtaatcctgccccccatcctatataaggtgggcaggaggccctctagggggcagatgagacaacctgatcgtcagatcaatacacacacggcggattcaaatccccaaacaggagtagggtattacctctcattgagagggcctccctagtattttaatatatgacgccgttgactttttgataaacgtttgactttccgtcttatttaaaaaaattatgtaattataatttattttattgtgatttgatttatcatcaaatgttctttaagcatgacataagtatttttatatttgcataaaaattttgaataagacgcgttatcaaacgttgattaaaaagtcaacggcgtcatacattaaaatacggagggaatacttcctccatttcacagtgtaacttattatagtatttctcatatttatattaatattaatgaaattagatatatattgtgaaacgggggagtagctcgatatctagtgaaattatgcttcgttggccgatcgggacaaagtacatccaaaacatgatatgcacttaatttgttaaatatatactattaattatacactgtgttcatagaaattggcttgaccacagtgttaattaaccggccatcgccggcggcgagacgtctggatcattacggccaaaagcacggagccacgcacacccatccgctgatgattcgccaggacggagtcgttaggcggttaggcccagccgcccagccggctgtgtttaggccatgtttagttccacccaaaatcctaaccttctgttacgtcacatcacatcgaaaactttcctacacatataaactatcaactttttctctaaactactaactttctcacagcttcataacttctccaccatctaaacacacccttaattagttcacataaaaaattgaaagtttggttgaaattgaaatgatgtgatggaaaagttggtagtttagaaaaaaactttgaagtaaacacggtgcaaattaaaatgctcgatcatatcgccgcttgattctcaccacttgcttgtacgccaatccatgattgacaacgttgctgtttaacattgaccttgtctcggtcacttttgaaaattaacctgacaaagtacctttacccaataaataatttgcaactctgttcttacattgtccacgtactccctccgtcccataagggattttgtagcgcccgttccgtcgtggcgcctagcggaaaaattatctcctaaaaatcctaattgcgaaatttgtttcttcgcttgtcgtctagtgtccgtgccgtctcaagatctcaaatccccgatctatcgtcgagttcaattccgaatccaaatccttccaaatcaaattcctccgcaaaagtctagtttgcctcccccagggtcgatgggccgaatctcgctcggcccatctctccctccctccccggctctctctctctctctctctctctcgctccccctccgctccgcgccgcccgcgcgccgcgcgcgtgcgcgtgagccgctcgcgccgagcgccccctttcccctcgctctccttctccccatccctggcaagctccccgcccgcgaagccggctcccgcgcgccgttgttcgcgcgcgcgcccacgtggttccccgcccgcgccgagtcgagccctcgctgctgctccccgcgcgtcgttcgcgcgcgcgcccgcgtggtcctcacccgcgtcgcgtctgcgccgcccggccccgctgccctgccgcgcttgctgccgcgtagccgctcggccccgcagccagtgcgcgtgcccgagccacgccactccatccgccgcgcctcccgttgcgacccgcgcgcgcgtgccgtggtggccgaccgcccggtcgcctccgccgtcagcccatgcacg

SEQ ID NO: 56551 - DNA, 3114 bp, Oryza sativa
attcctgcagccctccctcctccttttcccgaagaggcaaggggacaagcccctttctccccctccttttcccccttttcctcccgccggcgtcatcctccctccctcctgtcgccgttttggccgctagccggagcgccagctcgcgccttgaccgccaaagtcggtttccaaaccgacattgccgccccctataaacccgagctccctccctttttcctttcctctcccattcgcctccgcgccattgccgccgcctcccgtgctctgttcgccgtcgccgttcgtcgttgcgcgtgtcggaagagccggcacgagcaaggacgcggaaggggactctgggcgcaccctcttcttcctcttcctcggcccgaggccggagagatcactcccgcgccgtcggcctctcgtcactgcgcccctcctcatctcggtagtgcctctctccgttctccctcctcgctccatcttccccccttagttttcggtggtagcatgagtagcctccccgtagctagccggcgccgccccgaccgttgccgtcgctcgccgtgtgctcgccgccgtcgccgctcgagctccgtagcacccgctcgtcgccagcctcgctcggcgtagctccgcccaatccgacgctagcatcggattcccatggccgcgtggatgctctcaccgccgggaatcgacccctcgtgacctcgtcgccgtttccctcttccctccccgccagttgccgccgccgcgattcgccgccgtcaagctccctccggcgaatccgagccgttggctcgtctcccctcgtcacgtgcaaccacccggtgtgctcgcttttgcctgtatcgccgtgggttgctccgtcgctcgccgctgtcgaccgccgtccgttccggccggcgtcgtcgtctacctcccgccggcccgcgtggcagccacgtaggcgccacgtcggcgccagcacagccaaggccgggtcgagtcgaccccggtcagtcccttcccgtgcgcgcgttccaccgcgagccgtgaggctgcgcgtgggcccgccgcatccgcgtccaccgcgaaccgcgcgcgtgcaccgcgtccctcccccaccctagcgccgcgccgcgtgctccctccgcacggtgagccgagccgctgacaagcgggtcccacccgggactgcgcgtggtgagcccggtccaccggccctctctctcctcccctcccgcgcgcgcgcttgggccatcttgggccggccggcccatttagctcggccggaccgccccatctctctcgggccgcgccctagccgcccgaggaaaagtctaatttccatccctcttttctttcttttcttttctttttcaaaaaggatttaattaaatccttttcctttagaccaaaaatccaataatcttagaaattcaatatcttcccaaccgtaaatccgttcgactccgttcaacttccaaaattcctcaaatctcgagatctatctaatggcacgcttagaggtcattaatagggctttattttcgccgtttgttgagttgtcccgtttcgcgtgtagtctcggagcccgaagacccgcagtgcgaggattgcgaggatcaagctccagatctcgagcaaggcaagccacctttgaacatcttgagcctatatttgaaatttaattatgttgcttgaaaaatattatgcattgataggatcgcactttttctgtcgtcccgtctgcaaggcagattggcggacccacctagtttgttgcatttgatccttcctttgttaattgttataccttgtccccttgtaaccatctagttgcgtctcgatattcgtgcaccctgtgcgagtatcgacggacgccttcaaacttaaaaatctgaataacaacttgggtaaaacttgggttttacaaaagatttggaaaacccgacacctgggtcggtgcttgcgaactaaatgaatttccaaaaccgcgggccggggaacgtaccgggtgtacggtttcccgctctcgcacttaaggaccgatttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggataggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacaaactccgaccggacgagacgcactgtctcaaccgtgtcgtttgagaagcactcacctagttgtttttagaaaagagttcaaataaaatcaattgcaaaaacaacagcctttcttcgaagcctgcattaaacacttatttcccatggcttgctgagtactcccgtactcacccttgctctatataaatatccccccctcagttgctgaagaagatgaagcggattctgttgatgaggagttcttccaggagcaagccggctacgatgagtttagggtttcggcctagttcctaagtcacgcctgtgttgattggtccaagtcctggcttccgtttcccttttgtaatgcagttgtgagctcgggatctgtccgcagcccaacatgactgtacctctactctataataaagagacctctgttgctgtgatattctgtcttcctgtgataccagcactatttcctgggactggtatcgattaacaggttaatttagag

SEQ ID NO: 56552 - DNA, 1357 bp, Oryza sativa
acgaaaagttgtgtttaaagtattatagataataaagtaagtcacaaaaaaataaataataattttaaaaatttttgaataaaatgagtagtcaaacgttgcagacaaaaatatcttttttaattaaggctgtgtttagttcatgaaaaaaaattaaaagtttggagaaaaagttaaaagtttatgtgtgtaggaaaattttggatgtgatatgatggaaagttgaaaattgagggtaaactaaacacggcctaacagtaaaaaatgcatccaataattaaactgatcatatatacataaatacaactgagacaagaagtaatactcaactggacaacctcaaggagctctgattttttcacaatctatctcatattataatgtacataatggcaacatattagtagcaagcaacacgtacagtggccgagttaactcccgtgacgtcagaacccaccaccaccacccccgccgccgccgccgccgccgcagccgccaccgctgaatccgctgcttgccccatggtcaccggagtagtggtgcccgccgccgccgccatggtctccgccatggtggtgccagcctcctccaccatggtctccgccatgcccgtggtgatggtggtgcccgccgccgccgtggtccccgccatgcccgtggccatggtggtggtgtccgccgccattgtctccgccatgtccgtggccatggtggtgatgcccgccgtgagcatccgagctagcagcgaaaatgcacaaatcacaacaagagagatggaattaagcactgatagcacacgtgttaactcgttcttacctaggctggtcgccgccgccgccatcaccgccatcgccgccgccgtccggcccgtcgccaccaccatcgcctccgtcgccgccgccaccatccccgtcttccctgcggcggcggcgcttatctttcttccttcttgggctgtctttaggcccgtcggcacagccgaacaccgcgatcgccacgacggctaaggccgcggcaaagccgaagccgatgaggatccaaccggcagcaggagcagtagggacggcgccgaagccattgcccgcagtaacagctaacgccctcaccattgttaccgagcaagaagtgtctagctagctagcactgtgttcttgcagcagcagcagcaagcgagaatggaagatggataagtagcacacaagcttaaagtgcttctgttaattaggtgcaggaaaaattaagcacgcatcttatgaagtctcgacgcgttgtttctaaaaagatagcgaatggattttccaaactttgctgagaaattgtgttcgatcagtagtgccccagaggatatcgtcgaaaa

SEQ ID NO: 56553 - DNA, 1318 bp, Oryza sativa
cccgtcgccaccaccatcgcctccgtcgccgccgccaccatccccgtcttccctgcggcggcggcgcttatctttcttccttcttgggctgtctttaggcccgtcggcacagccgaacaccgcgatcgccacgacggctaaggccgcggcaaagccgaagccgatgaggatccaaccggcagcaggagcagtagggacggcgccgaagccattgcccgcagtaacagctaacgccctcaccattgttaccgagcaagaagtgtctagctagctagcactgtgttcttgcagcagcagcagcaagcgagaatggaagatggataagtagcacacaagcttaaagtgcttctgttaattaggtgcaggaaaaattaagcacgcatcttatgaagtctcgacgcgttgtttctaaaaggatagcgaatggattttccaaactttgctgagaaattgtgttcgatcagtagtgccccagaggatatcgtcaaaaaagtgtgaaatgagctaaggtcaagccttcaatgttgacgaagagtttgcgatgataaaaacggaaagtccgcagctagacgacttctaattcagagtgtgtttagttcacattaaaattgaaagtttggttgaaattggaacgatgtgatgaaaaaattgaaaatttgtgtatgtaagaaagtttcgatgtgatggaaaagttggaagtttgttaaaaaaaattggatcggtctgaggctgcatacgcgttcagaagttgcacagaaactggctcatcttgacccatgggcacagttatcgccgccggcggcgagctatccgtgtgattacgccgaaactcacccgccaccgaccacgcccacagatgataattcaccgaggagattggacggtgagtcatcgcgatgaggcccaggccaaatgacccagggggatccacggcctggcaagtttttcctcgatatatgggccgaaataggcccactctatcggcctactccatcacataaagcccaccaaatgagacggcgatatgtttgaaaaaaattgcaccgaatgtctctcaacttgtcatcgagttaaaaaatcgttccccaaccgcaaagccagatatatgatatccttcaactttcaaaaccatttactttagatccttaggtggttttgaccccggtttgtccgacgtggcggctgagttagcgtaaggatccacgtgggtcccacatattagggtgaccacgtcaccacccaatctttttttcccctcttctctcctatcctcctctctctctctctctctccgacctctctgcgtaggttggccgtc

SEQ ID NO: 56554 - DNA, 4702 bp, Oryza sativa
cctcaccccgacgacgacgtgtgaccacagcaatggcgccgcacggcacgtagagggggaggaggagggcaggcagacgaccgccgcataataaagaaaaagaatgaaatgaatatcaggccagtccaacaatatttttataatgagtgtctaggttgattatttttctatattatggtatttataagggtagaatggtcatttgattattgttcttgcatgtgaggatgaaatggcatacccacgtgacgttttttttttgtttaaaggactaatgttatgctagatgataaattttaaacatttgtttgtgtgtttcttatcttggtcttatcacttttataatgtttgggtgtgtttaattctatttgaactacactttttgttcgagtgttagattgtaataattggttgtaactctgttgagtaaagaccgggatgttaactattctattattaaaaaaaattattgaaacgtcaagcactaaactaatcctgaaacttcatggattggctattcaccctaacaaaaataaatgagctgccgcacacaaagtacagactaatggtcatgtcgtgatgtatgccacctatatatcccaagttttaagtgagcgtgcaggtcagaagaaaatattagatatgggagaaaccctaaataatctaatgtattatgttgtattgacactgtaatgataggtatatatagagagagtacatatgaggtagatacaagttagaatatacttatctttaggactcccttttatcagtacaattcgtatttaaactctttatctccacctgtacacaactatagctactacggccacggcaatggcgccgcacggcacgcagagaaggagaaggagggtaggcagacaaccgatccgtgcaacggtagccatcggcggcgccacccgtcgcatcggctatcctgtccactgcgctcctcccctgccagccgccaaccacgctggccctcctccctgccgcgtcgaggacgccgccgccatcaacgcctagggggaaaatgagagaggaagggagagaagagggaaaaaagagagagggtggtgatgtggtcaccctgacatgtagagtctacttgggtcccacgctgattcagccgttatgtcagataaaaccggagtcaaaaccacctaaggacctaaagtgaatggttttataagctgagggatgtcatatccctggttttgtggttggggacgattttgtaactcgatgacaagttgagggaccttcggtgtactctaatgataggtatatatagagaaagtgcatatgaatatatgatgtagatacaagttagaatatacttatctttaggactcccttttatcagtacaattcgtatttaaactctttatctccacctgtacacaactatagctactaacacccacctccgccgccgcagccaccgccgccgccacaaccgccaccgcccccatggtcaccggagaagtggtgcccaccgccgccatggtctccaccatggtggtgccagcctccaccatgatctccgccgtgctcgtggtgcccgccgccgtcaccaccaccatcgcccccgtctggaccgtcgtcaccgccgccgtcatcgtcccggcggcggcggcgcttgtccttcttcctttttggtttctgtttaggtcgatcggcacagccgaacacggcgatcgccacgacggctacggccgcggcgaagccgaaggcgacgaggacccagccggcggctggagcagtagtaggcacggcggcgaagccattgcccgcagtaacagctaacgctctcaccattgctacgtgagcaggaataatcggctaataaccttttcttcttgcagctgcagataattaacgtactctcaccattgttaagtacagcacaagctcttgtgttacgtgcagaattggagagagagagacattgtaagattcaacgcggttttctgagtcgtagagaggaattggaggagttgtacagactcttccttgaggaaatgtcgtaagcgtgtgaaatgagatcatatcagcctgaattgctgacgagtttgctactatatataaacagtggaatagtcaataagtacatctggcagctatacgacttttcattcaaccccccagatcagatcatcaaatgtctgttcacagaagttgcacagaaactgggtcgagctcatcttgaccggcggcgagctttctgtgccattacggcgaaacgcaccggcgccaccgaccacgccaacagatgattcaccgaggaggctagtcccagaacggcgaggccgtgccatgcggcccagcccaaataacccatggcaatcacgtccgcaactgaaggaatctgtaatagcaggtgatccattaaatctgagccacacagcctgatcgaacggctgatagagatcctgggggttgggagttttagactccgaccccctcgaacacccaaaatcaccgctctgtccaatttaccagccgctgacagttcgcgaggagcagctgatcaattaatctgagccgtacagttcgatcgagcggctggtagagacccatgggggttcggagttttgaaccccgcgcgacccccattcgcagccggaaatccaccactgcgcgtctgcgcctcatcgtagctctgccgagatcttggctgcgtcttctcccttctcctgcctcatcgagctccatatggccgcactccatccgtccagcgcctgcaattctgaatttcagatttagaaaccgtgcttcacatcgctctgcaaaggagacttaattcctgaagccgattaagaaaccgatgattcagaaagagaagaagacacagcaatgcttgggagtttcaccattgtttttcagacgaaccgaacgagatgaaaatgaagtatcatcttgttgcttgctgatctttttacagcgagatgatacgtggagtttcagtaaaatattcctggtctgtccctgatagtcagataagagcttaacaaccaaatctttaatatgaagatgctccttgggtatttgcatgctagctgtttgcagcacgcaggagaggaggaccagcgtagcaagactatgcgctattgcatccatcgtctacggcataacaattgtctggacattgctgctggatacctctttgtacctcttaaactgtaaaatttctttggaagacttagcgcgaaagtctattctgatcactagatacaaacaaattaacttgaaaaaaaaatatgttggcgtacaacaattgcatgctcgtaggagcttagcgccgtaaataatcattgtttttcaactagaaattacgtaaaagagatactgtaagctgcttaagccaagatgaaaatggaagaggcgaatttgatcgtgagtcaattaaactgtactgttattactcactatcactgccatagtagtgccatgcataatgaataatccataccacgaatcttgtcttgatcaactggatccgtcaattaacctccgtctactctccacctcctcctccgtctgcgcctccaccgccgtctgcgccgcccccgcaaccgtctgcgccgccaccatcgccaccgtcatcgccgccgccgccgccaccgccgccatcaccacctccatccccgccggcgccccagcaacaacaacaggtggacctccgggatctgttcttgcggtcggcgtatccacaaaggagaatgaccacaatcgctagcacgaacacgacaatgcctgcagccgaagcagcagcagcattggacgtcgcgttgggcacgagaagatgttgctcgctagccatttgtatgatctcttcgatcttcttcgtctaattggttgatgattagggataaaattaaattaagctgcaagctagctcgatcgagtggtaattatatagagaggccttccggcgcattaattatgttttctccgactttgcactctagactggtgctagcgtgtagcgccttgcagatgtgtgctggatcgatcgatcactggagacgacgtctacgactttgccaatcgatcccaatggaaaattggaatgcattggtaggatagaacatgggccagtgtggatgctgctgaccttgacttaatttaatcaagctcagcctgtatttgtatactgtctacgttgaccatgagaggggcagagatcagcttcacatgtatacgcccgacggcctgacattgtttcagcccaactttaacgggccggacgttccttgccttttcagcccaactatacgggccgcatggcccatatgagaatatactggactattatgcgtacgtcgccttcctgcggcccagttttagtggtttgatgattaagatccggaataagttcactttgtaaccctgaaaaagtaatcgaaatctaatccgtgaccctaaaccacaaaaccggatatctagacccccaactcttaaaatcggtgcaatttgactccctcaacagttttgaagggtggttttgctaacgtgacgcctacgtgacaatattgactcggtcttctttgcacatggcattgacgtggcacttaggtggcattagaaataaaaaaatatgtgtgggacccatttatcattcaccaaaaatatgggtgggacccactgacatgtgggcccacataaatcatcctctcttcatcctcccccccccccc

SEQ ID NO: 56555 - DNA, 1100 bp, Oryza sativa
ggactcagaaaacagtagccaagtctcggcaaagaggaggaaattgcccaaccaaaacacccacaaagaagaagaggaggagtcgccaagacgtcgtaggcaacacctcccttcccccctacccttgaaccgaggccgagtcgtggtcgccgcgagtggaaggcaacaactctccaaggcaggcacaggcagcagcagcaggaggagaggaggcaggcgcgggcggcgtgagcagcagcggcagcgccgcattacagccttgggagtaggaggaggaggaggcagcggatgatgatccctagggaaggggcggtgccggagcccgcggcggcgtcctgatccccgaccgacgatcgcggctgctgctgttgctattttttcaggttggttttggtgctattcgattcggtttggttattcacgagttcttggatttggggtagtttggatttaggattagtgggtgtagtgcttgctttggttaggtgcggcgtggatctgggaggtcgatttagtatgctctagtttggtatatgtgaattattcagcgcgatttgagaatattgaagctgatttatgaacttgagcatatcatagagaaaggaagggagcgaatttgtggagaaagttgcttctttttcacacttagaatagttttatatacttttaatcaactgattagacttcctgtggtggtggttatagaggatggagaatcctcagattgagatgggggccttcaaggcgaacggtccgcaattgcagaatggtgggctacgttccagcatggttcagtcctggaacctgcagagattcgttgagagcgcgctgcggagcatcaggattgtcatattcacttctaagctcaatctgctcttgccgtttgggcctgcgtcgatcattctacactatactaccagcagacatgtaagtcctgttcacagcaactgaactctattgaccgcattttgtttatatttatcattgttcgtaggctagaaaccagagtaccctatcgagatgaactaataattgggctcactgctctttagtaacattactagttttgtattttttgttaatgtttcatcaattgaaga

SEQ ID NO: 56556 - DNA, 727 bp, Oryza sativa
ccctgtgtgtgcaaagcataaattaagatggaacctacgtgcaaggcttaatattgtaatgttgagtgtaagaaaatgactaatgctagctaatgaggggcccaacacgtgcatgcaccctcctacttgcaatttcatctttgataaaagaaagttctaatgacaaagattatgtatagcttagcgtcgagaaaactcttgagcattcttctacatgatgagcacactgacattgcattgtcagtagatccactagtattagaaaacattagtatgaaagtagtattgcctacatgcatgaaagtattgcctacatgcgtgttttctgcaaacatcacccagatataattagtcaaatgttgagaggttttgttgggttattgatatcattttttcttatcaggtcatacatttgttgaagaagagggcaacaaaaaaaggcttaacaaatttctgctaaacaaaaaaaatgaacatggacgacagattcaacatggaaattaatgtacaaacttaattaccgaatgttccgaggtagagatccttgttgccagccactcttccgatccttgcttgccatcgcccatgctggtgatgtctacatggttgcatcacacaaaacatcagttacctgagacttacgtgcaagaggccaaacatggctagctaggctacaagtgaaagattagtacaagaccaatatatatatgaaccttgtaacacccct

SEQ ID NO: 56557 - DNA, 6574 bp, Oryza sativa
aaatatgtaataaatccatctttatatatatgcatgagagttaattaccggaaagttggttgtggtgctaggaccccagtacttcaacgcggcaagatcatacgccctcgccgctttctcctccttatcatagccacctgtaaaatcatcgaacaaactctctgcatcattcaccttaaaatgttccaaacgatgcaaagttacaatagctgctactactagctagtagctggccaagagactagatgcatgtgtcttttcttacccaagtacactgtagatcgaagacaccagaaacatcagccataaatgagaagaagcattgccaacaagtcgacagaacaaaaaagaaaatcgaagttagctggatgcacttatgagattagatgcaaatagctagcaaaatgcagtagtaaaattattgagtagtgaccttggcgtcccttgcggctctggccctcacgccggcagctgttatcccacagatgcgcctcgtaccttccggtccaccgatgcctatacataaccaaggattttttatgccctaattaaaatctctgaacaaatattggtcatttgattcttctactcccattaacaaaaaaaactactactaaatcctattaatacgatcgatgatgcatgtgaatctatatatgaaggatgcacacgaacacgagatgattagtttgcgtgcaagaaattagacgagctagctaagaatttatttttagattttatggccgacacatgcatagactgatcgatctcagcttagcttagctatagcttaccgtgtgacgccgcggtagatagacgttctctgcccgaacgagtccaccgccttcttctgctccggcggcggcgccaccgcggcctgcggcggcaaggccagctgcttcgtctcgtcggtctgctctagagcagccgccggcaacagcgcgggcaccggcggcgccgccccagccgcgccgctcagctggaagccggcggcgagaaacttgagctccgactcgtacagctcggcggccgtcggcgccgtcgtctggaccggcgggcaagcgccaccgcttgatcccccgttgcagccgccgccgaggaagtcctccagtttcggcggcggagccgccccggctatcgcggccagctcggccgccgcgcccctctcctcctcctccatttcacctgcacaaacacacacacataccaacgcataagcacggcacttactccaaaaaatgaccaagaacacacacacatgtgatcgatgaacagacaacgaagtagaatgagtactaacagtggtgggcgagggagaagttgagccatggatagtggtgcgaggtgtccatgtccatggtaaggtaacaacgagagcttgtcgatcgaggcgagtatttttctgcgagctactagtagcagatagaagaagaagaagcagcagcagcagctaggtgaaggtgaagatgaagagagcaggaatggggcggtggatggtgataaaatagaggaaagagaagacacgacgacgcactgtagtctgtagagagagagagagaggggcgccgcacaggcaacgaggcgcggtatatttatatgagggtttcgaggaggcgccatgtatgtagagagagagagagagatgctttttactagtactactattccatggctttgaaagcttggccgctagtaggagaggagaggagaggagaggtgtggtggcagcggtgaagaggtggcgttttacaggtggagggcagggtgcggtcggcgccggcggtatccttgaccgccttggaagcaaagttgcattgcaggcaggggcaatgctcgcttcaaatctggatggatggataggcttggttctgcatgcccggccgctcatgaagataggtcaccctagaacaatcacgccgagttgatgtttacttggtaagagtacgtacaatagcatactttaaaccagctataaatatatatagagagaagatgaaaaaaagatagagataaacagtaggctacacatttatagctttatttaaggtaagagtatgtacagtagcagactataagccagctataaacatatatcgagaatatgaaagaagagagatgaacaacggtctataaatttatagccagctgcaacacaagttgtgggaccggatattaataggtagtatatatttataggtaactaatatatgaattggctattaaattgattatatatgatttggaggtagtagttggctatactccctccgttaaaaattattagtatttttgaaattcgacacagttttcgagataccattttgactagcaatatctatagaagtaagatgttttaaataaaaaagttatatatattatgatgctactttgacttagcaatatcatttttacatgttttatcatttttatttttttaatagttaaagttaaaaattttgacttggcactattttaaaaatgtttatattttgaaacggagcgagacagggagtacgtaattttctgaccgcacatatctatgttgagattagttgttttagaatagatctcgtcatcctagattataacattttataatgaagatgatataatttctatttgtatagatcgtttagattttcctaatcatttactagcaacatactatgaatctaaaatatgctctttgtcaagatttcttttactatgaaatgttccatataagattttcttggatagagggaagtaccattttcaacctaaattgccagaatatcccatataagtactgacaacccatcaaaataaagaaaatacccataacatttgtgtggtgtagagtgctgatgttataacatcgttataaagtatttaaattagttacttactattttaaatatctacttaaatatcatttaaatttgtaatataaaaaaatatttgcttctcattgttaatgtgatattttccaatgtgttcaattccgataattatgtttccatatttctcaatgtaattttgttgccattgcaatcgtaggaccaacattattttcgtctctgactataccatttcgattttctttccaagaaaaaatatatatttttggaaatggtttgaacatttttcccatgttgaccattttcatcctattatatattaccctccttgttttacatcctaattaatgttattaatcaaggactgatatttctccaatcttagaagtgttttgtactccggaatgcaaaaattaaagactactccgaccctcccccaacttttttttttgctgaattttattttttaactgtatacaaataaatttcttttttttactggcagcaccatatggtagcgcaccgaaaaatttcaacaacgaaccgctgaaattatgttccaaaatcattaacattttgcaccatatgatccgaccgacttacatcgctacaggtgtgtctaatttagatattgtagataattttaaaaacctctaaagagacaagtacatttatgtatttaattatgtatgcgcattgaccctagtatatttgtatcctgtcccctcaagaacagtacgaccacaaaaacatgatgtagtggagcaaactttgtagtcgtgcaaacaaccggtaaatatatgacaaaaatggtgcggagatggagcagaaatgggagggggttttatgcacggcacggaggaagcagccaccgatgacaggaaacgacgtgtacgtgtacaccattgcgtcttttcctcgctcgctatctacctcagctaagagaaagtttagaaagtttaatactattatatctaactaataactcaaaatcatctataatcaatttaatagtcaatacatataatagttacctataaaaaaatactatatggtctcacttgtcatacacattgcatcttagagtcacccatgggcgaagctataacgaaatgaagggggtgtcacttgtttaatttaatttactttatatcgagtttaagttgatacatgtttctaaatttatattgagagggtgcacacatgataaaaataggtaaggtttagttacaaattttttttcaccggctcatgggaagactctaactccgcctctggaatcacctgtcatacacctggtctcttcttttctttttatctcctcgatacatgttcatagttggctattgaacctactctaatcgtgcgacgacaatcgatggagcatggagctgacggagtaggccagtaccttggccgccgccaccgccgccgtgtagggtgtcgccacgtttcgccgccgcccgccacgcctgcactgcatgcactagctgctgctggttggcttcacacggcggcgacgaccgttcgccgtatcatcttactccaaggcttcaaagggtacggagaggctggtcgatcgatcggcaccctccgatcgttgcacggatcgatcggacgttcaggattcctcgagcagggctggatgacgtgtactgtagtgatgccatggacacgccggatcgatcccttcacgtcggcagggaggcagcacgtgagagaggcgtgcaaccgtaccggcgggtcgaccggccggagctagcggctctgcgacgcgtgcaccccggcgcacgtgcgccgtccgtgccggtcgtcgttgggggagaaggggaatctggtcaaaatatccatacatcgcacgagtagtaggactactcatcaccgggcaggtcgggggaagaagaagatggtgggcatcacgtggacatgcccatttttactggtttttcaattcagaatggcatgcaattcgctatggccccacggttgcgttacgtttcacattcgtgttcggttcaacggcgctgtcgatcgatcgatcggcgaaaaactgcgctgtgagtgccacgctgaaagtctgaactctgaactgaagagcggcttcattctgagttacaggtaaaagaattgctgggacgacaaaagtactcagtcagatgcggttggtagggaagtaagtacagtcaaattaatctacacacttgtttataacgatttgatttgatgagaagcgaggcacttcgccgaatagttttttgtctctgaacctccaacgctatgtcactctgaagaacagatctaaattcagttgtggcaatgaatcagacgattgcctaagaagttgacatatctacccttagccatggtaaattgaagataacaaccaaacagtccttcggtccctgtgtcttattcaggaaagaattgtttttcatacatatgcaatacaactggagagatcgcagccagtaaccatagcgatgctactccatattgtctacaacccaacaacctaaacaatgtgtcctacggataaccacggatcctcttacccattgggacacgcagcacgtcatcaaagtgaaccaaacaggatagggacgacgacgaagaagaactaaagctaaggttagtacttaacacacatgctgccctacggccatctcattgcggtcgataatgaggttgttgatgatcgaattggttaattaagcagtacgcgagtgattctaaaggaaacacaccagacacctatagctcagctcagctcagcttgaattgatattagcttagctacctttctttgcttccggtgctaaccaagaggcttaaactaagcctgatttgccagaaagttcaacgtctgcacgtgcctggcacaactttttttctctccttggtgttctaggtgcaaaggctaagcttggttcgtaactccttacgtcgtctcaatcccctccagaaaagatgagacattttgtatacatctgctaggcaaattataatctatctgatgtatgttctgacgtgttcaatggtagtatatctgttcagatatggtccatatggacgtgtagatctgtcagtggaagcactgcactatttgtatatgtctacgtagaatatgccgtatctagtacagctgctgctgctgctactactactaccctttgcaaagttgggatcgtctgctagctctgacgaaacctgcagcgggaagagcaggttgtaatgcaagctgcttgcagctgatttccaagtttgcaactgctaaaacatgcagcatgttagcaagtaggaaggtgccatattttgcatgattagttggttggtcttcggcagaatcttgattaatactctaattgccactagcatgaagctgggagccaaatgaacatgaagtggccgttgtatctgaagacgtaagtacgtaggccgaccggccgagattgacagtcaaagatggtacagtgattttgttataaactgattgccgttgaccatataatatatgtgtgtgtgtgtgtgtgcgcatatcgtgcatgcccggcgattagtgtgcagcacgttaatttcctgcagctcggtgctaagcttcacatgtctgaagaaaagaaagacagaaagaagtgtgatgagaaggtggcacatgcagaggcgacgtggctgcttcttgtcacactcgccggccaaccggcgacagcatcgtcacctccatattgcagctaacttct

SEQ ID NO: 56558 - DNA, 795 bp, Oryza sativa
ccaccggtccatgcaagatgcaccacaatgatagatgcaaacctctgaccaccactcatcgacatatggttggttcgttgtcatctcctgcttgccagatctacaaattgctgctacaactcgtcctagtttggaactgtagctacgagcctacgaggatggacgagatgcttggtgcccattggctcactcactcacacaggtccaagctagctactagagctgtagttaagctcaatggcccaatgtcattagtgctactgacagtgtgagctgcaacatctgtaattagcaggaccagcttatcccaaacagtagcaatgcagtgtcatacagtattgattcctgtgagcactgtgtaccattcatagggcttgtggtacacttgtgctagctagtatgcactgacaaatcctgatgatttccatgcgagttgaacccagcacatggagctttttgttcaggttaccgattgatcgagcagctaagacctcgagcattatgagatcgataagcatagcaatcgatcccgtgatcatacatgcagatgatgcagtggcgtgcgtgacactataggtacgttgttgctgaagccgaacatgcgatgctgcgtgcccgtggcgcaatgatccaaaagattacaggcttgcacgatcgaccaactgtttttcatgcaagatgttcagagagacagatagtgatatgtgtgttgttgtgtagatgcatgggcctcggctagaaatgctatttcataccgctacctcgtagctaccacggagagctatcgatcgaatg

SEQ ID NO: 56559 - DNA, 3078 bp, Oryza sativa
  unsure (1)..(3078): unsure at all n locations
acattttaccacgccacattttattagacgtgtattagtttactatcacaattgtgcattgctacactttttcaacaacatattctgcatgtcataggcttaattttttttgtcaacttttgtcacgctttgtggctaccaatttattcattattttctttttgtctatcaaaatttgctaaaccttagttgtagtaaagtgtggctgacaacctaatacatcgtaagatgctagccaaaaagttcaaagatgcaaatgataaagatgaagtactgaactgggctaaacacaagttcagataaggcccgatttgtggtacttaccaagtgggccaactacacaagaaattgggccgtcctccccggcccaatcgacccaataggtaggtactgcttccatgtattgggggaagcagagagatccccgaaatcaaacccctcctcttctcttccccttcctcctgcgttctagggttttgcctcccagcggcgactcggcgagcgagaccaccggcaagctcgtcggcgatggagcccacctcgtcggcggcgatggcgaggcagacgtgggagctggagaacaacatcccggcggcggcctccgacccggacgccctggacgcgatctaccgctacgacgaggcggcgcaggcgcgggtgcagcaggagaagccctgggcgaacgacccccaccccttccgccgcgccaagatctccgccctcgcgctcctcaagatggtcgtccacgcccgcgccggcggcactatcgaggtcatgggcctcatgcagggcaagtgcgagggcgacgccatcgtcgtcatggacgccttcgcgctccccgtcgagggcaccgagaccagggtcaacgcccaggccgacgcctacgagtatatggtcgagtactccaccatcaacaagcaggtcaggccccccaatccttccctcctcgctgtttattttggacctcatgatctgaccacgctttagtgttgctccaatctaggtcgttatctgctttccctgcctgaaattgtatagctaggaacactaaatcataataataattagtagtgccacggcgccgtctgctcaaaagttgtgcgggaggaagtatttgtggttaaatattgttagtgccacggtgctgtctgctcaaatgttgtacgcgagaaagtatttgtggtaaaattttgcagtgctgctaatttggtgttcattgtgtcacccttagattggttcgcaccatgctattgatcataatgtttctgaggtctcagtttttgctaacacattgatgactgatttggtatgtttgttgtgatatttgatcctagggataaaaactacagggtataatatttggaagttttagttgatattttagcactttgaactggtggtatttactgtttgtgcacatactgcattgtataatctgtttcatagcatttgttgtaggatttggtagtccccatactgtgtatcacagccatcttcttctaggatttagtcatcttagaattgttttgtgtccatctgatcatacataatctttggggtggctgaaatgctaagggggatcttgattttttttccttattctatactttcatgttctattcaaaattcattacctcgtgatcattgagctccgaaaatgagaataaatcgatgcaatttgctatataaagttacctaacatgcatatattcatttggataggctggaaggttggagaatgtggttggctggtatcactcacaccctggttatggatgctggttatcaggcattgagtgtcnactcagatgcttaatcagcaatttcaagagccattcttggctgttgtgatagaccctacaaggactgtttctgctggtaaagtggaaattggagcttttaggacatatccaaaagattacaagccaccagatgaacctgtgtcagagtatcagacgataccactcaacaagatagaagattttggtgtccactgcaaacaggtaactaacttatacgtctatttttttcctcccttgcccaacaaatgatctaattctgttctaattgtgttttgtgcagtactatgctctggatataacttatttcaaatcatccctggattctcatctccttgatctactttggaataagtactgggtcaatacgttatcttcatcacctctcctgggcaacagggattatgttgctggccagatatttgatttaggtaagaaatttcttttatgaatatttacccaaaaagaagtacacatctatttttgttttaccatgagaccagataaagttataaaccaatttgtgctatgcagctgataaactagagcaagctgagggtcaactggcacacagtcgatatggcatgcttatgccatcgcaacgaaagaaagaggtcatattctttaccatctgctgttcttcgtcactttcaataatttgtggtggtattgtatgcttgcaacttgcaacctatgagataaatgccaactatatttgaaaaattccatctgctgttctttgtcactttcaataatttgtggtggtattgtatgcttgcaacttgcaacctatgagataaatgccaactagatttgaaaaattgaacataaagacatttagttatgtaaatattgaattagtgacatcatgcatgggtcagtttgttatgtgctagggctttctctcatgagaaatttgggaggaagctatagctgtcatacttccattaggaccattacttctgttatatttggagtactgcaattgtgttgctctgtacttgtgttgataggagatttcaagctgagtacgcagattgatgatagtaaagtaaaatacaagatattaatatgaaagccatctgagtgagactgggaaagtatgatccagattatgttctgttcagagttgcaacttgcaacaaatgggttaaatctatattcgggataatagactaggattgaactagtcaaacagttctctttcttgcaaatatataaatcaatttgttctttgttattgtatatatttgtattatgtgtcgggctgcaggaatta

SEQ ID NO: 56560 - DNA, 798 bp, Oryza sativa
cgttttcgctttgggagttttcacttcctttccgtcgaccacttcttcaagctcctcttctctgacttgatccaaatcagtcagggggaaactcaatctgatttttatcattatttatcgtactgatttttaatcccagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccgccattgctgataacaacaacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgctgctgctgttgggcgtctacgctttcaccgccggcctgcctccgtcgccgccgagtggtgcctccgcctacacggccggcctattatgccgccgctgttgggcgtctacgacttcaccgccggcttgcctccgtcgccgccgagtggtgcctccgcctacacggctggcctattatgccgccgctgttgggcgtctacgacttcaccaccggcctgcctccgtcgccgccgactggtgtccccgcct

SEQ ID NO: 56561 - DNA, 1389 bp, Oryza sativa
tgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacaactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggctgcctttgggccgattcctagcacccgggggctcgttggatggaccgagtaacgcaaggtgctaagtattattcggaataaatcaaaagcatagagataagataaattcattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttacctcttacgctccaggaatggatcagtcagaacatcaccaccggctcgcctcgaccgccgctgactggtgtttccgcctgcacggctggcctattatgccgccgttgttgggcgtctacgtcttcaccgaccggcttgccttcgccgccgccgactggtgtttccgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgcttccgcctgcacagctcgcctttatgccgccgttgttgggcgtctacgtcttcaccgaccggcttgccttcgccgccgccgactggtggttccgcctgcacggctggcctttatgccgccgttgttgggcgtctacgtcttcaccgaccg

SEQ ID NO: 56562 - DNA, 984 bp, Oryza sativa
tataaaccagatgtagaggcgagggcactagtcagcagcagacgagatgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcgaggacatcggtcggcggcgacaaaggcaagccggtcggtgaagacgtagacgcccaacaacggcggcataaaggccagccgtgcaggcgaggacatcggtcggcggcgacgaaggcaagccggtcggtgaagacgtagacgtccaacaacggcggcataaaggccagccgtgcaggcgaggacatcggtcggcggcgacgaaggcaagccggtcggtgaagacgtaggcgcccaacaacggcggcataataggccagccgtgcaggcggaagcaccagtcggcggcggacgaggcggccggtcggtgaagacgtagacgcccaacaacggcggcataaaggccagccgtgcaggcggaagcaccagtcggcggcggacgaggcggccggtcggtgaagacgtagacgcccaacaacggcggcataaaggccagccgtgcaggcgaggacaccagtcggcggcgacgaaggcaagccggtcggtgaagacgtaggcgcccaacaacggcggcataataggccagccgtgcaggcgaggataccagtcggcggcgacgaagg

SEQ ID NO: 56563 - DNA, 1391 bp, Oryza sativa
ttcctgcagccctttggagaattaagtagatcagcatatcttagaagtgcagtccgtaaggtgcaaggagaagggaaaggtggggccaaagaaccaccccctttacgaggtgatccatcttctgcgtctgcatggacggagaaaaatgtatctggggaaagatctagcagcttttcagcctgtccactgtctcgatagcattttctgaataaacaccaacatggtcaccagtttcatacctgatacaaagttcttagaaatataagttgttatcaataaaatacaaattgaaggatcatcgttgagtcatttgacttcacacataaatgtcaaaactacacgagaagacataaaaaatgtcagttttaggataccaaagaacttacacaagaccagtgcctgagatatcgaactccagatgaatgcaagagcgatctgaagctggcttatggagttcctttcgaacagcaacattagacctgggcaataatcaaatgatgaactagaatgcatatactgtattctaactgaacagaaggaaggtgtagctaaatcattttcttgacatatgaatacctgacaggatggtgaatatcaataacaccactgccattggcaagtgaccacgatttgtcttggaacgatacatctgatttatcaataaatacaattctgtattcaggtatagcagcagtgtaaggagtggatgcaccagttgtatcatcttcatcacggagcagttggtccaattctggccaaacttgttctttcctacaagtattagaattgccaaaatgcttttagataaaataccagtatacttaaaagtaataacataatctagacatcactttgtcaataaaattcaggcaaggagcaataaattgttttaacagaacatttgccaaggaataatcatttttggtggggtttcaacctatagaccagaatccaagttgatattgttagtatcaatttaatttagtcgcaaaaacaggatagatttaagaacaataaaggggagtattaaagaatctaactacaacaaatctaacttgctttagtaaaatatatttctgttgtaaaggaaggctcaatatatccaaaactatgcaggtacatgtggaagcctaagctctgccccataaatagttcaaaaaatataccatgcacacttatttgtatcaatgtttctgtgtactgaagaaaaaaaaatggtgcatgtggtatatttgttgaactagatatggggtatatcttctacatccattttccagaaagcggaaacattccacattcaccaaaaagacaagttgttgtttcacatatgacaaaagaggtttttattcagtatccaaatccaggaccaatcaaagagaaaacttggagtt

SEQ ID NO: 56564 - DNA, 712 bp, Oryza sativa
atatagcaatgcacgcgccctattttcccaacttttctccaaatgaagtgtagagcaaagagtacttaccctgctcctctagcagttcgtccaccacctttgcaacctatattttcaatataaataacccagcatcagttaccagaacactagtcaacctttaccaatttatactagcatttcatagtcaataaatttaacctattaaagtgctcatactgcctatttcccaggccaaaaacagcatacttaagatccttaagccagacttccttttccttcccctgcttcaatgccaaaaattaataaggagatcataaaataatgtagttagaatatgtcaacgaaatggagtcaaaatgactttacacacctcagtgaaccatttgtagaatcttgcagcattgtcggtaggctccccatccccatatctacactcgatgaaacataattagctacagaagtcattgacacgtagcaagtgaatatagccacaagagatacagtatgtgcaactcatgtaaaggcaaagattgattgttgttcataaattctagaatgaaaggaaattcacccccaagctagttaagttctttcaagatgccattcaatggcattagttcataacaatccggacaagaataattgagctagctcccccacaaaaagcccacgtgttcaactctcacccacaaaaaacccacttgttcaa

SEQ ID NO: 56565 - DNA, 732 bp, Oryza sativa
tccaaaaattttaccaatttctagaaactttttattattgttctctaactttgtcacatgtttattatccaactgctaatataattttgcacaaccttcttgaaattgttactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcctctgctacaagtggagacgcctcttagcatgttgtggccgcaaagttgtccggttatttggacagcgactgccatccaccacgaagcacaagatttcaacgtcctcgggtggtggaatgaccacaagataacatatcctgtgctttcaaaactagcacgggatgtgttgacggtgcccgtgtcgacggtgtcctcagaatcggccttcagtctatgcggccgaatcatcgaagaccggaggacgact

SEQ ID NO: 56566 - DNA, 1288 bp, Oryza sativa
acttaggcatttttgctttggcaatttatgctcgcaatggtgtggcccaatgctgataaaatcctttttaatgcggttatataattctttggaattattgcaatgcaaattgaaaggtacccgacagaaaagtgttatactatttttgtaagcttttttaggctgcaaaagctgtctgggttgatttaagatgacttgtttttacaatggtcattctcttggcgtgttatatgcctattttaattatggtgagagtcatagcctaggctattagacttattaattaccataatttttataacatttgatggattatctttagagttttttactcggatgtttgttaaatgtgttcatttgtgaaccttttagagtgttattcactcggatttttttactatggctggaaagcagtcggctgaatgtcttgttggacgccgcatatgcttttgtcatatgatgcatgattatgcaattattttattcttgactacatgtttagtttgttaactaatcatatagtcgggggctactgtggagattatggataccccatatctacacggcggttatatttagactgaatataggataccgaatatagatagaatatctttatttgtatctcgggtttgtttcttaacttgtacgtcaaggaaatatcctgagatttagtcggttacgattgtattttatttgtattctcgtattctgataaggatatgagttataccttgtaatacggactccttcccctatataaggaggggtccgagtccttcctgggacaccaattctctttgagatcatacattcaataatacactcggcggtttccaccccggacaggagtagggtattacttcttgaataagaaggcctgaacctatataaatcgtttgtctccaaacccatccacttttcaagcttgatagccacccctttttagtattgccgaaatcttgtttcgacagtaacaaactcttggtctatctgcaattaattgagcaaattccactgtcatggccaatgaatttgggctattttgaagagacaatgcaattaaattccctctctgctgctgtcagacataagaaactctccaactgggtaaggtcaacctgctgctgctattttgtttagttattttttccatcgacattccagttgagaacactgcatctctgcgctcatctccatgttctcctcaactaatcagatgttgcatgatcaccatattgcatgtatatgcatgcatgatcagttgttcacaaattataattaacca

SEQ ID NO: 56567 - DNA, 917 bp, Oryza sativa
aatgcattctccacataccatctccacatcccagagttttgaaccggcattagttcccaataaaaaccatatgttgcccgacttactacaacatagattgtaatgtcactagtctgtggatcaactcccaagccccgcatcaaccatttttttatagaaggtacactcctctcggctggcctatcaattccccttgctgttacaataaattctgacagatctaccccagttggcccataacggacgtttccttgaccatggtatagttgaaatataagtttactggacatatctgcaaagttaattactaggccgttattttacataataaacgactacagtgtaatatcttctttgcaacgtacctaaatttttatatattctattgcaatgttactcaacaacatttaaaactacaaacctaataactacaaatactacagatctactaagttacctacatggctacatctaacaatatatatttatatagtaccacaggtaaaactctatttcatacaatgcatttatcatatatttagtcacgtatataatctacgaatattacctgaaatcgaagtttgaaactggcagggcttcgcctcttcttttcttctcctccccttctcctttttttttttttttgatgtggagaggttaggagggaatgggctcctcaaaggagccggctgggctttataggcggccaggcctgccgccttctgtaagggcggcaagggggtcctgccgccctttgccagggcggcaagagggcaggagggggcaggaggacggccgtcccgcgccgtccagcgcgccgtgtgccacgtcggcttgccgcccttgcgaagggcggcagggtctagttttgcaaattttttcggcgctataatatttctgtaaatattaaaaaaaaa

SEQ ID NO: 56568 - DNA, 1273 bp, Oryza sativa
gtccacgtgttcgaacttgctgttaatcactgaacagcagagcagcttaagtagcaagaaggaatctttgtaaccctttgtcatcttatctcttgggcaagaataagatggcaaattagattgttgtctactgcctgtcagtggaatcacaatggaagatatcaagataagtacatgattaagaacaattagagatttagaggatctgagaggcatcaatcaaatcttattatgaaaatttagccactattatcttcctgaatatgacatgacaaagagagacggtggatcaaatcaaaacggatataagaaaatcgagtttttttagtagggtatgttttatccggcctctacatgcaaccagatatatatagcctttttaaattagaaacttagcttctcaaataacacaatctgaaatcgagttaggaagttgatgctttatgggcatgattagttactagtttattttatactacagttcctgcaacagggtgcgatcatttaaaaaagaaggtggccaatccaataaatagattgtactagaaatattagtgaataaattacatttcaatgtagttagaggcctagaggacgatcatgtctgcaaaatttaagtaaacatattccaacagaaattttgcaagaaaagtatttttcataacactataatggtatggaacatacttttcaagacaattcttctcatatggttttcacacgttaaatctgaatatttaaactaaattggcgaagagaagttgttcttccttcatacacccaattaagttataagattgactgtgatagtgtgatatctatccccattggtgtctacagtacatatagcttatgattatttttttagaaaaaaaggagtgaagtaaatgaaaaaattgctttccaaataacagacacaaacggtgcaagatttatatataatgttgacaaagcagtggcacaccggacagcctgacgtaattgtgatccaaatcactgttctaacacaggatgagctaatccgatccacttcaagttcataaatgacacaagattgcttcatttggggataaactaaataatccaaatatataatttataattgcaatgctattgcttgcagttccctttccttttcgtatcactttcttcctacaagaagcgaactcttgtggcttcatttgttcctgacgcatcttcactttgtacaagttgaccaaaagaaatagacaacataagaagatcttttaccattgaatggtggataatttaa

SEQ ID NO: 56569 - DNA, 907 bp, Oryza sativa
aatatatatcttacctgctgctcaatgttcttggaacgcaaagatcgtgaaatcagaggctggagcaacgggaggtacagaggctccagcaattcagagacctcactgccagttctacttgcaagcagtgataagcatgcctgcacattcttcctcacaacaattgaggtatttgggttaaacagttccactgcaagaaactccacaactccctgaaaactttgtcggcgatgttcactgtttgcttcatctgcattgtttactacccgtagaacttgtgttaggacatggtttgtctcctcctgctctttgtttgcatgcatcgggagcctcttaagaacatggataagcccgcgtacaactctaacctggaaaatgcatagggtatccacagacactttaccaaccagcgctccaaggcccattacaccacccatctgagcttgccatgtgctaccataacaacaatgcaacaggcgtggcaataattcctcaaatactgcaacccgcacacttggaggaggagaataaactggattcaaagatggactagaaactaacatgggggtactaggaccacctcttagcataccagtatgcttcatgcgagcaagaaagagtagtgtctcagcaaaagtatttaaagcagacagagcagcttttgcatgttgacgattttcacttgagagtacttcaaccaatgaatccataaatattaaaggatccaactcacggagattagatgaagagttgttccttgatctagatccaatgctagatgaaagggacgaaccaacaggttgtacatatccagactgactggaggatgaagaatcgatatggaaaagcatagcaaaatgtcgacataaatcaacaacgaagtcatccttctcgtctgtaaggctgg

SEQ ID NO: 56570 - DNA, 742 bp, Oryza sativa
attcctgcagccccgcaccactatccatggctcaacttctccctcgcccaccactgttagtactcattctacttcgttgtctgttcatcgatcacatgtgtgtgtgttcttggtcattttttggagtaagtgccgtgcttatgcgttggtatgtgtgtgtgtttgtgcaggtgaaatggaggaggaggagaggggcgcggcggccgagctggccgcgatagccggggcggctccgccgccgaaactggaggacttcctcggcggcggctgcaacgggggatcaagcggtggcgcttgcccgccggtccagacgacggcgccgacggccgccgagctgtacgagtcggagctcaagtttctcgccgccggcttccagctgagcggcgcggctggggcggcgccgccggtgcccgcgctgttgccggcggctgctctagagcagaccgacgagacgaagcagctggccttgccgccgcaggccgcggtggcgccgccgccggagcagaagaaggcggtggactcgttcgggcagagaacgtctatctaccgcggcgtcacacggtaagctatagctaagctaagctgagatcgatcagtctatgcatgtgtcggccataaaatctaaaaataaattcttagctagctcgtctaatttcttgcacgcaaactaatcatctcgtgttcgtgtgcatccttcatatatagattcacatgcatcatcgatcgtattaataggatttag

SEQ ID NO: 56571 - DNA, 866 bp, Oryza sativa
tatatacaggggtgttacaaggttcatatatatattggtcttgactaatctttcacttgtagcctagctagccatgtttggcctcttgcacgtaagtctcaggtaactgatgttttgtgtgatgcaaccatgtagacatcaccagcatgggcgatggcaagcaaggatcggaagagtggctggcaacaaggatctctacctcggaacattcggtaattaagtttgtacattaatttccatgttgaatctgtcgtccatgttcattttttttgtttagcagaaatttgttaagcctttttttgttgccctcttcttcaacaaatgtatgacctgataagaaaaaatgatatcaataacccaacaaaacctctcaacatttgactaattatatctgggtgatgtttgcagaaaacacgcatgtaggcaatactttcatgcatgtaggcaatactactttcatactaatgttttctaatactagtggatctactgacaatgcaatgtcagtgtgctcatcatgtagaagaatgctcaagagttttctcgacgctaagctatacataatctttgtcattagaactttcttttatcaaagatgaaattgcaagtaggagggtgcatgcacgtgttgggcccctcattagctagcattagtcattttcttacactcaacattacaatattaagcccttgcacgtaggttccatcttaatttatgctttgcacacacagggcttgtagctagattcgtcgacatattttatgcaggtcaaaaacatctacttctgaccaagatgtaagcatgcccacatttgattcgaaatttgtcatcttttgcgcgccatgcatgatggggctgcaggaat

SEQ ID NO: 56572 - DNA, 731 bp, Oryza sativa
caaaattagccctgggctaatcttccaaacagggccctagtacgccggatcgccgactaacgaacaggttgccgtcccttgtttaaataaacaaacaaatatttcttccccgttttaaaatataagaaaccgaatgtgatttactataataaacaggttgccgttccttgtttaaataaataaactgtgatattttttaatattataaatctaaaccgatcagacctaagatcggatgggatattttctagtagtataccgattcttaatagtaggaaatggcttatccgttttcggtttagtccctccttcccagtaccaaatgcggcctctgctgtgcatcggtgcatgtgccttatcgagttcttcggaaacttctgtgtgttgcgagttactacttgtttcaaaatagcactattttagaaagagaaagtaaagtctaacacattcacggctaagccggcaaaattctcaattcatgttaaggacctctcaatgattgagataatttgaagaggcatttcatttggcttctacctcttatatgattcaggcagcaatccccgaaaagtaatatgattcaggcagcacacaacgatttagacaatacgcattccaaatcatatttatatattttcacgatgtaatcatgcattacaaataatcgtgcgaataaacaaataagagcaaatagttagagaagctgacagcctgcctaaccactatagtaa

SEQ ID NO: 56573 - DNA, 5069 bp, Oryza sativa
  unsure (1)..(5069): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaagcgggagctttaagaaaacactcagtgagcaacagctttttgagccttgtttgggaggatactgtccgggaggataagctctggtgggatctcacggaccacgccgagcatcgaatcgtactcctcgtctttgtgcgcaaacttcttcctcagcatcttctcgagctcaatctcatcgaaggtcttggcattctcggctgcgtggacttgagccaaattgatatagtttgttgctgactgtgcaatgaacgccatctcctcttcagtaagctttcttaggaacttggcaggattaccaacccagacctagcaatgtcaggaaacgatatggtttaataaagccatgcaatgtattaacttaaccataaaatataaatacaaagcatatttaaatcttgcagctgttcacaacaagtgtggaacataaaacatggacatcagtataaacatgcagcggcagctttgtttagtaatcctccagtccccgattacagttttataaataaggaaattcatgcaaaatatgtgtcaacacatcataactgtaaattaagggaaaaatgcagactaaacctctacctcagaatcattcaattgcattattcgaaaacaattaggtatttttctgaacaaagagcagccaattttgtaatcatataccagcatctctgagaattacctcattacaaaatgttggcagttgattgcacatttctcatatagcaagtgaaaaaaaaaaacttgcttagcaagaaaataggaaggtaacctctccagaaggaatcctggtgttttgctttacaagggatcctgcaccaaccatgctgtgcttttcaaccaccactccatcaagcagagtggcacccataccaacaaaagcttcatcctcgacgatgcatgcgtgtagaacagcactgtgacctggcagaagctttattgtttaggtaggtgcatagcacagtgtcacagtgaatagtccatgcgaaatgaagctcagaattttaactcgtaaatcaatcacaaagcagcaatggaaaccatatttttacgattttatcaggtataaatgatgccatgtggttaatgtcttccagaaaagccaaatcacaacttcaatagcatatcagagtgtatattacgaattaagataggaagtgctctactgacctattgtaacactgtttccaattatggttgggagaaccttcccactgatattagcttttgaaacatgtacaagggaattgtcttgtatatttgttccaactccaatatgaatgctgttgacatcacctgaggacaaaagaatgaaaaggagctaaaatggttatcaccgcaccgtggaagtatccaaagtacaacttcaacactatagttactgaaactttaaatatcaatatgctagggttaacccagtatgtatgacagcacaaatgcctcacaccatgataaaagatcatatggtgtaggaggaacgttatcatgtgaatgaagctgcttgaatcctttttctacttggatttggttgtaaaggagaccatacaggcattggtcaaaaccattctcacctaattgttttcttaagagctactagtatgttactccctccgtttcatattataagactttctagcattgcccatattcatatagatgttaatgaatctagacacacatatatgtttagattcattaatgaatatatgaatgtggacaatactagaaagtcttataatatgaaacggaggaagtagtacttaatgctttatggttgggagaaccttcccacatcatcgttgagagcccaacacatcatcgttgcaggttaaaactcgaacttcatgtgaagtgtcagttgagagcccaacaatgaaaagatgagtgtactagagctgtttgataaaactgtgcatctccgtacgactggtggttctgtcagttgtctatgtagtaccattcatcataacaatgagtgtactgcagtcagaagcaagtttattccaaaaacaaaaatgtacagtaaacaaggtgtaacaaagaaagaaatgggaaacaaattatcaagacaaagcccatgcttactcacatgtgtaataatactacagtgtatatcgaccaagagtttacctcttaaaatggagccataccagattgaggatccatgtccaatctcaatatcaccaatcacagctgcactgggagcaacaaaaacatccttgtggattctgggctctttctcaaatatgttcatgattgtgcgatgccttggcactgacaagggcatacaaaacggtaacatgatagtcaggctcaaccataaagtttatgtaccttgctaaattcattagctcgtggttattctaaaatgacctatctagacataataccaaaacctttttgatacaatgtccaatttatgctaattcaaggccctctacaagatgcagcatggtggaaatcaatcaacaccaactacagcaccacacctaactagaaggtggaacaaatgacattcttcatgatgctacgcaacagaaaatagatgcataaccactcgaaaattggcatgccaaattgccaatgtgacactcccacaatgggcagtatgaccgcaataaccaatatgcgcaatccttgatttacttgctgcagttttcacacacgagatcgatcactagttgaaaacctggaatgcagaacttcacaaataaccgacgataatttaggctcatttcgagactcctcgaatccagtcaccccctatccattcctaccaatttcttcccaataacaactgccaaattgtcagagagagagacggcggctgctgctgcttacgctgctcgtcgacgcggaggccgccctggatggtggatccgaggcggtccatggcctgccccgtgccgcggatccacttccccgccgtgtagatcgcccgccccagggtccccatgcctcgtcctccccgcttgctccctccgctgtccggacctcgccgccggccgccgcccgccgccgaggtgagaggtaactgtgtgagagagagagagagggagaggaggtcaaacagcttttggcccaggttttttatgggcctggatccggcccgatcatcacagaggcctcgcggcctattgagatttgggcccaggtttttatgggcccagcctgttgcgcgaattctagagtgatcacggccgtccaaaattcgattgaatttttttctttatgtttcaaacgattaaacagtactccatccgtcctaaaatataagtatttttagcatagtatcaagtcaaatatttgtaactttgactattaatagcaaaagaataaaaaggatcaatcatgtaaaattgatgttactaaatttatcattaatgtaactctttttatttaaaacatattacttttatagatattattggtcaaaatagcatctcatagactatgtcaaagtctaaaaatacttatattttaggacggaaggattagtaataggctcccttgttgggaacttcggatacgggcttaaaatttgaagtgaaatattggcttacccacatgattggctaagagttccaaatcgctcaaacttaacgtgactgattatgttgcagtcatctacggactgcagggaactggagtcttggatcctgcttgctttgcatcaacaaaaacaaaaatctaaagcttttacaacgtgcacgcattctgcagctgccgtctgccgatcatccgcaccaggactacagagagtgtgcaaccgaacaaaaataattgaccctgtttggatggtgttacatcggatggatgtttgtacaaagtattaaacgtaagctattgacaaaacttattctatcctagttaattcgcgagacaaatttattgatccaaattaattcatgattagcctatgtgatgttacaataaatatgtgttaattatgaattaattaggcttaaaaaattgtcgcgcgaattaacactcatttatataattagttttattaagtagtgtatgtttcatactacatcagtcccaaaatacttgtcgctttgatttttttcttgcaacctttgaccattcgtcttatttaaaaattagtgtaaatataaaaacgaataagtcacacttaaagtatttttataataaagcaagttacaaacaaaataaacaataactctataatttttgaataagacgaatgatcaaaagttatgtaaaaaacacaaaacgacaagtatttttggacggaggtagtatctaaacatcctatgtgacctaggagtatgtgactgggacggacaacagtgtacaacctttcgttgaacaacagagacgtacacgtacgcaatgttgcacgggtcacagatataaaatgcacacgctacaacgcagcggatgtactcattgcgttggtgcactgcacgcatgcagcgagagatgcccgccgacgctgacatgacgcgccgccgccgctcgccgtcgctaccgtgcgcggtgcgcgtgcaggcggccggcttcgcgctcgggcaccgccgggacggcagcgtccggcgcctcgtcttctccctcttggacatccacgtcagggccaagcgccgcgccggcgtccgctccgtcgacgtcaccatcgacgcctcacgcggcctctgggcgcgcgtcttctccccgccgccgacgaagggagagg

SEQ ID NO: 56574 - DNA, 2742 bp, Oryza sativa
gggggcaacatggtgcaccacgtggcccagcgctgggcggcggcgtccgccgcctcaccgtcgtcgtcgacgacgctccggctcgccggcgccgtgctgatccagccattcttcggcggcgaggagcggacggaggaggagctggagctcgacaaggcggcgctcacgctgtcgctagcgaggacggactactactggcgggagttcctgccggagggcgccacacgggaccacccggcggcgcacgtgtgcggcggcggcgagcacgacgtcgaggtggcggaggcgttcccggcggcgatggtggcgatcggagggttcgacctgctcaaggggtggcaggcgaggtacgtggaggcgctgcgcgggaaggggaaggcggtgcgggtggtggagtacccgggcgccatccatggcttctgcttgttcccggagctcgccgactccggcgagttcgtggaggagatgaagctgttcgtccaggagcatagaaccaagcgtgtgcagtagatggcttgttggcccaacgctgtaattgatccagtgattatgatgattccagcagaatttacgagattatttttcgattacacgacaggctcatatgtatgcacatgtactcccccgtcccaaaaaaaaaacaatctaattagagatgggatattacctagtccagcgtatctaaacaaacatatgtccggatacgctggactaggtaatgtcccaccttcataggttgggttttttttttaacgggaggagtatatgacaacacacataacaacacaatcatacgccaccaatactgtgagaggcactacacgagaaataaattttattattcattcctaaggaatactcgatgggatgagaaataaataacaaccttgaagatgagtaaatatcatagagcaagttttatgtcatttaagagatatgcgagaaatgaagacatcacatgggagacaaaaatccatctgcggttatttgctgccttttgttatcataatggttgccacctgctattcgttgcctttcgtcgatatacgattatattactatagtgaagtgtgtgtcgatgggttatacctcaatcacatgattcgttcatatacaaattgtttggaggacgtaggaattgattgttaggaggatacaaacaaatctgtaaatggagcaaggggaaagggatttttatataggtagacccttgatgacgagtaatagcattatttctgttgaccggagctggtgttgccatcgtatatcaatctatcacaagtacaaagtagagaataacctaatctagtgtaccagcgtatcaatgtaaagctcgagtatggttagtcgttggttagctatttttggcttcctcgagaatccattcggcgagattggaggttgctctatattttttttattaggcttgtccttcacttctgggatcttgtacttatatttttaggtgtttcctttttaagtagaactaagaagataaacatagatacgatcgtcggttttgagggctctgtatttattttatgtgactcatttcttatctatttaggacttccgctatatgcacgagagttgtttccgtacaaatggtatatgatggtcttgcaaagctaaatacatgtgtatagggtactacatatttagagcactcacggtctaaatttaaagtacttttggttttggcatatatatttatctattcattttatttaaaaattatgtaaatatgcgaatataataaatcatacttaaaacaacttcaataaacaatacaagtcataacaaaataaataattttgtaactttttttttaaaaaaatatcaaacatacattcaatgtcactggcgtcctagagtctcaaaggtcactctaatctcaaatattcttttcagcataaaatatatagtaaactgagaccgaacaggatgtatctttttacaatgaatacgaatgtgaataaaaaaatctatccagattcatgaaatcattatgtatctcatctaatttcaggttgctatattttgagatctcctctacgtcttcgtctcaatctccttgcaagcgactactaccagaatggaaagactctacgtagtccaggacactgcgtgtgatacacttcttgtctatcaggtgggtaactgggcacgcatggcagatagttgctgcctaggactcgccaagaacgtgccacacaggagttcagagaaattcatctggagaaaatggcaaaacggtaaaaacaaaaacgaatacgaaactcacaactcacaaggaaaaagtctagggcctgttttgggggagcttgttccagctgcagtttttcctaaaaactgattctgctagaagttgcctcaaacagtccacaacttctgagaatctgtagttacaaattctgaaaaatgaactaaaaaatcagaagctggagaagctgggtttcagagcttttctagattatcaaaaactagctaccaaacagctgcttcttataatttaaagatcccaaacaggccctaggagtagtatctctctcatgattcattacttgatacatacagaaatcatacaaccccactagctagtttatttaagtctattgcatactactctgtcgaaaaaaaatcctacctacgaacctaaagcatgtatccatgtttataggtaggattgattatttttttttttgacggaggggtatgtatctgtaaatatttaaaattttc

SEQ ID NO: 56575 - DNA, 3970 bp, Oryza sativa
cgccctccggcaggaactcccgccagaagtagtccgtcctcgccagcgacagcgagaggctcgccttgtcgagccccacctcctcctccgtccgctcctcgccgccgaagaagggcgatatcagcacggcgccggcgagccggagcgacgacgacggcgaggtggtggacgccgcccagcgctgggccacgtggtgcacgatgttcccgcccgcgctgtcgccggcgaggaagcagcgggagaggtcgacggcggcgccgagctcggcggcggcctccgcgaggccgttggcgtcgaggtagcggagcgcggcgaggccgtcgtcgtaggcggcggggaagcggtgctcgggggcgaggcggtagttcacggacaccaccacggctccgaccccgcgggagatgcggcggcagagcgcgtcgtaggggcgcgacgccgcggagaagagcacgaagccgccgccgtggaagtagacgacgaccgggagcttcaccgccgccgtgttcgtgggcgggcagaacacgcgcgcccagaggccgcgggaggcgtcgatggtgacgtcgacggagcggacgccggccgcgtcgggacgggggctggccgcggcgtggaggtcgccgaggtagaagaggaggcgccgcacgctgccgtcggaccggtgcgcggccgagagcgcagcaagctgcacgcgcaccgtccacggaagcggcggcggcgacgacgacgaccggcggctgcggtcaacgccggccatctcttgctgcaccaagtgtggaggagagttttttttttctttttgagtgaattgcaggagtgatgtggtgctttgatcttcgatgtgaccaatgcgacaaatctgtcgcgccattaattaatgtttaaggacaagttgttcgcaagttgcacacggcacagtggctgtggagttatattttatttcaatttgtttgtttagttttactactagtataaattattgtttgataaagctcaaactgtaataagagtgccaaagtactgaaagagaagtgcagatgactcaagagttgcaaatttctgccatatgtaaaagcttctgttctttattgtgtagatatattttgacccttgaatatttgaacattggtaatggtaatatgatgtaatcctagttggccaaaatcatgtccaattagctcaaattctctgtccatatcccgcaaattctcaaatttccttcgtctcttcggttgcttcccgttcatcttctccatcatcgtcgtcatcgcatccacagtcgctgtccatagccttcctcttcgtcttctccacgaccggcgtgtgcacagccgcaggtgcaagggttgtcgccgttgtcgtcgatctcgcactcgacgtagccatgggcagcgagctccgccttgacccactcctgctgctccttccagtactcgttcaggtgccgtatatatggcctccgcaccgtcggcgtccaagctgcaggagcgcctcctcctccgcctcgctcgccgccagatcttcgctctgtaacacggtcgcggggcggacatcgtgacaggatgtgcggtcgatctgctcctgcagcatcctccacttcctcagcttcttcattatcttcttcatcccttcggcttgcgacgaccaactccagttcatcgccggcagaatctggatttgttgggatttttctgatggattcatggatcgctacgggaccacgccataaatgggccagaatgcccgtgttctactcggcctcgggctcctagtttcctttgtgaattctccgccgcgcccatgtgtgccggcccaggctcccaccaaatacttctctgtgacttgtgaggaggaaaaagtacaccggagatacctactcttgtcgccgatttacaaaatcatcccttaaccaaaaaaccaaatacaatgtatcctccaacttttaaaaccagtgcaaacaaaatccttcgatggtattgtccccagtttcagctaacaaggcaccaatgtggctccttcgactagatcttcatctcacatggcgcttatgtgacggtttcatcaagaaacaaattataaaataataaaaatgggtgggccaattgatcagatccccttattccttttctctcttcttcctctcttttcttgcgtcagacaggaaggaaggacatgaggacgatggcgaggtatgcaccttgcccttccccatttctctcccaagcttctccactcctccgcggatgaccccgcccatctcctctgcgccatccagctcctattcaccgccggtgccctcctccatggtatggtcaccgtggttgcctcctctcccacctcacctcgccagcctccttcgctcccgacgcttccctctacccagcgccgccatgtcgctcgtcgtcggccgtcggacctcctcctctccgcaccggacagccagcccacccaaatgacgacaagaaaaacgagaaagggtagaaagggagagaagaggataagagagagggtaatgccgtggtcaccttgatatgtggggttcacgtgggttccatggtgactcagtcgtcatgtcggacaaaaccaggatcaatgttgtctaaggacctggaatgatctagttttgtaagttgagggatcttatacatctggtttttttagttgagtgacgattttgtaattcggtgacaagatgagggacctcggacgtactttttccgtacgaggacaccttgtctccatatggcccatcaaaagcccatcaccgtcgttctcttccttcttcccaccaacgcatcctccctattcttccccaacgttcaagttcaaagttcaaacaagcagccatggctaccaagaaacctccaatcatgctgtttaactattaaaactggtagacagcaggctagtattaatcacacataatcatattaaaaaatataatgcagaaattatcagtgatcgaggttccagccgtctaatttcccgaacagattttcttctcttcagtttcgtcctcataacaatcatcgtctccttcttgttcttcttcttcttcttcctcctcatggtcggcagcataggcgcagccgcaggtgcaggggttgtcgtcgtcgtcgatctcgcactagacgtagccatgggcggcgagctcggccttgacccactcctgctgctccttgtggtaccggtccatctcccgcttggccaccgcgtcgtcggcgtccacccgccgcagcctctccttgagcgcgtcgctgatctgcaggcggccgatgtccacgtcgtagcgcggcggccgggctggctccggcgaccacgacaggatgaggtcgatctgctcctgtggcatcctccacttcctcagcttcttctcctccttcttctcttcgccgacgttgttgacctcgtcgacggccctctccgtcgtcgcggcggtggttcgatcgatgctggattaatcttggattgcttggggattttttttttctgccataaataggggcagaaaggtctccatgttcttcttggtttcctttgcgaattcggatggaataagttcacttcatgaccctcaaaagtgatcgaaatctaatccatgacctcaaattacaaaaccggatatcttgacccccaaactcttaatacccgtgcaattttactcccagtgcggttttggagagcggtttcgctgacgtggcgcctacgtggcagcattgactcggtcttctttccacgtggtgttgacgtggcgctgaggtggcattagaaataaaaaaaatatgcgtgggacccatctgtcattcacacacaaaataaaagtggggcccactgacatgtgggccccacatgtcatcctctctctcactacccttcttcttcctcctctctccgttgtttctctctctccgttgacataagccgccggcaggagggggctcgagtgccggtggtggtgggtgggtgatggagt

SEQ ID NO: 56576 - DNA, 25596 bp, Oryza sativa
  unsure (1)..(25596): unsure at all n locations
gctctagtctccgaccttgtcggctgcggccatagccaccacccacgggacgcgtcgccgccactccgggtcagcacgcggcagcgctgtcgtgagcgcgagtgcgggaggaggcaccggcggcggcggtggcggcgacaacacgagctcggcggctccgcctctcccctctcccttccggcccttacacaccgccgcctcctctcatgtcacccatcacatccgtttcctccctcacctgctctcctctcctctcctctctccacttggcgaggccgccgccaccgcttcagcttcctccgccgctgccgccgctctggcgcccgcccgctgccgctccagcctcccatgctccccgcggccggccgaaggagagaggagaaaaagaaagaaagagagaagggaggaagaagaaagggagatagaggatcccacgcatatttttatttctaatgccacctaagcgccacatcaacgccacgtggaaaagaagaccgagtcaatactgccacgtaggcgccacgtcagcgaaaccgccctccaaaaccgcccagggagtcaaattgcaccggttttaagagtttaggggtcgagatatccggttttgtggtttagggtcatggattagatttcgatcacttttgagggtcatgaagtgaacttattccaattcggattcggcctctcgagcaaatgctattatgtgggccttgtgttgatatgggccggtatctcggcccattaagagcctgtaataaaagtacgaaatgttcttcaaaatgtactgctgtacttttgaatttagtttctctatatactcgtgtaagtcgatcgctctcgttttaatactgatttaattctcgtcccgtttcccctttttttttgcgacaaaaaaaagtctgaaatgtgccgatgtgcttgtgctccacgtgaacagaaccgtgtagtttattttatccttaagagtgtcacttttaaatgtgacaattaactctttgacattggacccacatatcatggaggggaggggccaccgcgcaccgctctcccccttgttgccgcgccgccaccggcctcctcctctccagccaaatcaaaaagagggaggtgaggggagagagtggggcagccgccgcccctggcctcctcccctccaaccagatttgggaaggaagggggagtggggcgctgccaccgacgctccatatgctgccttgctgccaccaacctcccctccttgactccaccagactgtcacccgcgaaagtcgccgccgccggatccaccacacgcttgactcgccgtcaccagatctgccacccgcttgattcgttgccgctggatccgtcggtgaagacggaggaggggggtgtgcaccagtgaggaaggaggaggggtgcacgccggtgggcatctgcagggaaggagaaggagaggggtagggaaggagtgcgtaccgatagggatggagagggagtaaagagttaggtgcggtggagagagctgatcttttaatatggcagtcctcttcaaccgccagtggaaatcgctaaagtgagccgccagcaaaaagatacactttcgttggccagcgaagatccatttttgctggcggtctatagccccattgtcgctggtagttttcacgtatggccgccggagaaaataataaggtgacgccataaaagatcgattttgtagtagcatacgctcctaaagtgttcgactttggcacacgtgaaaaaaatcattaaacatttgttttatacaaaacgccctctacttaattagaaaatatcattaaacaaaagagtgtgtttcattttggaccgtgtaatagacgactaaagttggaaatagaagttgtttaaacttacgaaataattgtatgataacacaatgattatattttctggcccaataagggtgcgattgtttcggctggggcggtggacggtttagtcgcacgcaaaacgagaaatgcgattagtatatgattaattaattattaatatataacttttttatgaataaatttgttggatttttttaacaacttctttatagaaagttttcgcacgaaatataccatttggcagtttgaaaagcgtgctaacagaaaacgaggagaatctaatcctataggctcaaaacgagagcctgtaagaaaaggatagaaccctacacgaaaagtgttcttcaaaatagcttttgaatttgattttttctatcgacgtgtaatgcgtcgcgtacgtctcaaaagtcagactgattttacttgtcgcaaaaagtaattcttatcatgtttcaaggctgtgtgtttagatctaaagtgaatccaaacttcagtccttttccatcacatcaatctgtcatacacacataactttttagtcacatcatctttaatttcaaccaaaatctaaactttgcaccgaaaacacagccttcctctctctctctctctttttctcttgtcgcgtcaaaaagaagtcagaaatgtgcagctgtgctcgtgctccgcgtgaacagaatcgtatggtaggttaatgtctccgtcagcatcatgggatccatgcgatgaaatcggaataaaaaatacgctgctagtaaaatcggttttattttattaggtatgtttaattcatttaaactacgttcagtgtttgggtgttacttttataataattggctgtagctctgatgagcaaaagccgagatgttttatttcattatctaaaaaaagtaaaatctgtttatttcacagagcaattcatcatcgcaaaacttgatcaaatttcagcaaaatatatatgaaatagcagtccaggttaacattttgaaatgccaaaggtaaataaaacgcttctaattaagcattcgatttgggcggcgcgttgcgctccatgaacgccttcatctccttgacgagctcgccggagtcggcgagctccgggaagacgtagaaggagtggatcgccgccgggtactccaccacctgcaccgccttcccattccgccgcagcatcccggcgtaccgccgctgccagtcctgcagcgtgtcgtaccctccgaccaccaccatcgccggcgggaactcctccgccagctcggcgttctcgccggtgacgtgcgccgccgggtggtcgcggtcggcgccctccggcaggaacgccctccagcaccagtccgcgcgcgccatgctcaccaccggccccacgccgtccagcctcagctccgcctccgtccgctcctcgccgccgaagaacggctgcagcaggacgacgccggcgaggcggacgcggcggctcgaggaggtggtggcggcggcccatcggtgcgcgacgtggtgggcgatgttgccgccggcgctgtcgccgacgaggaagcagcgggtgaggtcgacggggacggccgctactacgtcggcggggaggccgacggtggcgaggtggcggagcacgtccacgccgtcgtcgtaggcggcggggtagcggtgctcgggggcgaggcggtagttgacggagacgccgacggcgcggagctcgcggcagagccggcggcacaaggcgtcgtactggctgaaggcggcggtaaggagcgcgaagccgccgccgtggaagtagacgacgacggggagcggcggggattccacggcgctgctgctcgcgggggagaacacgcgcgcccacagcccgcgggacgcgtcgacggtgacatcgccggagcggacgccgtgggcgtccgggcgcgccgcggcggcgctctggcggtctgcgagggagaagaggaagcggttgacggtgccgtcgccgcgctgcacgatgtcgacggcggtgacgagggcgaagagctggagccgcaccgtccacggcaacgccggcggctcgggccgccggagctcgtcgccggccgtttcttgctccttctcgtgccccatttcgccggtttctgtgcgagtcatttcagtgtccagaggacactatatataggtgaaccgattaattttttttggaaataaagggggtgtttagtaaagtttcggcgtgtctcatcaggtattatatacggtgtgccataaatgttcggcactaataaaaatactaattacagaatccgccggtaaaccatgagatgaatttattaagcctatttaatctgttattagtaaatatttactgtagcacaacattgtcaaatcatggaacaattaggcttaaaagattcatctcacaaattagtcacaatctatacaattagttattttttagtctatatctaatacctcatgtaggtgtttaaacgttcggtgggatttggggtgggatccacacaggaccaaaattatcccttgatttttacgtgaatattccaatttgatagtagaaatttgaaataccgtgtaactactcgtactacctagaatttaagtccccagcgccgaatttagcctaaattggcattcatgagtcatgaccatatcgtcgaaccaatgaactctagctgcgttcaaatttgacaaattggcacttgatacctctcataatctcatgtacaggtattttaatgcaattccatacgaccatatatagctccgttgcttctgtttgttttgagtataattagtacgtcttcaatttaagttttatagttgaacacattggtactacgtacgtacaacccaatagcttcaatgcgatatgattttgatccaatctcattattgtgtactgctcaactgatgagcacatagccacacgtttgtagcgatttttctttgtttgattgaaggatataattaattaatccagtagccttttgcaatgatgtgtatctgattatctgatacgtacatttgtggttgtggttaacgtctcaagtctctcgcaacgaccatgcttacgttgatggcgatgcatggctgcctattggggactcttgaggaatatcttcttattgttattgtatatatactcacatagttataaaaaagtttaaaaggatgtattaacatgtaatatatcactttataaatatataatttaaaatttaacttgtacatctcgcaactaaaaacaaactaacaaactatagttggatctttttttgctgagatgagctaaagcatcattttttttccttcacttttttcttcataaaaaacaaactaaagatgttactccgataatttccaacgagacatagtccccattggttggcaagagcttagcggcaaaaataattaatgaaatttttttatatatccattacttatcgacttaaaagctaaataaaaaaaaactacattgagaaaactttgaaattaaatttaaaattttatagcgataggtcaaatgatgaggccctcgtcactaagcagtgggctgcttggacgtgatgcattcttccacgaacgccctgatttcaccaacgagcttccggtgatcgtcggcgaggaactccgggaagaagtagaaggagtggatggcctccgggaactccaccacccgcgccgccttccccttccgccgcagcatggcggcgtaccgccggtcccagtcctgcagcgggtcgagccccccgacgaccaccatcgccggcgggaacgcctcgtgcagttcggcgtcgtcgtcgtcgtctccggtgacgacgtgcgccgccgggtggttccggtcggccccctccggcaggaacgccttccacgacaggtccgaccgccgcgtgttcagcaccggcgccacgccgtcgagcgcgcgctcggattccgtccgctcctcgccgctgaagcacggctgtatgagtatcacgccggcgaggtggacgacggggttatcggtcgtcgtcgtcgtcgtcgtcgccgtggccgtccatcgctgggccacgtggtgcgcgatgttgccgccggcgctgtctccgacgacgaagcaggtggagacgtcgaccgggccgacgtggtcggggaggccggtggcgccgaggtagcggaggacggcctccccgtcgtcgtacgcggcgggagcccggtgctcgggggcgaggcggtagtcgacggacacgacgacggcgcagagcgtgcggcagagcgcgtcgtaggcgcgggaggccgcggagaacagcgtgaagccgccgccgtggaagtagacgacgacggggcgcggcgacggcgacggcgagtagaaaacgcgcgcccagaggccgcgcgaagcgtcgacggtgatgtccgtcgagctgacgccggcggcgtccggccgcgggtcggccggcgcccggcggtcgaacagggagaagaggaaacggttgacgctgccgtctcggcgctgcgtcgcgtcaatggcggcctcgaaaacgcagagcctgagcctcaccggccacggcagtgccacccggcggcgccgcccgtgcgcgcccgccatttcttggctactccgacggttctaccttttcgtttgggagactgataaaaaaatgcaggttcagaaacaaaattcagagaagttcaggaattttatctttcagtgtgcagccacaaaattcagaggttcagaaagtgttgtttcagtgttcaagcagccacaaaattcagtggttcaggaagcgtgtctttcagtgagtgttcaggcaggcacaaaattcagagaagtttaggaattccttggtctgaaaacaactttcaaagtgatatgaaattgatattacgattgaggcctggatagaggtgacatggagttatggagatcgccaattctccgtacttgaagataacgcagacgctatctttgcggtctcacgccgtaggattgttgtgagaagggtgcaagcaacacatacgacatgtgactatatgaggtcgcaatttgtttgtacgcttatcagttatcacatctctcttccttttcgcaaggcaaattcaggtgattcttgacttaagtattgaaaacttaatcttttttgctgattcagtaagttcagtgcgtactatagcttagtttactgaacatttagaagcgtctgacatgggattttgaagtttaacaggagcaatatcctgaaaaatcccagatagtattaggctgattttgaattacactaggcctacactgtttgatgaaaaacagagtgtgagtaaggatgggtaagaacaaggattttctacgcctaaatgccatagcacccatcatttacatacgacttaaatacttatagaaaaaatttagtaacattaattacgatgatataaatctatacagaaacatgcaagattatatttgatctacaactagataaaccaaaataataatcgatatcgtacaacgcagataaaatttattatttttgtttttcatgtgtatatcgaatttagacttacatgtttgtagtatcttatattatcgtagtccatcttatcaaattttatgaaatttttatataactatttaaactacatgcatacacctgagtgtagaaaatacattcccgaatgcgtaactattggaggtatgtactcttacgagtcgtcgactcatacataatttctataccaaatgccttttttttattttttatttttgccaaacacggtacaaacatactaatttgtcaaaaaaaaaacaaactctaaaaatgaacctggacacacatatatccagattaatagttaggattggtttatttggacggagggggtaaacacttacatacgtacccacacttactccttactatctccaaggactgcaccggtgtaaacccactctctatccgtatgaacatctccaaagactgatccaacatctttcagtataaagcgggtatgacacctaccattaaaaaaagggtaaaaatagttagctgcaaatacgaacaccctagtaagtctatgacatgttggggtgagcatgttttcaacacatgaaacttagccaagtgatcttacactcgcttcgtatgaaatgccaaaatttcatcgcggtggcaatgcatgatcatacaactttcatcttaattcatacaactttcacatgacacttagctgtgacctcaatttttcatttttgaattaaaaaccgttcaaattcaaatttaaaactttcatatgaaaacttaaaaccttcatactcaaattatacagttttcaacataaaatcatacgaaacttttaactgcggccttaaactttcaccttgaatcacagaaatcccaattcaaaatctcaagtatatgaagtgtacgacgcgtgtacggtacgaagcagatcaaactctcgaatctcaattcaggcggtggcgcgcgccgccctgttgctctggacgaacaccttgatgtcctgcaagaccttgccggcgtcggcgagctccgggaagccgtagaagccatggaaggcgtcggggaactccgccacctccaccgccttccccttccgccgcagcacgtcgacgtaccgccgctgccagtcctgcagcgggtcgaaccctccgatcaccaccatcgccggcgggaacgcctccgccagctcggcgttctcgtcggtgacgtgcgccgccgggtggtcgcggtcggcgcccaccggcaggaacgccttccacgagaagtccgaccgccggaggttcaccaccggcgccacgccgtcgagcgccagctcggagggcgtcctctcctcgccgccgaagtacggctgcacggggatcatcccagcgaggcggaggttcttggccgtgggctgccacgtggccgcccagcggttggccacttggtgcacgatgttgccgccggcgctctccccggcgaggaagcagctggcgaggtcgacggggacgacgtcgccgtcgaggcccgggatgccgttcccgtcgaggaagcggagcgcgtccacgccgtcgtcgtaggcggcggggtagcggtgctcgggcgcgaggcggtagttgacggagacgacgacgacgccaacgtcgccgcacagcctgcggcacacgccgtcgaacggcgccaccgccggcgagaacagcgcgaacccgccgccgtggtagtacaccatcaccggcatcggcgccgccgcctgcgccgccgccgcgggcgcgaacacgcgcgcccagaggccgcgcgcggcgtcgatggtgaagtcgaaggagcggacggcgccggtggcggcgtccggggacgggtcggcgcggacgctcatcaggtgttcgacgaggacggagtagagcgcgcggttgaccgtcccgtcgcgccgctccaccgcgtcgatcgccgccgagagcccgatcagctggagcctcaggcccagcggcataggcggcggcggcggcgggcggcggttgctctcgccgccggcggccacgtccttgcccatcttccctcccattcgcgagcttgacgaacactctcgttttcttctctcgctttttcggtgtggatttgtgagtcgtgatcacgcaacgctgtttccgaaatgggcacgttatcgccgtcccgtaaatgaggagtacagtgattgtactaacgtgtcgctgtcggcgatgggacacgttccaaaaaaaaaatatttttccatccatttcacatgtatcaatacaaaaccaaaaccaaaagaaaatttaaaataatcatcgcttcatcaaatcctaatacagttatttatctactcctaatacatttattctttacttcctccgtcccattttcagtgtagccatgattttttacgtccaactttgatcgtccgtattatttaaattttcttaaaaaaaattgaaaacataagtcacgagtaaagtgctattcatattttatcatcttataactacaaaaatattaattataaaaatttttcaaataaaacggacgatcaaagttaagcgcgaaaacttatggttgcacttaaaatgggacagagggagtatttttcacaaatttcggtgtgctaacggtaaacgggaaagttgaagtttggaattgagaaaaaagaactgaggccttattttgggataaatgggagagaaaaaaaatttgtcctcaaacagtggaagtactagtaagaaattgctttagtagaaaattgaactcggaattgttagaggacagtggctgtttaggtgctgaacctgtccagtcagtcgtggctgcgcctgcgccgcaagttcatcagtcaattgcggcatctggaaatccatggcaagaacagagctaacactgccaaaagcccaaaacacaactagagcataaaacggtggggttcggaggatgaaactccgactcccctttgatctctctctttcagcttattttctgcagttttcttttgttcgtcgttcaggtgcccagacgcaaaattcataccgtttaaattaaagccgtctgatacggatgaaatgatctgttataagaaagaggaaatgcaattttcagtgttattccaagatgagagtagatcactgaacagaagagcagaggaatgaactcaaatatggattctgatttcagaaaccatgagatggctaaaaggattgtgggatgaggtcatatgagtccgtagagggtttaactgaagatctctgaatattaacaggtgagcaggtgactgacaagatgacgccgccggctgttcttttgcgctgtcggtggcgagcaatcattttgtgcattagtttaaagcttgcatgtgaatcattttcatctaatataatacttctccattattcttgggataagataatccactaataaattggtcgttgaggatcgtgcctgcgccgcaagttcatcagtcaattgcccgatcaactgagaaccgcatgatcactttcaaatagcaactttccttacggcaatttaatttgggtgcatctttttttcttactggaggagtcaaaacaaactgaatcaaagttcagtgcaaactttgctgaaaattgaacccaagttcagtgtataatacagagtagcatgatttactgagcatttagaagcatataacattttttttgtgaagtttaacaggagcattcatccagattccagcctgattcattatattgagagtgctcctattgattcattgcgaagagaattaacatttcccaagcagtggcactaggcagttatgaaaccatcaaacatcgtctgccatttacacttttggtcttgccatgatttgaaattttaattctttgaacactacagaccaacaaacgagaggatatcagctgctgctatgaatcaacgcttctctaaactgcttagcacttggtacccctgcaaaggagacgcagtatgcgataggagtggggtccggagtttaaactccgaacctctttggtctcctttnttttttcctcaaggtaattttctacaattttttttcatcgttcatgtgatcagacgcaaattgaacctgttaaaattcgtctgatacgggtgaaatgatctaataaaagaatttaataaattgcaatttgcagttatttcaacaaacggaaggaaaaaaatatttgatgattccttttcaaatggatttcgctgctttgcacttggacaacacctccaatctgaacttctctgcaggatgattaaggtctaaggagtaaggaacaacgaaagggtggaaacgagccggctcggctcgcagtggctcgcaacaaacaaggcttggcttggctcgactcagttagggaaacaagtaaaacttgagcacggctcggctcggctcgtttcctggctagcattcatgttgaaacacctcttcatatatattttataattattaaaaaaaagcaagaacaatcatcaacatgtaaaatttaaataagtttcaattcttcaaaatcttaatggtaaatttcaagttgacaaataatatctccataaaaaaaataaaataatcgatataaacacatgatggtctaggctcgcgagccaaaagaagttgctcgcaagccagctcgggctcggctcatttcagcaatgagatgaaaagaaggcttggcttggctcgttttgcttacgagccgagctaagccaaccaaggttgagccaagcccgagctgagctcatgagcctaagctttttttttttccaccactagctaggagtggagcgaccggagcgagcgaggagacggagtttgtgatgggaaaggggttggagtttcaaactccgacagaccgacatcctttggtctccttcttttcagttaacgttctgaattttttttcttcgttcattattttgatcagacgcaaattaaacctgttcaaagccgtacgatctgttaaaacagaaaacctattttgcggtcattccagtcttccagatgaggctaagcaacgaactgccgaactgctaggagttcttattcggaaaaaaaaaaacgaactgcgaggagtgaggaatacaggaatgaactcaaatatcgattctgatttcaggaaccatgagaggactaaagcctaaaggtagggggaagagttcgcatgaatcagtagaggttttaactgaaaatctcagaacataatggccaaatatttaaagtgaaatgctgataagtaccaaaaactacaagtttcagaattttaatttcattgtcaatttgtaattggtagttggaattgaacctgcctcacaggagaagggaatactatgcacaatgatgctatacttttgtaatctttgtacttcattttagatagcgtagcacctaaaaaaatcctccttaatatttatgtgatttttttaaacttttaattcagctagccatcttttttagaggagttggggacctgtcccatcacacgataatttttgttttctcagatggctgagatgtaaataatttccattattaaaagaaattgaaccatccccaataactgaacagtactagacagttctgaaaccatcaaacactatctgtaatttacacttgtcttgtcatcatgccatggtttgaaattttgattccttaaatcctacagaccgacaagcgagagaaaatcatctgctgctacgaaacatgaatcaacacttcgctcttccagtttgatgattctttttcagatggattttcgcagctttgcacttggagtgggggtcggaggactccgatcccctttgatctctttttttttcaggccatgttctgcattttgttcgtcgttcatgtgagcagacgcaaatttatacctgttgaaagccgtctgatacgagcgaaatgatctgctaaagaaaacaatttgctgcatgaactgaagagcagaggaatgaactcaaatatggattttgatttcagaaaccatgagtgggctaaagtgtagggtggtgaggtcaaataaaccattagtgggttggactgaacatagtgaccaaatattatcggttgaaataccgattaatatcggaaattagaaatttcagggtcaatattactgttaatagtaattggtactgttgaacttattagcgtgctccccaataaaatccattagacccctccccctgatgaagcaaatcagattgattggtccacaacaaggaagaaattaaggcctgatttcactaatgatttcgactgcatggacttttgtggaagcacgtgtgtggcggcgttttgcagaaattaaccaatcaagcacttggctagcataattcctttgttgttttcttcctttaggtgatccatcttctttgtaacatttcttatctttcatgtaattcaccaactcttcttataatatatatattttggtaaccctccattgaagctagccttttgcagcctctatgttcatgaatgtacgtacagtaattaacctgtatgagcatcagcatcagatcatcattggaatcaaagcaatattcaagcaacaaaccccaagaaaagcgaagggaatgacaatattatagttgtgcctcagcccctctaagtctaaggtttgcctctcagccaccctaaaatttaaatattaaaatttaattttgaagttgattttagagtttgtcgtagtagtttatttttgacaccggctttcaaattgttaaacatgcatatataaaaaatgtattcacaaactatttttttctttaataaatagttgtaggtgaaatgatggtagtctcactatccctcttgatccaaacaactccagcttgcaaagacattttgccagataattggcatgcatgcagcctaccattttcaatattttaaatagcgggctaagatatttagcggttagcttctaaaactgctatagcgggctaaatggagctataccggctaaattgtacatgaaagcaaatagctagaaccctctcaaacagctatagctgaagaccctgaccatttctcatctctataaatagaagtgcaaatctcgagctcctaatcacaggcagctgcagctagctagctaagcttggataacagtgcaagggcgccggacggctacttggtccatggcgtctctgacgatcgtcgtcgccaccatcttcctgctcagcctcacctcggcgagcgtcgccgtccatggccggagcagcaggaggaggttcgtcaggagctacgacgagccgtgcatggagatgaggctgtacctccacgacatcctctacgactacagcaacagcacctccaactccacggcggcggcggccaccaagccgacggcgctggccaacgccgtgccgtcgaccggcggcaccttcttcggcgaggtggtggtgttcaacgacccggtgacggaggggagggcgctgccgccgtcgctggaggagacggcggtgagggcgcaggggctctacctctacaacagcaaggaggcgttcaacgcgtggctcgccttctccatcgtgttcaactccacggggcgccgcggcacgctcaacctcatgggcgccgacatcatcgccgagaagacgagggacatctccgtcgtgggcggcaccggcgacttcttcatgtcgcgcggcgtcgccaccctccgcaccgacgctttcgagggcttcacctacttcaggctgcagatggacatcaagctctacgagtgctacgtatgatgcatccatccatggtcgtataatatatactccatccgttctaaaatataagtatttttagctatgaacgcttatattttaagacggagggagtaccaaacactattcattattgtcgatgcaaatttcagtgaagatgtgacatctttggtcagggagacaaatgatcagccaattgacaaggtgatctgatgctcctagcttcgtctacctatagatttatttgttgctgctcccatcatcagatcagaccaccagctgtatgagtatatacacagtttgtatgctaaattctttctaaataaacatccttatgcaaatgtgttgataatgaatctatctattatatactaaaagtccattaaactccctataaacactctaaagccaccacgtgagactcctacaaacgctcctagattgccacgtgccgctttaataaatcttacaaattctaagaaaaaagcaaaacatctagccatcaattttcatttaatttggtggatccaccaccaactgcagccgccgccccaccaccttcaatccctgccaccaccaccaccaactgccggctgccgccgccacctcacgccgaccctccgccggtggcctccccaccagatccggccgcggcggcccggatctgggcggtcttcactgtctactgcgcggccctccaccgccgacgggagagggagacgaagatgacgaagccccgccgccgccgtccttgcggccgcgcggctttgccgatggccgcttgggcagcggcgatgcggcggaaggaggaggggggggggggagcaggcggcgccggcggtttccgcctcccgtgtcgcccatgagggaggacgacgcgggagcgggcgacgctttttgaactacgccttcttggtagcatgtttaatcaaaataaaaatcttcttttcattaaacaataaaagttgacaagaacattgtatataaaaaagagagatttaattagattgtttatgagataggattttgtaggattattgcaggaatgactccaattttctcctaaacagttaatttatgccattggaatgattttgaaaataacatattataatagtatatgtcttacgattgcaaattttgttcccatttctacttttagaatttcttatatacaaaacataattgtatctatgaaaataaaaattatagttaattatatacatattattatattatgtttttaaatctggtttggcgcaaattaaattgcatggggaaaaacttgctaatctcatcaatgatttttgactgctcagatttgctaatcttctagacaagctcacctccgggatccggctattatgccgggtttcaggagattaagcgattggctaggcgtagatcacttttcttcctttacgactttaagcactccctcttctatagatacatgtaacatcgatctcattaattcacccactctaatttcttataatattttaatagacatgcgaccagatctgtcagaatttttttttctggtaaccctcccttgaagcctttgcatacctccatactgctcataataacatgttacaataccctgcatcagcatcagaaattcagaatcaagcattcgagcaaacagtccaaagtaaagagaagggaataacaatataaatatataaatataatagagtagcctttgcttatatctcactccctcttgatccaaccaactataggatatgagatttgctccgatccaacaaaaagtactttgagttaccagtacctcacggtaccaaatcattttcgatcattggatctaacagtacccattctgtccagttagattcaacggtcgaaaatgatttgataccgtaaagcaccggtaccttgagatacttgttgttggaccagagcaaatctcagaacctacagcaacacattttgccaggcatgaacatgcatatattattccatttcacacctctataaatagagatgcaaaactcgagctccatcacagctgcagcaaattaagccagcaacacttgctaagtggagtggagtagctagcttctccagctagttagtgaattaagctcattaagctgagttaattgcactaacttactactccaagatagcaatggcgacttggtccaatccctccctgatcgtcgccgccatcttcctcgtcatcagcctcacctcggcgaccgtcgccaatggcggccgtagcggcggcggcaggaggctcgtcaggagctacgacgagccgtgcaagaagatgacgctctacttcacgacatcctctacgactacagcaacagcaccgccaactccacgtcggcggcggccgccaagccgacggcgctggccaccgccgtgtcgccgaacggcaccttcttcggcgaggtggtggtgttcgacgacccgatgacggaggggacgagggcgctgccgccgccgtcgtcgctgagggagacggcggcggcgcgcgcgcagggggtctacctctacgacagcaaggaggtgtacgacgcgtggttcgccttctccgtcgtgttcaactccacggggcgccgcggcacgctcaacctgatgggcgccgacctcatgtcggagaagacgagggacatctccgtcgtcggcggcaccggcgacttcttcatgtcccgcggcgtcgccacgctccgcaccgacgccgtcgagggattggtgtacttcaggctgcagatggacatcaagctctatgaatgctacatctgatcattacatgcatgttttttttaaaaaaacaaattgaatttccatttttttttaaaaaaaggtgaatttccatctcgatatatagttgcttgatttgcgtgacgagttatatgcaccgacgagtgtgcaaaatgtatcccaaacacagttttattttccccctaatttgtgtgtgtagaatgtatcaaactattatcgcacttttatttcattcaataaagactaaccacataatcgtgttttgcgcgactttttatcctgtttaagaacttttgtatgtggtctattagtttaccttagctcttaataaggttttgatataagttaatttatttataaagtatctattatcctagccaacaatagaacttccttcgtcccataatataagggaatttgggtggatgtgacacatcctagtgcctctcgagggtcggcgccgaccctaggtgccacatcggcgcaccagatagaccaagaggccagggtggcagcggggaagatgccagcattcgttgctgcttgcaaaaatagttccacaaaaaaaatgataagtattccacaggttgagtttttatatcttaacaaacatactgtttgagacaccagaatccaacagattaaattctggagctctgtctccctattaccatctgcagggaagtcttattctaccagtcgtcacaaaagttgatacaagctcgaaagtcgagatcaaacaaaaaaaaaccaaccgatccgtagattcgctacataagtaactatagttgccatgaaagtaaaagaaacacaacagctgatgacatttgcactttgagatcggcaatatcaacatcatgacctccttcaaccaagccccatctatcaacctgggggaattaaacaccataagacaagagaaaagtaaatagccttaataaagatagacaatggttgcagaataacctggtgatcttcttcaagtctgatcaattcaattgcctgctcaattcccagcttccctctgaatattgcgagagggattaccagggaatgggctgctgctgccatagcatcaatagatgccaactcaaagtcggtggtattcttcaaaacagtttctacagcattagctaacccttcatcttgctttccaccaaaaaagcttgtgtatacaacaggcttgaagccaaactcagtgtttacccagtctagtatagggtcaattttctccttctgtctttctgcacacacacacacacacacaagaagcataagaaagacattgctggagggaaatgaagagaagacatcgctaaccaaaatgtatggagttatatgctcacaacactatgaattcatatggacgtcattgcatacacagtcaagaggaaacaacttacgataaactcctacagtcagctcattatcatcaggtgaacggcagaataccaaatcttggtggaatttcttcatcaaattatcaattattttttttcgtgtcaatggaactcgttccagtgcagtgcaagcaagcttcataagaggcattgtaaaaggccggattccatctgcttcctatgatgtcaagaaagtttggtatcagtatatgttacataagaaactagaaaatcaaatacataaagaagagacttgcaaagaagttaaattcaaatataattctgggctgtgtagatgagaagcacatcaagtaaacagaattcgttgtaacatctcctgtcacttgtaaaatagatgatgtttgattgcagcaattcagccatgaacatatgttacagttgaaggcagtaatcaatattaattggatgcacacccgtgatgctaatataaccaaagaacaaacaaaaccgattacttatgacatgacagatcttttaattcacatatgcaatatggaagtatagagcagctgactacttcctaagtttacccaccgcaacatataagtacagacatacatacattttaagggttgccatgtgaatatgtgatgcaaatgcaaaggcgcaattgccttatgaagtttgcttttacttagctgctggaatcaacctgataaatttgaatacagtccatcttgtggtagtactattatagggatgataagataagaaccagacaacaaaataactctaaatgctgcattcttcatatcctactgaaacaataactctataataccagtatccgaattaattaggagtcctggtcatcttctttgctacttcccccgtttcacaatgtaagactttctagcatttcccacattcatatagatgttaatgaatctaggtatgtatatgtgtctggattcattaacatctatatgagtatagacaatgctagaaagtcttacaatatgaaacggaaactattctttaaagctgaacaatatttgtagttattctagctgctctagccgcaacagggagaaagaaaagaaatgtaatgccaaaaccacctctaattgcacgatctaaatcatcgatgccactgccactgaatagtacactatggcaagcgagattcactgattgaatagatttaaattgcacaaaatccttccgcaactcattacagttctgggttaaactgaacttacaagattaagatcgacctaagcgctactagtcacccaatttccatttcgaatcatttgatttaccatcttccatccgaatttgagtaatcttacactacagttgagcagcataaccaatcgagggccaatcaaacagaagatggggatcatgacctggtactcccactcggcggcgatggccatggcgagcgtccgcgactgcagcttgagcggccgcttcgccggcgacttgagggtgcggtagtcgagcatcaccgaccacccgttgccgtcgtcggcgcgccgcacggtggcctcccggtagaaccgcttccccaccaccgaccccgtcatgaacgacatcggcatcgccaccgacgtctcgtcccgcgtcgttaccgccgccgccgccgccggcttcttcaggtagatctcatctccccctcccccgcccgcctcttccctccctcccggagaggaggacgcctccgccgccgtccccagcagccgccacctcccccccgccgccgccgcggatcgctgcaggaggaggcggcggcctgcgagtgtcgccgccatgactggtctcgctccgctgtttgggcctaagctgctgttctagtagaggcaaataagtctgtttcgtctccctcatctcttgctcctgtaaatcgtctccctcaactgcaaaaccggatatagcgccgctcccggaaggctttttttgtcttcggaaagtagtgaaaatcaattcctcgatcgttttggaagtggtttctactgacatgacagtttgaccacggtttaacttgttaagtcagtagatgggatccacgtgtcagcgactttcatgtcacctcatcttcttcatcatctctctctctttcgggctcattcggtttaaaggatttttataggattattgtaggaattcaaacattaggatttttttcctatatgcctcattccttccattcctataaaatcctatcaaatacctaaggattatagccttacaagcttattccatatgattcttattatcatgagataagacctcttagaaaaattcctaagaaataagatgcatctaacatcctaattctttaccttccctgtacctttgatttgggaatcctataaaccgaattagccttccatctgtccccccccccccctctctctatcatcaggctcaataactaggcccatccgcaaaatcggcccgatgtttgaggcccaactaggcccagagaaggttcgagacgcgtggagcagcttcgtctccgcggcgacctaaaatcgcgaggactacgaccaaatcacgcaccttcgctctcttttccattgcagagccctcacgcttccgcaaccaccaccgcgtccgtgatcccatccacctccatcgccgccgccgccgcgtatgcgccgccggtgaccgggatccatggcggagccggacctactcgcgcccttcgccgacctccccttcccccccggcgacgatttccccgacttcccgaccctcggggatgacgccttcgcgctggaggatttcgatctcgacgatctggacttcgacttcgatgtggatctcttcccgccggatgcgccgccgccggtgacgacgtcgtcgtcgtcctcggccgccggatcgccggaagcggggacgtcgtcggccggcgacgggggttccaagaacgaggagtccgcggattcgtcgtcgccgtcgaggagcgggagtgacggcggcggcggcaaggatgggaaggatgatgaggcgaagcggcgcgcgcggctggtgcgcaaccgggagagcgcgcaccagtcgcggcagaggaagaagcagtacgtggaggagctggaggggaaggtgaaggtgatgcaggccaccatcgccgacctcaccgccaggatctcctgcgtcacggccgagaacgccgccctcaagcagcaattgggtggcgccgccggtgctggtgccgccgcgccaccgccgccaatgcccatgtaccctgcggtttacccattgccgatgccatggatccacccagcctacgcaatgcgtggctcgcaggtgccgcttgtgccgataccccggctcaagacgcagcagcctgcgtccacaccggagccaccggccaagaaggcccggaagaccaagaaggttgcaggtgttagcctgcttggattgctgttcttgatgatggtctgcgggtgtttggttcctgcggtaaatcggatgtatggtgcagcgtacactggggaaggcgctgcgattgttccgtcacatcatgggagaattctggctgttgaagggccacaaaatagtgtctcaaatggtgttgatccgaaggtacctcagaatggaagcgaaacgctgccagctttgttatatttgccgaggaatgggaagcatgtgaagatcaatggaaatctggttattaagtccattgttgcgagtgagaaagcctcttcccgtttgtctaactatggcgagaagggttctggaaaccaaggaaaggaggagactagcttagcaatccctggctatgtagctccgttagaagctggagaagtcatggattctgctaaaggaatgaatgaactgatggctctggctcctggagatggaagcatatacagggaggatgatgggatgctgccgcagtggtttagtgaagcaatgtcaggtaagaatgctgcataatgtcgcacgcacaccctatttaatttaaatgaacaatactgtatatgccttgttggtgtttgtaggacaatgtggcacttagtgcgatgaattgtttggagtataacacttactatctgctagagctagcgatcttaatagatgaatgtagtgcttattcagtgctggaagtagaagatatctgcatatattacatgttcttttgccgtggtaaagttgtaaacttattgtgggtttagtatgccactcgggtggatgattaccaatataccatgatacataggaggcgatcatagacttttgggtcagtggttcattgtttagtcaccattgtgaaaagctcaatgttgtagttttttccgttgcggtatgctattggagaaggtaccattgcagcatatataattaactgctcaatgcatatattttgttgactggaatgttatgttctgaattactgctaattctgtatattttatgatatttaatttactattgtacagtatactatttatgtacattagtttgacgagtaaattgcattgccggtacacgaacttgtaaaatgctcgttttggtgcttgaatttgtctggtgcatgcggaggaaggcaaaaaggacacaacatggctaatcttattaatttaggggctcattaggaaattatgtaaacatatatctgagaaggtttgctattagacatacacctcttcaataaaaatagaatggatatagtgatcgtagaaaaagataaaaaaaacaaacaatgatataagggttagaaatatatgaaattcatcactttcatgatgaaggataaagtagagaccacatttataaatattgcatgtcttatgtacactcactacacgtatgcacgtcacatcctaatcaacattagcttcgtaaaattaacattgccaagctattttggtcctcattcgcacgaactagacaagtttgtgtatcgaaacaagcatttcacaagtttatgtactaaattgcacccacctaacaagtttgtgtactaccaatgcaatttactcttagtttgaccttataaacttcctctggacaaaaagtcactgatcgaatgaattgattatatccttagctgcctctgtatagttgaattcaaccttacatgtataaccatcacaagtaggtatttcctttgtttgctgaaattcttccattacacatgtcctgtttatggacatatggcacaattgaataatatactggtttttctaaattgtgtagtgaggtagtacttagatttgtgcatatgtgaagcacttattctcttttttgttgatggattagtagagtgatgaaacatttgtgccttgtgatgtagctttgaccctaaccttttaattcctcggctgatagttgttataagtagtttgatgacttggtccttcatttactgaagttaaccctgtctattgattattttccaggtcccatgttgaactccgggatgtgcactgaagtattccaatttgatttatctccaacaacagctgatgcaaatggcattgtgcctgtctactctgggtcagtgactaacacgtcacaaaattatactgaaaatcttccttctggccctgttcagaaggtgaagaacagaaggatttcgtactcagaagccatccctttacgaggttcgacatccaatgacacggatcatttcaaagcaccccccaagaaccatagtcagagccatgctggtcgtaagccagtttcgtccgttgtagtctctgtcctggctgatccaagggaagcgagcgatagggatggtgaggggaggatctcctcaaattctctgtcccgcatcttcgttgtcgttcttatagatagtgtaaagtatgtaacatactcttgcgtccttcctttcaaaagccatagccctcacttgtaatgtaagcaagttttacaacgtaatctgtaacagaacggatctccaaatgagctgactttattgtgcgatgttgatagacatatagagccttttttttttctttttactggattaccagtttattgacaggaatgagtgttggttccttgtctctgtgcttgtgtttccatgcctttgtgatgcatggtcttgtttggaatgctgggatgtcgaaatttctctgaggttttcgcgttccaaggaggcataattcattgttgcatcaccgcatggctctctggttcttgtagattgctggcagttggcagtaaaaggtagtttctttttattactacaacataacttgcatgtactccttttccttttgttatctgtctttcaggtaggtgatttgcgtattttcttgaaacaagtggcattgttttgttctcatgccatgctactcttagcaggatgtcagggatatcattttcatgtcgatgtttatgatcactaccaattgtttgtttcacagatatgtcctcaccacttacttttgttggcttgtttctgttagtttttgcttgtaca

SEQ ID NO: 56577 - DNA, 9517 bp, Oryza sativa
tgtttgtttcacagatatgtcctcaccacttacttttgttggcttgtttctgttagtttttgcttgtacatatcgtagacctgttttcattgataggaagcaaaacctacagaaaattgttgcttcataagaggatttaagcattcgcagttttttgtaatcccgagtctgaataaagcaaaggtaacctttctacttccatcatggactcacttgaggtgtggttagagagtcttgaccaatgcaacccaggccctagagctgctgacattatccatcctgtcaagtcctgaatacacttttatctgctccttttcatcagaggccaaaagcctggtttagttcccaactttttcttcaaacttccaacttttccatcatatcaaaactttcctacacacaaactttcaatttttccgtcacatcgttccaatttcaatcaaacttccaattttaacgggtactaaacacacgtattacctacatattttctgtggcttctccaaaaagaggatcatgttgcttgatctgtgtgtagcgtgtgttgctcacttgtgtgtgctattaaagacataaacaaccattgcggatagcattaagttgtgatttgacattccaactgatgattcattggcgccctcgttacctactggactactgtggatccttcctgtgatcatgtcctggtctttctgatcatgcacacctacttgtcttttgtaccggcttactccgtatgaatggattggtgagatccgttgttgattgggattccatcacctaattcgtacgtagaccactttgatctcgtcagtgagacctttgttgattttgtcagtgtttttgctggatggaacactctgttgtcggtcagattattggaagaaatagcagcgctcctggttcaggctgctgtcatagtgctgcctgaacttgcaacatttaggcccggatgcaaatcgtctgctggaccgcacctgcagtaggtgtcactgacatgtgggtcccacctacttcgggcccacttgtaagtggcacctactgcatatgcagtacagcacaggatctccgcactcttaggccccctttgatttgcaagatagagaaaacataggattggagaaaacacgtgattttaaattttggtttgcgtgatagagaaaacataggattggagaaaacgcgtgatttaaaatggtacccttctctaatcatatagaaatgaaacccatgcaaaaataatagaaggccccttaaatgccataggaaaaatgaagaaaaataataaagaaaaggtgagacctctaggtaattttccgattaaaatgaaatgtacaaatataataatatggaaagttttcttccttttccaagtttaatgtaagaaaaaatattttcactagaatttgaattctatgaaaatcttttgccaatccttagtagcttcagatcaagcaagttttgtttaactataacatttttagaacggaaggcttatcaattgaatgatcaagtaataaataataaatttgggaagcacccgtggtgacttcatgacaaccaaggttcaaatcctgatacacgagtcagggtgtgcatttgcaagtatatgagtgaggtatgcgtgtttgatgatatacacgtgcgtatatgtctaccgtacaataacgataaaaaagagagtaaaggtctgttcactttgatgccaggttgctaaaaaaaatagctatatttagtttgctgtcaaattttaataaatataaaagaaaacctaccaaaattttggtaactatactaaaattttggcattaaggttttttttacatcaaagtgaacatgccctatataacaaaatccttccgcgaaattcagttgaacagcatcgccatctctgcacaaaattcagcgaatcagcgagagaaggaccagttccaactccgaagtttacgcggtccacaaagaccaagtgcaccgaaatatgtccccccatgctgacttcgtgctcttcttttagggcccgtttagttccctaaaattttttctcaaaaacatcacatcgaatctttggacacgtgtatgaagcattaaatatagataaatagaaaaactaattgcacagttatagagaaaatcgcgaggcaaatcttttaagcctaagtagtccgtgattagccataagtgctacagtaacccacatgtgctaatgacggcttaattagtctcaaaagattcgtctcgtggtttccaggcgagttctgaaattagttttttcattcgtgtccgaaaatcccttccgacatccggtcaaacgtttgatgttacacccaaaatttttcttttccccaactaaacacaccctaatacttcgtctgcatcttgagttcaaagctgcctctgtgttagccctttgcttagctactaatcatcccacatatttcaaaccatttaaaatccaaatagtcctaataacctactgcattaacgtcactactagagatagtgagagaagataacaaagtgtgttctcgctgacgaaccaaggtgatttcttctatatatattttgcgtttttatatgattttttaagttcgttgctaggttgcatctgctatttttttgcccccaatttttgatggttctaccaatatccgaagcctcaaaaccctatctttgtcactctcctgcttgattctgcctacgcatccgaatcttggccgctttgtaagctgaatgtcgcctgggttttctcgagcggagtaactgggtttggatctttgttcttcttttggtcgccattttggagttgaatctcttcaccgcgtcggacttcttccctctcctggggattctttgtgccgcaagttcttggtgagccattgtttgagcatttcagggttttctcgtctgcgccttcctttcccccccatttttggtgctcaatcctgcttgaggtttttattttttatttcccctctatttagggttcttgatttccatccaattgttgtttgctgctctttttgaagcgtttcggtgaacagattgttgtcattagcacttcgtttgtaggttcactaagtttcttttttttcttggtttcattttgcaagttgttgctaactgcaagaatctgtaacttaccagaatgcagtgtcactcatccacaaatggtgatgcttgtttgctgcggacaaccggaagaagcagaattcggccgatatagtaccaaattgcaataagaaaatggtactgcatgattctagttttgtatctctgatatctgatagcaacaatatttgatcatagttttcgtattcgcagcatccatattcacttaaaagttccaagggagcaccgtttccaccgcgaccgattcttgtcttcctcattgcaatatttggattctatgtatgctacatctcctttaaccagataacactagagaatagatctgaggagaacagtggagaagtgcaggcagaaattcattgccgaaagcctcatcttcctcatgaggagctgcgttatgtgcactttccgaaacctgagagttatagcaggtaattttcctctagagtagaattattatctcttagtacgcccctgttatggatgtgcattttctgattcatgttgcttcaaattttccttcttccataggggagagtgttcctgcaatctggttcgatcctttgtgcttgtatctatgcaacggtcgggaagtggatggtttgagactttgctgaacagccaccctaacatcagctcaaatggtgaaatatttaacagggtggatagaagagagaatatctcatctatcttacagacccttgacaaattgtataatttggattggttcaccagtgcagcaaagaatgagtgcacggctgcatttggattgaagtggatgctaaatcaggtatatttcagcttttcttggtccatgtgaatattagagggttagctctctgttacattgaacttcagaaatcgcacacctttctctgaaacttaccatagtccatagttaccgacagtgtgcactagtcctgttcttgggcaatccagttcatatagtctattcgcttgctaaaattttagaggtatagctagaatttttaacagaactacagggtaatatgcttgcaattcccaatgatatgttctggctgctctttgtagttgtacaacacaaactggtcagctatgattattgatgttggcatttgtgtgttcaatctcattcatcaagcattattgcatgggtaaaattatgcctacaacttacaaagttatgcatggctttgactgccatcattgtgttctccaggggtttatggaccatcatgatgatatagctagttatttaaacaagaagggtgtttccgtgatatttctcttcaggagaaatacattgcgcaggcttatctctgttttggctaatgattacgacagagatgcgaagcagctgaatggaacccacaaatcccatgtacactcaaaagaagaggttatatccatgcaacagtttatgtcctctccttactattttcagttcatatttttcacattgaacatggtttcatactaggtgcacttttgatgaaatatgaccatagtatatttgaatgcatatgggaaatattgtatcaatattggaggaatgactatattgcatttggaaggagccattttctctacatataaaagggctcctcctttccgaacttgtacccttatattaggttatattatagaatatagacaactactggacttctggtatagatattttggtgaaacttaaatcctacatatttccattccaagagaaatgtaacatcactatcaatcatgttggcaaggaagaaaaaaaaaatgaaatgcttatatattttttctgagcaggctgagatattagcgaaattcaagccggtgctggatgtgtcaaatctgattccaaacatcagaaatgccgagaaatacatcagagattgcttggaccacttcaacaccacacggcacatgatcctctactacgaggatattgtccgcaacagaaatgtactaaaacatattcaaatgctgtaacgaaggatcaatgataaccctcgctttgctaaaatatcatctctatgaatgcaggcattgttccaggtacaagaattcctcggagttccggtgagaaagctggtcagcaggcaggtgaaaattcacactagtcctcttccaggccttgtcaggaactgggatgatgtgagcaacaaactgaatgggacacagtatgctcattttcttgacggtgcagattatgtcaggtgatctacatggatgtgagcgacaggattttttttttcatatggggttttagttgccatatgattgattcttttggtacaaatgagttggtaaaagaaagggataacgataaatagatcaagatgagagaccttgtgatcaaattgtacatgctttccactactcattaccttcagagctcaaattgcaaatatatgctcaaaattgctgacagttttgtgatggttattttgtgatcaaaggaatacactattttggttcacttggaagaatccgaattaacgaaatttgtagttttgttcacctatcaccatcattatattactcggtctataagccgtagctcaactaataactttgcaaatgaaaggctaaaccacaggagacagcaacagaaatgcagtctcccagttccatttttcaggtttcaacactccagtagcagtgtacactttcgaaatcaaataatgtttcctcgcaaaaaagaaaaagaattgaataatgcatcatgcatgattgccttctagcctaaaagagggaataaaaagcggggaatgtacccaatagttagtacacgaaaaaatggtcgcagatcaacaacggattaataactcccgtaaattcttgtacaagagcaaaaacaccactcaaaatcatgtttacaagttgttacagctacaacatcgttaagggcaccagctaatggtgtgggcatcttgacagtggcagatcattgacgccttcgcttaatcctctcaagggcgccaagctgctcattctcctgggcaccagagctttcctcctccctgttctctgcagctctcttgccgagctctccaaacaccgcagcgggaacactcttctccgcaatttggacatcgtcttcctcctcgtcgctctcatcgggcagctcaatgtcctcattgttagtagcagcagcctgttgttgcctgctgctgctctcagcctgtgcctgcactccagcactgacaaagttcatcatccggttagcaggagcagtagcagtgcttggagctggtggagccgtggaaggtcctggcgctagttgcctttctaggttagccatctcatcctcaggaacaccggctcgtttcagagtgtcaactgcctcatcgaggttcagcctctggtccctctgcatcaagtactctgggagtatgaaatgagtctgcacatgaaacgaaatacatcattttagtttactaactcacaagatgatcattgataataccaaactgcctataaggttggcccttgtgacatacctgactgcggctagcagccacagtacgcttgatgcgaagcatctccctgaatgtatcttcgttaccatgctgaatctcaaattcattccatttattccaaaattcaggatgagagtttggatcagcatagttggatgcgtggacataaatggcacgggcacgatcaatttctccaaggtttctttcaagttctgcaaatttcatgcacattgtcatgacatctctgtctgggagtccagattcaattgcttgctgcagcacaaaggaataaagttagaatcatttacagttgtgcatacctaaagtgtgactcaactaaaatctagaacatactatacagaaaaatagtatctggatttttcataagtatatgggttgttacagcgagtgcagaatgagttctttgattcatacgaacagttagcaaaaaaaaaaaaaaaggcaaggctgttggaatgtaataaaacccacattaattttgtcttaaaacagcaaaatgtaaaactggatctcaaaacaagcacacgatataaccagtattagtaagaaccaagataacacactcacctcatatatctgtcttgttcttggaacaccaaatagctccgcagcccgtgcaatatatatttcgtacatactcatcttttcgctgttaggaacagcccttacagcttcgtcgtatacattcattgcacgtttcgcaaggccatagtcttcctccagcttagcatactgcaaatacaataccttcttttcttgtggaggagcctgatcaaacaaaacaaaatgtaagtactgaagcaatataggaaaaacatcattttcaaaacagcatcgatgcaggaaaaaggaacacgaaataatcaaccaaaggtttggaatctaaacaagcaagcaagcaaatgcaaaatatcgcatgacatgatatcagcaagcagagacaaggttcttaaaggaagaagaaagcaggcgcaacaagaatcgccctgaacttattcgtatgaagcaaggacaaaatttctgattgccagttatacccaaaaagcatttggtaacatgttaactaaaacaagtcccaactccaactagattaaacatgattcaacttagcacattttatccggtgaacaagaacagtacttagggacacatgcattcagtgtttcaaaagttaaatgtagatatattcataactactttcatgattttacaaaattattgtgttgtggagatggtgtctctatccaaactgttactcttttgtgactacagcagcatgccacaaatattgcttacatgcaagcattgcatacaactatatgtaagaaacatgtgggtgaaattctagttacctgtttgacagcttcatcgaacagttctcttgcccgctctaacttgcttctctgataccttcttacaaactttgtgaggtaggtcacccaaatgtctttaacatggggatatttaaaaattttcacaccacgctcatacactttaaacgcatcttcgaaatacttgttttcctgtggaaagaggaaatgtcatgatattagcatatgcacgataaaatagtttactcgaattttggaaatgcggagttaacaaataatcctacctcaagaagatatgcataattgagaactatttggggagtggcaattcgtaaatccaatattctctcataaactgcacgagttgattccaatgttccaagactttcctccaggtccacatagaagctccacagtttcagggatttatgtactttcaattggacaggttcatccccctcagcagcagctgcacaggacatattgcattactgttagaaaatatgaacagtaaaacacacaacaaaaaataagatggtaaatatatatatatatatatacctcgcctcttaacctcaacagagggttctgcagtagcttgcctcatcagctcaatagccttgtcaaaattactgtgcctcagctccatctctgcccactcacaccaaatactggctaagtggtcaactgccttgtagttcacctgtgttgcttttttaaagatctcttcagcactatctagacgattatgtttctcatacatctttgcgaatgccacccatagagtatgtggttttccagctgccttcatagggtctacggttttcacagcttcaacatatgtggctacttgccttgtaggatccttctcaaaaagtttcaccctcctgcaaacataatcgtattgttagccaattccatcaagtatgagaatggaaaacacaaaagggaactgccaacatactagtacattgctaggctgagaaatgaaaacacctgccactagattgatacattccacagtatacatgttttgaattaaaatttaccacagccacttactgcactaaagaatccaaaacttgtcgctggaaagaaatatgtactacaaaaacagtaaattgcaactacaataaaacagtaaaaatacatagaccgtatacttacaaccatatgtaatagtccagtggggtcttgcattagtcatttaatatatcacctaaaatatgagaagggaccaaactttttgcagtaacagtacatttggtttgctggtttaacatgaattatccaaatcaaaattgttctactaggctggaatattgagatgctactaagttaagatgttgatgttgaaaaaataaacagcatgtacatgaagtgaactaaagagcaaattagtgtttactattgtcaaaacacatgaaaaagaataaatcaatgtgatcaatcaagtgagtctcacctgtgccattcctccacattatgcggattctgtcgcagcaggacactgctgaggagctctggccggcgatccaacagccgctcaaaccttgccagcctcaaatcagtatcatcctc

SEQ ID NO: 56578 - DNA, 5955 bp, Oryza sativa
ccgcaacctcatcggcatgcttggtgaggatttcgcagagctcaagccagagctggtgctgggtcttacccttgacggagcggaagccgtcatcgttgagcacggacgcgaggcggtcggcggcctcctgccagcggtttgcggagatgaggaaatcgatgaagtcctcagcgtgggaggggtcgtactggaggtatcgtcggaagacgcggagcgaggtctcgacggggcaggccgggagcgaggcgaggcggaggtagagcggccagatgcggtcgtgctgcgtgacggggagcgcgcgcagcgcgcggtcgaaggcgcggcgcgcgcgcgtgagcaggcgctggtcgagcagcgaggtgaggtagagcacccagacgcggggcatcttgtgcatggtggcgagggcgcgctcgaaggtgttgttgagggaggcgtaggcgtggtgggagatggggtgcgggcgcgcgtggtcgaggcgctcgcggaggtaggcgtgccacagcttgtagctccccgggagcgccttgagcgcgcgctcgtagatgacggcgcgcttggcgaacggcgcggcggcgcgggcgacgaggtagcgccaccaccccttgagcttgaacggctcgcgcaggatctcctcctcgtacgccaggtcgtcctccgtcgggtacatctccggcgagatccccagcgcctccgccgccgccgcagacgccgccgccacggccaccggaccccccgcaggcgacggcatctctcgctagggtttagtgctccgccgcggcgaggaggatttgcgccggagagagagagagagatcgagtcgagacggagaggctggcttggcttggcttggccaggccggcgcgtcgttttgttgggccgatgagttggaacccgagtaggcaagggcttgagtggttttggtgggccttcagggattttgggctgaacttttttacggaggaattgggcttatttggtatttgagtaattgggccgagttttgtctgaaccagagcccaaccgtcagtcatctgcttctgctactctactcaaatatttctttccccgattttggtatacatttgtcaatttttttgttaaaaaaactacaattatactgtatttatatttgactacagatatatagatagtcctttttttcctgaacagaaactttaagttttttttcttagagaagaaactaaagataaaatattactatttaattatgtgattacgtgtaagagttatttgctgcaatgcaaatgttgaagtatagtcgtgctacggtttctttatatgccacagaccaggaaaaacttggcaagagaaaatagggtgcttttttggatagatgtcgaatcatgccgcacctgaattaggcagactgactagtgagtagtgactaccatcactgatacaacaaatcttggcgttggacattatccgtacgagttcttctcaacaatattctcccttggtccaaaaaaaccaatctagatggggatgaaataccacctagaacaacgaatctgatattccatccccacttaggttggattttttttagacggagggagtagctgaacaacgaaaatgttagcccctctatttttttgggataataggcagtgatcccagtatatgctgaataaaagaggggcaaaaaccacaatgttaatgagactagatcctaggtggttgcgcgcacgcgaaggaacggacgacctcctacgtgcagcgggagggagggaacggaaggaagaagaacggcttcgtttttaaaatagtagagatatcacgtacaaactgccagtataccactaaggcgacatctaaatacatttcagcatgctcccataaaacttcattgtcaaggacaagaggtttggtatacttcgaagttcgaaagaaaaccaacattgttacattaccggacttctgctaattaaggctcaatcttgcacaacaattcatctatggaaagaaaaaaggagccattagctcataactccagattatttaatcaataatatgaaaactatatgattgatgatgaccaacaaaatcaatggaaagcctctatcagattcagagagctcacatcattcgtgtgcttttcaccttgctcctgaccaatcctccattccaggagtctatcagaattcagagagctcacatcacttttgtgctttcaccttgctctcgaccaaacctccattccaggaggcgcacgtgcatctgcataatctgcatattgccgaaccaactgagcacgatttcaggtgagcttaacagaatctgttcttgaacaagaaaaccaagaaatgtcactgccaaacttgccaggtcctgatgaaggcaacagaggaggaaccctgccttttgcctgtccacacagagatacacacccaaggccgtgattagttgcatttttttttcaaacttctaacttttccatcccatcaaaactttcctacaatcataaacttctaacttttacgtcacatcgtttcaatttcaaccaaacttttaattttggtgtgaactaaacacatcccaaatcgtctctgcttcttgctctccacggagaagggagatcaccggcgcttccacgagttgctcctcgccggctcgccgctggtcgcctcggccgccgccgccgctgcagttcgcgagaagcacttggggtgctagtgtttgggcccaaatggaaacaactgcacgaggcccatgtagtccggcccaatatgtatagccagtataattcgatcctttatatttgtggtcggaggtggtgagattaagctgcaccgccattttagattagtacgttgtcagcatcggtagcgccttcacttttaatacttacccgtgtctccatcgcaaaatataataagttttgattagataagatacatcctaatattataaatctagatagatcgtttatccggattcgtggtattaggatatgttctatctaatcagaacttcttatatattttgggtagaggaagtacttgctctatccactccaaagaaaagcttagggcatgtttactttgataccattttcaaccttaccaaattttggtaaagttgtcaaaaaaaagtggctacatttagtttgctgctaaattttggtaactatacaagaaatcctatcaaaattttagcaatttgccaaaattttagtaactatgccaaaatttggtaagattttttttttcatcaaagtaaacaggcccttaattctagttatagaactggatgggtgcttatcaagttcatagatagaattaaattattattgtttttataataacaggtctactctctccatctcaaaataactcaatttgtgatagtaatgtaacataaactagattcattgttcgagtcacttgggaaggaggaagtatagctcaggaacgggagaaattcttggcgtgcggcagaggaaagctgtcattgccttcgtcgatgatgtgtgctgctaatgtccattgcacaacactgattaatttatcagctcattgacttcaatacattcaagtattcaatcacatcctaaattaatggatacaagggcacgtgtccagctgtcgttggttcaggagctgatggcctggtgctgatcgagacgctagctcagctgcaactgcaagaatgtaaaacaattaattagccaagctgactgtaatcactggttcagaaactgatcctgaagatctattcacatctcaaatactccctccgtcttgagtttttcttgcactgtttgactactcgtcttattaaaaaaattgaaattattatttactagcaaatatgtccgtgcgttgcaacgggtgaaaaaacgtaatgataatatacgtttttcatgcataaccatgtcgataacaatcagaaaattagaactacgaaactttattttctagcgcgttttcttttgtgcttttttctgacatttttccctcacgtggttttttaaaccgtttttattttctggcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttccctttttttggatcggacagatttttttttgcccggtttatttcgcccgatcgattttttttaccgcgtcacatataattccttttactttggatttttttcgccctttttttaccgcgtcgacggagtcggattcgttttgattttttttctccatttactttggaattttttcgccctgttttcaccacgtcgacggagtcggattcgtttttatttttcccctttttggctttttttgtataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcggacaaatttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttgctccacgatacatataattcatttttctttggaataggacagttttctttttattttttaaactctttttaccgtgtcgatgtagtcggattcgtttcggtatttttttccttttttttgtcggacatatttgttttttttccgcccggttttttttcgccaggtttttttatcggacttttctttttttttcgctcggtttttttctcccgttttttgacggacgacagaagcacctagagaattttcttttctccaatccaatacagatcggatctcttccagggaaatcagattttttttctccagggaatcggactcttttttttcgctttttttattcattaaacggtttgtctctcggacttttttttccctttttaagggatcgggtgttttttttgccagggacgggtgtttttttcgcccggtttttttttcactttttttttgatcggactttttttttcgtccggtttttttatcggacaaacttggttttttctgcccggttttttttcacccggtttttttgacggacgatggaagcacctcttattttttaagtagtagtagatttattttatgacttactttattatccaaagtattttaagcacaactttttattttttttatatttgcataaattttttaaataagacgagtggtcaaacaatgcaaataaaatctcaaaatcccttatattatgggacggagagagtgtatgtagtactacttaattagtcagataattcagagctgctgctcgaggtcgtcgttgatgtcggtcaggctgatctgcccggccggagagaggtcgtacgtcaccggtgaaacacctgatgacctgaatggtgatgctgctgctg

SEQ ID NO: 56579 - DNA, 3338 bp, Oryza sativa
atgtgcagcctgagctgatttgagttctaaactaacaatattcagttcaattcaggggcggatccaacgtgggtgagtcctccctacacccacaagacccatggataccccggagcacctcattcaattttttcgccataaatgataaactaaaggtctctaaatggctggaggttaaagaaactgtgtaattaagcccccccccccccccccccccgcccctggttcaattcaatctcttattcgaaaaaatattcagttcaatcagatggttttattttgtgagttgtgctagctacctcattgcggttgatctcctcgagtcgtcaatagtgagtactcgtgacggtttagtactgatcaatggtcgaagacttgaattttacaacttaatttaagttaattttagaggtttattgttgtactccatttttagtattgtcttttaaatcacgaataattaatacatgagtaaaaattgtaccgtgatttttttcttcatttatatttctatagcttattagctatagctgaaccaatcagagcataagacacactccctccatttactatcgatgtattaatcaaatgatataaattaattagttactccctccatttcattttaggttataagacgttttggtcaaagtcaaactactctaagtttgactaattttttttaaaagtaataatatgtttaacccaagaaaaatatattatgaaagtttattcaattatagatttaatgaaactatgctgatattataaatattactatttgtttatacagaattagtcaaactcaaaatagtttaactttgaacaaagtcaaaacgtctaacctgaaactgagggagtagttttctagaaaatgggataaacccagcctcttcatccaatcggatgtagaatttttttgagaattaatatcatttttatggaaaatcgcaaaagtagtggtcaaccggggaaaatcgcgaaagtaggtccctgtcgaacgggtgcagttcgatagggcgcctatcgaacggccagagcgcgactggcgaggagatcggaaggctgccgttcgacaggtcctgtcgaacagcccctgttcgacaggcagggctgtcgaactgcccctgttcgacaggatatccgtcgaactggcgcagttcgacagggtcgtgttctccatttatttgtaataataattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttttatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatatataagtcaaggacgatcagtgcccttcgcacgcttgctaggtcctcccttcttcctacgcctaatctgctcagtaggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttctccctggggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgcggtgtgtggccctgctctggcgcacgcggagtgatatgaagtccccatgctgatgtgttcaacacgttgtcccccgttggcatgtaagggaagtgtgccgacccagatactccctgcgtggggtgaacataaggcagagtttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctaacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacctattttaacacacaacatatcaataatatgtactaactaagaactaatttaaccatacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctcccctcgctccctccggcgctcacggcgacgatgtggcgactctcggcggcggctggcgatgtggtcctcaaacaaatcgaacaagcatcgcggcctgggtggacggggctttaaaccggcctgtcgaatgcccattgttcgacagggtcggtggagggccctgtcgaacgcccccggttcgacaggcctcgcggcgccgggtgatgggccctgtcgaactccctccgttcgacaggtgagcttgtcgaactccagccgttcgatagggatttgtcgactgcccgtcgttcgataggtgccctatcgaactgcacccgttcgacagggagctactttcgcaattttccccggttggccactacttttgcgattttccataaaaataatattaattctcaaaaaaattctcggatgtacaccaccaaagataattagttagttattgatactttcatgcaaacaaattaaacctaccaaatattatatagctctaccttgtcctctctcctactagttcgtaaaatcgtactaccgttctggggtcttgagaaaagaccaccatagaagtttctcattttgaatgggat

SEQ ID NO: 56580 - DNA, 7728 bp, Oryza sativa
  unsure (1)..(7728): unsure at all n locations
attcctgtcttatgctaatttctggattttagtgagattgaagatgtaccgctaatttctgtcttatactccatccgttcccgattgtttgatgttttaccccctaacatttatgcatgaataattaacgttttgacgtattgcttgtataagtgccactacttaattctatgcttaaaatatttcctgtgtggcttactccctccgtaaaaaaagaaaacataacttaaaaatgaaatgtgacacagtcaactacaacgaatctgacacatcatatcctaggttatcttttttttttaaaaaaatggagggagtacttggttggtgccatttgtgctaattccctgattaaaatgaccacatacaaccaataccaataataatttaggataatttattaattttcacctttagctgatgtagctcaccaattatagaacgatcaacatattggacagaggaagtaaaacatatattcggaagcacattcatagggatataaatatgttgttgcgtgtgtgcgtataagtctaccatgtaatcgaaaaaaataaagaaatactgtattacgtgtgtagtgcatgtgagtttacggtgtaataaaaaaattccatcttaaaaaaagaaaaaaaatgcaaaacgctgcataataaaactagtactactagtactccataaactaaagatgtggacatcacggagaggtgggtcccacggttcaatcagggaggccaacacgcacatggccacatgggccatggccgctggtgttagctcacggcactcgtctgcgcgcaacacgtgtccccttcccccccgcctatctgttgcttggcggtctccatgtgggccccgcgcccttcctttccgtgtctcggataagtgggcccacgtcactcgtcccaccaccacctctaacccacacagggccccacgcagactagacaaaaccatagttattgagaccggactggtaatcgaaccggtgaggctgtcggttcaatggttcactggttcaaccggttggatcggtggtctaatccggttcaataaatactaaatacattgatcattcagtgtaaacacaaagagccaagtagtctggtggtggaggagtttaactaactcccacgtggtcgtgggttcgaatcccacccacgccaaccaccaccaggccggttcaaagcggttttataccccggtttaatagcggtttttaagcaaaaccgggcggtctaaccggtttatagccggatcgattgcatgccggtcttttacctggaccggaccggtggggctctggttctggttttttccggtccgaccgccggtccggtccggtcttaataactgtggacaaaacacaaacaagcaagcactgtagaagctaatatcttgggccggccaactgctcaaaagaaaagaaaaagaaaaaaaaaagaaaaactgatattggtagtcaaagtttattgttcatgctgtcttattcataattggtgctattacgagagaagatttgcaagtgttcgcccatttgcacggatgctttggacagtttgtctgacgaaaaacagctgctgcagctttgcctgttttgcgagcagagctttctatggagtattatccatcacattcatatatactcctctgctactccctccgtcccaaaaaaagacaaaccctggtttccgtgtccaatgtttgaccattcgtcttatttaaaaaaattatgaaaaaaattaaaaagataagtcgcatataaagtattcatcatgttttatcatctaacaacaataaaaatactaattataaaaaaatttcatataagacggacagttaaacgttggcacgtaaacccgtggtttgccttttttttttgggacggagggagtatgctgcatttctctctgcattatgtgtgtgttccctgatttccatgtcggaaatgccagtgacacttgcattcatctgccatcggtttttggaacaaccattgctgtctgtctgaaaaatgcagatgcagagcttatcctgaacgaaacgacgcagcagtttttgggtttccagccgctgtttcatcaagtggccgagcaagcagaagcagcggtttgtgaatgaaatccacgcgccactcatattcatggctgatcctgaactgaattcaatgtgtcccacagcttagcactagcttatcatgcaccgatcgatccagtcagtggcggagccaacgatgtcatcaaacccaaacgataatatgtatttcttacttattagtaatggcggagccacgttcaactcaagtggtgcacacgaatcccagatccaaaatttcttacttaagaacactaaaatgtgcagtgctacattgattttttttctaggcttttaatgatgagaaaattccctatctagcatcagaaaaaaaattgctcttccctctatagcacccaactttcaaaagttccctatctatgcaccatcaaaatttttgttccctatctaacacttccgttactcccgttagcctccaccgtcaaaacaatcatggacccaccctcaggaatttttttcgtcgctctttctctaggacagagcgcgagcgcgacctgctttccccaacccgcgtgcgcctctcagcaaaaccctagatcgccgtcgcccccatggatggagaccccccgggcggcgaggacggcgaatcagccgtgcagcgaggatggcgaccccctgggcggccattggcgccggcgggctcccccggacggccagcgccggcggcacgggaggccatccctaggcctgctcggccggctaatcccaggcgggcgcaggacaggcagctcatggccacggcggcacatgcaggcagctcccaggcgggcacggacagcaaccccctagatggtgcgggcaaacagtccggcatggcgatgaacacaacctttttcttgcttttgccctggatgtgaatttggatgatttggatggttatggttatctatggatgtgaatttggatgctctctaaaatttatttggttcattattgtgttgcaaacatgctgttgttgcagacatgctgtcaaatttctctaaaaattttagatatagaaaggttaaaaaactgtgaacaaaatgaaaaaaagacgtacagacatctggacactaaatgaaaaaaaataaagaacaaaaaaaaattgtgaacagagagagggaaaaaatgtataaaatacagaagggcacaaccgtctttcctcatgcaacttaacaccgtcaccctcaaaactaacggaagtgttagatggggaacaaaaattttgatggtgcatagatagggaacttttgaagtttgggtgctatagagggaagagcaatttttcttgatgctagatagggaattttctctttaatgatagtgcaccacctctgtttggacgctagcttcgcccctgctcattagtaacattttacaagtattttcgataattaacaatggtgatctcactaagatatctgaactgtaaaaggctttagttagttagttttagttagtaatctgttcttgtcccactacaggcgctgaagcttttggttaccatccagactttgagtggactaagtaggtcggatgcgattaacaatttactaattggatatctgaagagagcgatcatgagtgagcatatcgcggtgcagtgcagtttgcatctttgttcaggtcgctgtccatcgattttaatttcgcacaagtcaaacccttttaaaacaatgcagcatagtgatcgccgaaagagagccatgctgcctttactgccaagttaattatgatatattattagcactagagttcatgccagttgacttgaggttgtcagattttaatcgatttggtgctgatttgtggcacggatcatcgcagcaagtcaaagcaaaaatcgaaaagtaagtttaaaaaattttcaaagttcagtagagtaatgggtgggctaggatcacaggggacacataatcgcgtgggaaaatccttgaatattcggcgcgaaataagggatccatcgatcagtagacgcatgatcttcatgagcttgctttgaagcaactggatgctgcccaaaagcaacatttccggtgcatgatctccagttaatttgatgcatgggtttcttgatctgacagtgtttttttcataaaaaaattggaagagaactggatctgatgatatgtgtccctatcttgagatgacgtgtatgtgtctgtcaatttcttgaaacaattttttttttgccttttttacattcacagaggcattgacttggtgtgtacaattagctgcatctgaaaagagggggaagaaatgtgtgaaaatctttttttttatctacctgatagttacacttgcgttgctgtctgaattgataattgcctaaaagtcaggtcatgtgtgctgaaactgttagatggatctccctccccttgagcccaacggctcaagggggccttgacccgcgccctgatcgggggcgcccagcccaatggctggtgggcccccgtcacactgtgccatataaagaggggtggaggacngnacngcntaacnacacaaggaacgaggttcgtcgccgccgccgccactccacccaaaaaccctaaccgatcgagggggcgcagccagtgacgggaagactccaccgcctcgccacgacctcgccggtatcccctacgaccaccactgccgcgcaacaccgtcgccgtcacgaccgccatcggcgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaacactaacaatggtatcagagcaatcctagcgtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtggggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgatggcgccgccgtgtcgccatgccgccgccggcgctgtgctagggtttcggcgacggcgacgccgctccgtgcaaccgcaagagaaagaagagaagaggagctagggtttcggcgccggcggccgggggcggttttgtttgcccgatccgcccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccaactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtattttttcatgcaaattacaatagaattttgaattgtcttacatgttttatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccagtttagtggttcttcaaagttttatacgacacagctgataaagcagcttgttacagagaggtaccatggaggtggtgtaaaataccacattcttaggatgagcaatatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcttgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactacgcaaagaagtgaaagatccattagagttgccaatggagttgaagcaaaagttgaggctgttggagatcttcgcctagaactcgcgaatggcttcacacttttacttccagacgtttttatgtcccttctttgcaaagaaacttgataataagtgtatccaaattggattttgatagatatgattgccattttggaaatggcaaatgtgaactatggtataataatgaatgtattggtcttgtgttgcaagatcagctttatttctttctgagaatgtgaatgttgtgtcctcgttgacaaaagaaaagaaagcgaacttctgatgtctcatcgaaattatggcactgttgtttatgccatatttcg

SEQ ID NO: 56581 - DNA, 2356 bp, Oryza sativa
atgcatacaatgtatagaatgcatcggtgcccaaaacaccatatgagctatggatcctccgtgtgtgggggagtcctgcaaaggataaagtatttaacccaaaacagtaagctgccattttattggctaattctgaaagatcaaagggtcatcgtttctactgtccaaacagttatacaaagtttgtagaaacaagacacgtcgtcttcttggaagacgaaatgattagggggagctcggtaattcgagaaattgatcttgaggagaggcgggtgtctgtacccgctccgtcgactcaggaacctttctaatgttgtgccagcaatgcatgacgttgcggtaccaacacctgttgttatctctcctgtggcaacaatgaatgaaagtgaagaacctattctacaggattcaacagaaattattgccacatcagaggaggagctgcaccagcctcaaacatataatgtgccagaataggaggcccctagaaggcctgaaagagtcgcatatcgaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgacttgtggcaaaaaggcttcacgcaacaagaagggattgattacaatgagacattttctccagtctcttgtaaagattccttcaggattataatggcactagtggcacattatgatttggaattacatcagatggatgtaaaaacagaatttctaaatggtgatttggaggaaaaagtatacatggcgcaaccgaaaggttttgtcatgaaaggaaacgaaaatatgggatgccgtataaagagatccatttatgggttaaagaaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcagctgtaggaagcctacagtacgcgcaagtgtgcacacgacctgacttggcatttgttaccgggttatttggcagatttcaaagtaatccaggcctagagcactggaaattggtatagaaagtcttgcgtgattgcaaggaacaaaaggcctcatcatgtcttacagaaaagcagaatcgctccagatagtggggtattcggattctgactttgcaaaagataatacaaagttaacatcgggatacatgtttaccctggcagtaggagctatttcatggaaaagctcaaaacagacgaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtctgggatcaaacaatcagtcttgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatgttagatggatctccctccccttgagcccaatggctcaagggggccttgacccgcgccctgatcgggggcgcccagcccaatggctggtgggcccccgtcacactgtgccatataaagaggggtg

SEQ ID NO: 56582 - DNA, 3761 bp, Oryza sativa
ccaccccaaaaaccctaaccgatcgagggggcgcagccagtgacgggaagactccaccgccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaacactaacagaaactaggcccgtttggttgttctcgagctcacaaattagtactatttctttaaaaataactttttttaattataaaacaacatatcaactttgtagtgggtactttattgatgccttcaaaattatcataaacttagagtaatccatcattaaaaaaaattaatcgtttcggctataactaagcttatcatcaatgagaaaatgattcatgggtaaaaattttatatatgtattcttaccaattttatataaaactaatacgaagtaatacacaacggtaaaaatcagctctaaaaattaaatttaacaaaggatggcgtgtgttacatatttcgcttttttaacttccactcctattattttttgtgcgctacccaaacagttaaacgatattttttttttgcaaaatttgatagcaacgctgtgtctgaaaaatcatattaaccattttcttaatttttagctaataattactaattactaagtaatacttcctctgtttcacaatgtaagactttctagcactgcccacattcatttagatgttaatgaatctagacatatgtatgtgtttggattcattaacatctatatgcatgtgagcagtgctaaaaagtcttacattgtgaaacgaagggagtagtaatttgttaatcctctgtttcatttttgcttagggatagatttgcaattaaaaatactccctccattctgtaatataagaaacaaccacttttcttagatgttccatgataaaaggcatacaattaattatggtatcttttccattaaattattaccttttaaatcctccactcccatgttatctaattctattgaatgcatgtattatattattaggatgattcaaactataagataataataattatttcttgatttttgagttaaggatggttgtgccttatattttaaaatggagggagtagttggaccagatgagaagtattaccaggtctgaggcctgtggtgcgcagatctttttctccagggagccgtaggcgaatgttccatctctcctctcctcttctcctctttattactgcacgcagagagctccagctcgcgctgctccgaccaccgccgcgccgctcgccgcctccgccaccgcctccgccggcaaaccaccccctcgccatggcctccccctgcgagcaccacgtcccgtacaccctcctgggcgcgctcctcagcggcggcggcccccacgccgccgcgtgcggcggcgccgccttcctccgcgactacgcggagcggggcaccaacgcgctgctgtgggcggccctcctcgccgtcacgtggctgctcgtcctccgcctcgccgcgctgctccgcctctgggccctcggcgcccgcctccccggcccgcccgccttccccgccgaccctggcctcgccgccggtgacatcaccggtaggtttccgtcgtcctcctcctccttcctcccttctcttccctgttcgtgcgagtagcggttggtttggtggtagttccggtgggtacggatgcggagctactgtggaattggatttggcgcgagttcggcgccttcgcagggtagaattattgggcatatggccttctctttttatgcttgctcgggtttccgtgggaactgttcgattgggaggaacgttgccgcagtttgattcgagattcagcaactcatcatcctccagttgctacgcgagcgacctgagtacggtgatttgggaatctgttcttattttgattaattgatgtgggatttgatttagttgggcgctgatctgggtggagttcgattagaatgtcaaatcggctgatttggactgtgtcgaattatttgatctgttttacgacagattcgtgcccaaatttgtagcttcagtggctgtaagcctgtaatatttccgttcctctttgaggaagtggaacctgctggtatgaggtaggggaagacaaaaaaaaaagaagctagtgattgaggtatgaactgtttttggcggatctgttttccagcaactgagcgtgacctataaattgttgcttaatttgttttgccgtttagattctagagtactttttactttttatgtgaggttgtttttgctgaattttcatattttgtaagtcagcaagggaactgaattattaccaagttgaccttgatttgggatatatttccaaaggattggacggtgtagagatctgctacgtattactttgaggtttgtctgattatatgaatatagtagaattcccaggagaattgaattaatactctgtttcctgagaaaaaaaaacacatttctcatgggctcatggcaatcggatcaaatcaaatctgtcatcagtgtatgctgatcttcatgtcaattgtctagatctaatcctccgctcttcaatacatcttggctattggtgctagagaacaatatcggtgcatcatgtaccctatcaaaaacacctgcaaatggtcattaaaaagtgtgaggtaatttgaaaacaatgatactgcatggatctacgctgccacagtttctaaattagtttaacacagggcagaaaattgaatagacagattttagtaaacaataatatagtaccatcctctttttttttcaattatcctctttcagttgattttgcttctttatttcaccttccatgacaaagttcgattttaaactatgtataatgaattgtggtctggtatatccattgtgcctgaatgttttcagtttttctttaaaataaacatttacaccttattttgaatacgatgtacatgaaggtaggatgaaccgtcctaccctgacctgcgccaaactatgatttaggaaatattggacaaaaattgctgaaataacctatctggatgaaaaaaaacatctcccttatatgaataagttgttcattacgattttgccagatgaggattgagttactaacagaattcgctgtgcataaggtaggtgttttgcatataaatataggaatagataggcatcacacgagtattttactaactttaatacggataacttttttttttttgcagggaaatacggataactttttgataccatgctgtcctatgtttgtggcatcatattgtatttctcatttttcctgtttagtcaaatgagcatgtgcgtagactggcctagctcaactctgtagtctttagggcccgattatacaatgctctagcacatggtgcatcaaatactctacataacagatagtcggttgtacattgttacgcataaaaattctggaaagaaatagctaatgcagattttgagcagattcataattgcgatctaccagtatttgttgagtaaaacactaaaactgtggatggtttgatttctgatcatattcccctgaactgctgtatttcaccactgatcatatgttcctttcaactg

SEQ ID NO: 56583 - DNA, 29972 bp, Oryza sativa
gagggaatcactgaagtcattcctggatgaaaaacttagtgttggtactggtggaagttccttcaagatcattcaaattgtccttgatagagttgactccattatggccagggattttctggactgcagatatttttcccaacacatggcatttaacattgttggctcggctcttttggtgatgctttctttgattggtctgatgcttctgcctatgaggagctgatgatgacggttgcaaaggatgcttgtttctgggcttcttatgcagttcccccattttggaaacctgattataggaggtacagaacactatgtgctcgattgaagctattaacacaaggcatcgttgcaaaatcaagaaaccaaaatggtgtacttagccttattgatctgagttcctgtcagagaagtgaaaggatgataaaagatccatgcagaggcttttctctgcttgatggtgtgatttcaagtcgttgtctcaacgaggcagctgaagggcctctcagctcagaagaagaaatatgtggtaacattatgggtttaatgttgcatggaatttccacgtgtgctaacctaattggcaacatcctaacaaggcttgccttgtacccaaacttgcaatgccaggtacacattatttgctttatttctctgttgcaaacaatcctggttgctctttatgtgatgattggtgcttgttactgcttttttgtttcaataggtagttcctttacctaaacagatctctcccagttatatatatgttacaatgttgcatattgtccagtattgctccttgttctttgcttatgcaatatatttctgcccttcatgtagtatcatgatagtctcaagttattctggttttgttatagcattcctttgttaatttgacaaggctgaacttgtttcttcatttatcttcgttgacatggaaactgcttctttcaggcggttgcattgtatttatgctgtttctctgacttacatgtgctgttttcctacagctgcattcggagatagtttcaggtcacagtgaatcatctgagcttaagatagatgatgtgcttaggatgaaattcctacttgctactgtatgtgaatctgctcgacttttgcctgctggacctcttctccagagatgttctttgcaacaaggtatacatatcttttcaataaaacttaaaaagtaccgatcaatgaaaaatgaaaaaatattaatagtgtacatagcaccacgtttcataccctgtatttcttgaggccatttttattaatatataaattttcttatatgtcctgaaatgtcatccatatcatattatcatatgattttaaatggagatgtcttttcttcatcctgatcttgctgtactgtattgagattatgctttggttctgaggttccttaatatatccattatccagttgtaggagaaatcaggtgtacttttatttcatttatttttagctcttgtgtgaagtgtgagctctagaccttttggattacctgctgtacattattgatctccttacaatttccttgagtgcagatgttaatcttaattccagcatcacaataccagctggagcaatattggttattcctttgcatctcgtgcaaatggaagcttctacatggggaaatgatgcttgccagttcaaccctaatcgtttcctcaaaaaggaaattaattttgaaggtctctccctctgctcccttcattttcctttccgcttgttcatttgtgcattatctcaatatgttttcttcttttacttgttttactgcagagatattagcggcagcacataaaggctcaaatgggatcaacctcttcactgacgagtgtgataagactgaatcattccttccatttggctctgggagtcgagcatgtgttgggcagaagtttgcggttcttgggatcgcaatgttgattgcttctctgcttcgcagttacgaggttagatgtgataattttttctgtatcttggcatggccatgtgaagagacacggccacgaactctgttatttattaccctaaaaaaactgttatttatttctattcactatgagctcagcgagtttctttagaacaattcctgactaaattatggttacaccccccttgagttataaaatttggcccttattaaggttgtattctaaacttgtgatgttgcttggaattcgaacctgcaggtacaacctcatccagctttatcccaagaaatggaatcattagttgacagcaacagccttcaccatattccgaacccaaagatcatcctcaagaaaaggagcatctgaagcagcaccttgacaaattaaagcttgacgcatttacccttgattacaatatatgttttttactggtggcatgccaggatatggtctctgttttttttcagaagcaatatggtctccaagcttgctttctttccatcgcagaaaccgcgacgtggatggttttttcctccagatttttaacggccccagtgagcttttctagacctagtttccattaattagcgttttgaggcacttgtgggcggttaaatcacaggaggtgtgtaccgatgtgcataaaccaatagtagcttcttcttttttcttttttttttccggttggtgttttcttctccttctggaggaatgtaatgttttatgatgcactgtatggctgtatcgtgcgcgggagcgcagaatctgttactgagtttagtgtaccatgtacctatatatatggtcacattgtattattgttgattgtttcttccaccgtaactggtgaagtttctcaaaaagaacattggaatttgtattgcctggtttgtggacaaaacatcaacaaaaaaaagagagaagaaaaaacctggtgactttgagtagtacgttatcgaattatgatattttaccatcgtcgtcgtctcatagtagtataccgtagtggtagtatactactagtagtgtgagtgtgtattattttacagagagtccgtgcttggattgcataggcgctgtttttggcttcgtctcgagctgcattgcctgcatcctcttcaaatcttcagagatgagagaggcaacggcgcagagcagccaagcatggacggagccagtcggtggtgtatacgtccaagtgtccaagccgaaagctgcctcaccatctccctatactgctttgattttttgtttttggttaattgtttgtttttgggatgcaagtcatgcaacctgcactgtggcagtggcagtggctagcaggcgagtgtgccgctagcgcgcacttcccacttaactatctctattagttaacattaataacagtaattaggaatttttttaaagattttatcttttttttagatttttttattaacagattgacaaaaatttaaactaaatttgaaacttttgatttaagattcaaattttaaagtcaaattttgaaaacttttaactcagatttgaaactttcaacttgacaagttgatattcgaaaactttaaagtccaggtttgaaaattttgaaaactttcagcttaagatttgaaaatttttaactcgagattcgaaaactttcaactcgagatttgaaaactttcaagttcagatttgaaaattttgaaaactttcaacttgagatttaaaaatttttaactcgaggtttgaaaactttcaactcgagatttgaaaactttcaagaccaaatctgaaaatttttaagttaagatttaaaaattactagtaaactaattatgattttttctcctacccgtgcgacatcgaactgtgaaaaaaaaaggaagaaacatggcggtagcaaatgggggatttacaattatgacactgcaaacattaactgcgccaaaaaaaaaagagaaaaagaaacacgtgtgtgggccggaagtacgcgttgacggcgcatacgcgggaattaggaattctgctggcggtccggcctgcacggtgagttaccacgttggctgttgatcgagagattctccggtcagaattttctctgagaaaaagaaatctgaggatgcccggcccaatatatggggcccaaaacaagcgagcttttatgggccgtgacgagtagccatcggcccatctccgctttcccttgttgaggtcaggaggccgtggcccgtgtgtgcgacatggtcgcacttccagccccatcttttgcttatcagccaaaatttaaatttttaacatttaatttagagttggttttgggatttttttcacctaagtttattttttagcctctacttttggatcgttaagaatacgtatataaaagttgtattcacaaattattttttttatgtaaatatatgaataagccaaacgatgaagcctctcccctcgcccatctcccgacggtcgtctcctccttcctcttaggctcgtcggtcgccaatccccccatctcccgccgcgcgcccgccgccgctccgcccgtcaccaccctgcccggcgtctaccacgctaagatttccgaactacggtatggtacgccgccgctcgcctgtggttactctactcatcttctcgctttcatatactattgtcggttatttttgagtatcctttctcctgcctcctccgaggagaaagtgtgctatttccaggggcagattgtcggatcggcggcgactattggaaccaagaaaatttgggaatatttgggagcccttgggcatatcattattctagtcggactctcaatgctcatgtcccccccacaaaagggcagccgaacctttgtcatgaacaacaaacacgagcattgggtttcttggcttcctaggcgcataaagggctcttaacttcgttgctgcataaaagagtcaggtcgtaagctttgggctttcaacatagcagcttcgctgcagaaggcaagtcagattccacatggagatagataatggacacacctttgtaagttcttggtttcaattataagtactacatccgttttttaatagatgacgccgttaactttttctcacatgtttgaccattcgtcttattaaaaaattttatgcaaatgtataagatataaatcacacttaaagtactatgagtgataaaacaacccataataaaataaattataattacgtaaattttttgaataagacgaacggtcaaacatgtaagaaaaagtcaacggcgttatctattaaaaaacagagggagtattctttagagttttaatgcttcaagccactaacatattttgtgtaatctaattattgtagcaagcggaggagggcgataggctcagcaatctacctgacgatattttgttggatatcttggcgagactcaacattagtacggttgcaaagacaagcgccctgtcaacgcggtggaggcacctaccttggtagttaactaagctggatttggatgttgcagaattcctacatgccccagcgttcagtagcataacgactgtgcacatggatcaagctatgtcagctctcaccaaagcagctacgagtttgctatctgtgccacagagagacacctccatcagaaacctatgcctcaaactctacatgatgggcagccactcaagcaatataggatcagtattaagtcaagcaattgaagctgggatagtaaaagaattggaccttgctgttttgcacgagaagagacatatagattgcaatgacgatgatatgcttcatcaagccagagctgtgaaggtctttgctggtgcttttcctcgtgtgatttgttgcatcacaaggctctctctgtacaatgtgcacctcgatggagacattcatcgtattcttttcgattgttgcactcagttggactatctgaatctcgagcattgcgatgatgggagccgcgatgtttggaagataaatgcgccaaattcaaagctccggcatttggagcttgcagtgtgcttctttgggaggctcgatttagtctgcctcccaaaactcgagtacatttactgggaaatttggttcactccttatgcccccttgtcattcggctcagtcccaagccttagggaattacgtctcgcatgtcctgcccaatctgacttccaaggcttgaagttaagcaaagttttacaaggtgtcccgaacttgcatactttgacaatagatttccaaggagaaaaggtaattgcataatcatttgttatgatctgcttttctattattggtacaactgttacgttgcggcatgttactcagaatgaggatctagcactaaaatgctgtgatagtttcagctggctcagttcaaccacttaggtgtatttaccttcaatttaaaaatgagaaaacctgtgaggtggtcaagtgtgcaaccacaccctcctaaattttggtttaacccctcttttgcttgtaattgcccgcaaggattttattatttaggagtaatcttgtttgtgcaatggattcatatatatttggcaatcactcacgtgcttcatttctgccttttgttttttcagttatggatgcaacctgaacaaaaacagctctgccctgcattcaacaatctaaagaagttatctattctttgcattcatgttgaatttgacctgttatggactataaacctccttgaagctgcaccatccgttgagctcctttgtattgatgtaagtttcctttttttttaatagagcgcaacaatagcatatgacagtaactgcaactggactatcattatgtgcacaaattaacataaccaagtgctcatactaaatgtagacctgggaacatgtatgcttggtaaacaaagaggatgaagatggaagaaagcttgttcatggagaaacaacacatccttcatgggagatatctgagttcactggcaccagaaattggcaattgaaagaactccagttcactggctttaggccactcaagcaacaattggtctttttaaaggccatcatggagcaagctcgcaacctgcagactgttattctgaaagaggaagaaccatgcgaggactgtgaggcattaggcaccctctttcttgtataaaagatcatgacttcccaaagtcgaaggatgagcaagacaatgtagtcgagcagctcagagagaagatttcttcggattcgcaaataattttccagtgtttgtaacatccccttcccaaattattttcctatagttttggaaaatgaatatatcctatgtacatccccgtgtacttgctacttgcaacggaggagttgtttgtcactgaataaatatctggaatttctattttagcttcatcctgatatccaaatacgtgtggaagtagttcaatgccatacgtactggtagcattaagaagaaccattgtaaatctaaccaaagatattactacctccgtcccaaaataagtgcagctgtaaatattcgtgctcaacgtttgaccgtccgtcttatttaaaaaatttgtgaaaaatttgaaaacatttagtcacacataaagtactattcatgttttatcatctaatagcaataaaaatactaatcataaaaaattttgagtaaggtgtattggcgatccttaaacttgtagggttatatcatatagttccctaaactctcaaaatgcatatccagatcctagaacttgtcaaagtgtatcatctgggtcccaaattaactcatcccctctaggatcctacgtgacgctgatgtggcaatgccacatggacgtgacgtgtccttttctctttttttcttcttttctttttagttttcttctcattcttttttttccttttttctgtacggtccacagcgaaaggagaagaaaggggaaaaaaaagaggaaaaaaagaaaaagaaaaaaattaaatgggtcccatttgtcaatcaaaataatgccatgtcatgtccgtgtggcatgccacatcaacgccacgtaggatcctgaaggggttgtggcgatttgggacctagatgacacaatatgacaagttctgggatttagatatgtattttgagagtttagggatctagatgacacaaccctacaagtttaagaaccgaccgtacactttactcaaaaattttcagataagatgaacagtcaaacgttgaacgtgaatagtgcaaaactatacttattttgggacggagggagtaacagataaaaataatcattacgtttatgttgccaatgaatctctctctagtcacttttcatcggcaaacataaaatgcctaccaacaagattagctaaaaagaaaatagacggtgtactacaacagcacataccactaggaatgggctgggtgtgaatctatcctaaaattactgctccttttgctacgaaaaaccccacaagttgagcccgtgggtcggtgtgcctgatgtcccacatcttgtcacgccctttcgatctcctgggtgcgcacatatgcgaattctccgcccaattccgcatcttccccgacgctctaacgccgccacctgatctcctgccccgatgcaccgcctcatctcttctccctctctcatggcatctgcagcggctagctggtggtcaccattgcttgctcgaggaggacctgtccgtcgtgtttccggtgtgttttcttgtcactcgacgatttcaatcctgactgatggtaccatcttatttattttagatgttgactaggtaggtgtctgtgcgttgcaacgggtaaaaaatatacaccaatttaaaatcacaaagtaaaatgatgttgaataattaaatttgttaggatgaaaaccttattattgcacgaacaataatttcatcacatccttataagttttcacaggttagtaatacaaacagccaaaaaattcaagaatagaatggcacaataggtctcttagggcacgttcaacggttgagcccgccatggactcttgaataggctatgtcagagaaaaacaatagttctacaaaggctggctttccgatcgtctctccactaatatgcagtaattaaatttttgtagcaatggtgtcgtgattttctgcattttggatctaaatacgtgacttttcttgaagatggactatacaacggccattggttatctcgtctgctcgtgtttttctcattgtgagccgatgtcaggccgattgcatgcaaaacatcgatgcatctccattcttttttctctctcttccacatcatcaaatctgcttccatggcaataaagagagcccactaattaatacctttgtacatgccctagtacctcctggccctcttccatagatcctgcacgcacaaataaatgaagaataactgtgcagtaatgcaggaagtaaattaagctgaatcaagttgtatagatgagataggtttatttaaaccatcaagattaatatttgtagcatcatggttgcatgatcttccaaattcaacctgtagcttcgatcgaaaccaaacctgtacaaatggtcttcccagttaaagaaatttcaggctgtgctacttatttcaaactgaaaatttccaacctttgaaaaatatactaatttaaatgagacaaccgatttaagtggttcatagctagaaacaccataccttgatttttcctaataattatgtaatagactaatagttaacagattgagccacaaaactctattgtaataaattgctagattccccaaatttaatcactaagtgcattagttacttgtaacggactcaatttcaggggaaaaatttttacgaaatattttagttgcactcttctcaattcttcttttgaagtgatcttgccttctcttaatttcttttaacttggatttagactttatttgcaaagttaatcgcgctcttttaaattttgcaaaacatttctattattttctttaatctctaactttggctctagattatttttcctttgaatccattcccgaacatctccaacaaatactatttcaattcccactcaaccatctctagagtacaggaaaagttgatacctttcctttggacccccaaatatttcccctttgaaatctcgttcatctaaattatccattcaagattttaaagtctactatttagcttgggccaataattcccgattgacccgactctttgttatattccattaaccattttatccttgggactaaaccagtataatttcctttttgctggaatttattctagatcaaacccttgatctagacctatctttagaaatccttgttctctttcatacaacaccttccacaaactcctctagatgttccacttcttctatctataaattaaaccgccagtttgattcccaaggtttgattctttctagcacaagaataatatttccagaataattgttcttgtgctaacaaaccttttcaatccctcctattcaaaaggtccaaaactcctttaaaacctatttaaaaccctcccgtcaaaattcccttagttttcaattccttaaattctatttaaatttcttgtccaaaattcaaaaggttcacaaatatcttcctttataatttttcccctttgaattctagtcaaattcaaaaagtccacaaacatttcttcctatagatttcatctcctttgaattccattcaaaatcctctacacaaaaattccaaaggtttctattcaaatcgggctgaaattcctttttcttctcccctcagcccatctccctcctcagcccaagcgacccagccccagctgagccgcctccttcctcttccctgtgggcctgccgccgccgccgtctgcaaccacagcgtcgtcgccgtctcgccccttccagatgtgccgccgccgacgccgtgctcctcttctccacgccaccgtcaccgtggccaagtcgccgactgccttcgcaaccgtcattcgccaccgcctctcaccgcctatataagaagacgaaccccctccattttccacacaccaatcgagctcttcgagctctgcctctctctctctctcctgccatgtccggctgccacctaccgtcggccgatctccctcaccggaattccactaattaaatccttgcgccatcgggtttgcctcgacgaggtgaactcattttcctagtttccccttcctttacccttccgaaaccaaccaccacagccacctcctcttgttgccagagctatactcttgcctgcgccgttccggccatctccttcactccctttgccaaccaccgacttccccggatgcgcatcgttcgggaacaccatcctctaccggcgcagtcatatcttagccaccacagcatcggcgcccttcctctcctcctctcggttccctggctaacagagaggaagaaaacgaagcaaggagagaagaaccggaggaagaagagacatatgacatgtgggccccacttctataaagtaaatctttttcctttaatttccatttcaatcttcaagcacccatgtctctccaaccacagatcccatcccagtgagaccttgacctaaattcttctaatttcaaactcttttgttttgatatcaaattcctattttaaaattttatttaaatttctttatttgaatacctttttaatttaaacctatttgatttatcttaaatacctttaattttaaatttcttattttatttaaaaaccttttccttatttatttatttatttatttactttctaattttaaattattttaattaacctttaaaaattattttacatccctttaattttaaatttcttgttttatttaaaaaccttttttaaattttaattatcctttagtttctttaaatacccttttctttaccattttaaattttatttatttaatctatttaaaacccctttttaatttaaattcctttgatttatttaaataccctttttatttctaaatcattcccataccatcccttagccactaaaaatccgccgatagaactttacgccttccatggagacgttcgtgtggtctcaaaccccgacgtcaaaccgttggtcgtaaatcctggcataacctaatcctaaggtcgaagtgttgctcttcgcaccctacgcctcaacgcgtacagtggtcagagcctcactactccctcgacctctacagcatgccacacactagctttcggattctgtgcgatccaagccgctctgctgccactcacggctgtagggtaacactttccacccacaaacctacataaaccctcccaactctctagtcgttgtgccacttgattgtagcatcgactagatgggccgatatttagccgttatgccttaacatcggctaaccactccaaatatctagccgttgtgctgcgttactctaggaccgactagaaaaccaaatccaccaaataaaccctacctatccattctatcctttctttgtttttatttgattcccaacctatagaaaccaaaaacctctcttttgttttcaaattaaaatttattttgaactcattcctttttcctctcgcctcgctccaattttatttattccttggctttatcatttctttgtagcaatttgcttataggctttatttgttatcttttcgtattcgtacattagaccgtacagtaagttttatcagtaacttggataaggaaatccgtctctttgatggtgtcatcagtgagtcacgtggtttaaagaggtcggtggttgctgtaaggagggattctttcatagatttgaagttcgaagtgggcgcgtttccatccagtttcgaccagcattatgtttccttcaaggagaaaatccatggctatgatactcaagaaataaagactgattttgcgttaatctcagtaaaggtgacttggtcggctttgctttctggactagagtgatacctctgtttctgtaacagagtgggccaagagtggctaaaaacctgcggcttactaaacctaggtgcggcaaacttggatagtaaagtattgtaataaatctgtcattgtaattaagccctccgtccctgaaaaaaagtacttttagtaatgcatctgaataagtgtttgttgagatgcatagtcggtcaatctctccgtccctgaaaaactgaacaagaacttttagacatgcataattagtttcgtctctgtattattacttcagcactaggggttgtattaattatatggaggaatcttcaaggcacaaccgtagagtggcttctctgtgatttctgcatttctgaatcgtatgttttgtggttatagttatggttttggtactagtgcatacacgtaagttctcattttatcacaacttttgcgacactatggatgtgcaaagtttcaaaaattttcagaacatttgtgccattttcacatatgactagcttattaagtcgcgcgttcgcgcgactataacctttctttctatttaaatgtgtggatacgttgtttaattagtttaaataagtgtctgtgaaacatactttgcaataattgcagctataagggaacaaatttatcttgatctttttcatgaatagcattattataaaaataaattacttacatttatgaatgtgtcatttgtaatattgcaagtagacttgtaatatgaaatgtcagcccttctttcggcttaacaaaatagtaacatgtactctgtaatggctagggttaaaaacttaaggtttctattcatcttcgccattgtttcgctctcactatgtgtgcaatcataagctctctttctgttgcgcctatcatctaggcaccatattcgctgatgcactaccccatcctcctcttatgcatttcattcatcctcttgtttagcaaatttaatttaattttaaagtaaattgcgttgacggtacaataacttggcaggtgggtgcgattaggtgtaaaaacttgaaaatacactgtccagcgtagcggtacaataacttggctaggtgggtgcgcccatagtgcataagttgccacgtaaacaaaaattgccatgttaccattccaccttatcacaattgccgcatcggctttgacacgaaagacctatctcattttatagaaaaccacttaatatcatttcttgacgtacacatatctcctttcatctttcttaacgtgatcttgaggtggttgcgctggtggcggtggcgacgcagcggcggtgttcaagccctaaaccagtaaccaaaccaattcaagtgtcgacgtgatcgctgcaagctttgggatggctccgactcggcgagtttttggagcatctgctccttgttttggtaaatcacttgctgatggttgtagatttctatttcttgttcaattgatggatggtcgcaaagacatcagccaacactgagaagtggcacttcgtcagtcccaaaatagctcaccagatttgctaacccctgcaacccttgcagcttgttcttcagaataagctcctagaaaaagcaaaaatcagatacaagataaaataaaagtgcaggtaatttgtcgtagcttcaaagtcatgctagtgctagtacagatgaggccgctgcaacagctgatttgagtcccaccgagggcacgaccaccatcgcttgctctgaaaccttatgagtgatgatcgtcgccgccaactgcgagcccaaaccgtcgcggactatagtagtgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacagttggcgcgccaggtaggggttgcgtcaagcttttcgccgatcagtgcaatgggtcccgtcaccggcatcgacgacctcgtcttcccacccgggcaggcgtttcggttcggcagcctcgacttcatcaccagcaacttcggcaagatttctctccttgactcggaatcgaaccagtcgggagagaaccggatctcagtcccgtttggattcccaaacgcggctgaaacctacttcaagaccatctcactcgagtcggcttcaaaccactcggccgagatcgcatcttctccaacgacaccagatcaagatgatggggcttacccaccagtcctgatgaagctccccgacgatttagcggccgtcttcaccacaacagcgtcttcatcccgtaggcctaggcggaagtcagcttcaacaccgatttcgcctagcttcagggaagtcggcgtcatcctccaaccactcggcacggtttcgacggatcagctagatgactacaacagctctcccaccgtcgactcgcgccccaccgacatcgtggagtacgatgagtttagctctcgctaccacgacccagatctcgacgacttcgacggaagcctagatgacaactacacccctctctactttggcgttttcatggccaataacgagacggaggagcaacgccaagcccgggagactgaagaacgtcgccgactggaggaggagcgtcaagcacaagaacaagaacggctacggcgtgagcagcaggaccgtgagcggatcgccaaggaagctgaagatcgacgtcagcgagctttggaagcagggcgccgagcgcgtgatctcatcggccaacaagacgtcgaagggacgccggttttccgcacccctcagcagaatgcggttgccgcgatcaccctactcgacaccctcctcaaccaaaacgagctcaatcgatccgaccacgtcgtcaacatcttgaaccagaccaagaccatgattgcggcctcggttccagttaactctgaaagcgtccacacgccgactggtagccgagttccacacttccggtctcaagactaccgtcatccaagcctcagcatcaccggcgcaggatccaatcgcaggagcaggggtcacgacgagcggtctgttcactcacctcccgaccttcatagggagcgccgagtggaacggcctcgctcaccacctcgtcgccgccccatcgatcttcgcgatacaatcatacagcgccgagcagctcgaggctaccatcactcgctggaccgccacgacgacgaccttgacggagtagcagccttcaccgacgacctgcgtcgagtggattggccagccggcttcaaaccgactggaatcgagaagtacgacggtaccactaacccagaatcgtggcttaccgtctacggtctcgcaatccgcgcagcaggaggtgacaataaggccatggcgaactatttaccagtggctttagcggattccgcccgatcttggctccatggactgccccgtggtacgatcggatcttgggccgaattacgcgaccacttcatcgccaacttccaaggcaccttcgagcgtcccggcacacaatatgatctctacaacgtcattcagaaatccggagaatcccttcgggagtatatccgacgattttctgaacaacgtaacaagatctccgacatctccgacgacgtcatcatcgccgcattcaccaaagggattcgccacgaagaattggtcggcaaatttgggcgcaaacctcccagaacagtcaagctcatgttcgaaaaagccaacgagtacgccaaagccgaagacgccgttaccgcatcgaagcagtcgggtcccagttggaagccgaaaaatacgccggctacgggaggaggtggaagtaacaatcataaggaccgcaagcgtaagcctgaggaacttgttgcaaccgccgctcattcttctcgacagcgttcgcgcgtcaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatattttcggcggccccatggcttatgagtctaaacggaagcaaaagttgactgaacgggagatcaacgctgttcaacccgacacgccccagtatcttcgatggtcagagattgcaatcaagtttgaccgctcggatcatcctgaccgagtggtccacccggggcggtaccccctggtactagacccagtggtccgtaacgtcaagcttcgcagaaccctcattgatggcggcagtgcactcaatatcctcttcgccaaaaccttggatgatatgcagatccctcgctccgagctgaaaccaagcaatgcgccttttcacggagtaatcccaggattatctgcaactccactcggccagatcactcttccggtcacttttggcactcgggaaaacttccgcacagagaatatcagctttgaagttgccgatttcgagacagcataccacgccatactcggacgcccggcgttagccaagttcatggccgtcccgcactacacgtacatgatgatgaagatgcctggtccccgaggagtcctatccctacggagcgacattaagcaagccgtcacatgcgacaaggagagttgcgacatggcccaaactcgcgagatggcgtctgcccgagaggaaatccgactggctgcaaccacggtgagcgaaggagaagtgcccaccgccaagatttcaaaaagtggggaaaccgaagccaagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgtcgatttgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattacactgatctcaacaaatcatgccctaaagatccttgcgggttgcctcgcattgaccaggtagttgactcaaccgctggctgcgagcttctcagttttctggattgctactcggggtatcatcagatccgactgaaggaatccgactgcttgaaaacttcattcatcacgccttttggggcatactgctacgtcaccatgccgtttggattaaaaaatgcaggagcaacttatcaacgtatgattcagagatgcttctcaacacaaatcggccgcaacgttgaagcctatgtggatgatgtagtcgtcaagaccaagcaaaaggatgatctgatctcggatctagaagaaacctttgcgagcatccgtgctttcaggatgaaattaaaccctgaaaagtgcaccttcggagtaccgtcagggaagctgcttggctttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaactcctcaccaagccaccggtcttagcttcaccacacccgcaggagccgttgttgctgtatgtatcagccacctcccaggtcgtgagcacagtcttggttgtcgagcgtgaggaagaaggccatgtccagaaagttcagcgaccaatctacttcgtcagcgaggtcctcgccgactccaaaacaaggtatcctcaggttcagaagctgttatatggtattttaattactaccaggaagctgtctcattattttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgctagctgattttgtcgccgagtggaccgagtgccaagaggatacccccgcggagaaaatagagcactggaccatgcatttcgacgggtcaaaaaggctttcgggcactggagctggagtggttttaatttccccgactggagaaagactaagttatgtgctttggatacatttttcggcgtcccacaacgtcgccgagtatgaagccctccttcatgggctacggattgcaatttccctagggataaagcgtttaatagttcgaggcgattcacagctggttgttaaccaagttatgaaagagtggtcctgcattgacgacaacatgatggcatatcgacaagaggtacgcaaactggaggataagttcgatggactcgagctcagtcatgttcttcgacacaacaatgaagccgccgacagacttgccaattttggatccaaacgtgaggcggcgccctcagacgttttcgtcgaacacctttatacaccgaccgtgcctcataaagatactactcaagatgcggacactcatgacatagccatggttgaagccgactggcgagagcccttcatacgatttttaacttctcaagagctccctcaagataaagatgaagccgagcggatttcaaggcggagcaaactttatgttatgcacgaatctgagttatacaagaaaagcccttcaggaattctgcaacgctgcgtatctttagaggaagggagacaattgctgaaagacatacattctgggatatgcggaaaccacgctgctgcgcgcaccattgtcggcaaagcttaccggcagggttttttctggcctactgcagtatccgacgctgacaaaattgtgcgcacatgtgaaggttgccaatttttcgccagacaaattcatctaccagctcaagagttgcaaactatcccgctgtcttggccgtttgcggtttgggggctcgatatggtcggcccgtttaaaaaggcagtcggcggttacacgcatctctttgtggccattgataaattttccaagtggattgaagctaagcctgttgtcacgattacagcagataatgctcgtgatttcttcatcaacattgtgcacagattcggagtacccaatcgcatcatcaccgataatggcacacaattcaccggcggagttttcaaagacttttgtgaagactttggaatcaagatttgctacgcctcagtggcacaccccatgagcaatggacaggtggagcgagccaatggcatgatacttcaagggattaaagcacgtgtttttgaccggctaaaaccctatgccggcaaatgggtgcaacaattgccatcagtactttggtctttgcgaactacacccagtcgggccacaggccagtcaccttttttccttgtctatggggcagaagcaatgttgccgagtgaggttgaatttgagtctttgtgctttcgaaatttccgtgaagaacgctacgaagaggaccgagtggatgacttgcaccgattggaagaagcccgcgaagcagctttaattcagtcagctcggtacttacaagggttgcgacgttatcataatcgcaatgttcgatctcgtgcctttctagtcggcgacctggttttacggaaaatccaagccacacgagatcggcacaagttatctcctctatgggaagggccattcattatctctgaagttacccggccaggttcatatcgactcaagcgcgaagacggcactctcgttgacaactcttggaacattgaacatcttcgtcgtttctacgcttaacttcatcattgtatttccctattttgactgtcaacatcaagttttcttcttgccgttgtcagtcgggggctatcatcataataatggagtatgattttttatcaattcagtttgcttacttggtttatcattgccttgtttggtttttctacttagtttgcgaggactgaaagtttttaatagcttctttgggttttaggctcaaccaagcttagcaaaaacttttaagaaatcaaaaacttcgcaagaatcatcaagcacagcataaatacaccagtattgtacaaattgagcctccatgtattacatccaaactcaatcagagtcagtcctttcgtcatcagagtcatcattactcggctggaggtcgttgttgcgaaattgttccacaacatcactcgcaattttgtcagccgcagtttgcgcactactgataagatctagggcagcttcttcacttgtcccgtctgcaaacccatcaatggtgtcgacttcaattctcgggtacaaggattttgtcatcgccaaggccatgccagctcccatgcttccagccttcttgatattcttgaaatatacttccggagcaacactcagcttgtcaaatatttcggttgcgtcgagtgtactcggaccaccattattgaggaacatggcttggataattggtgcagcggcattggcgacgtcatcccttgctccttcaagcctcttgatcttaccaactaggacgtcaaactgagcttgagacttgattttccggtctacaaaacacatttataatcagaatctactgcatttaaaagaggaaagttcagatcatcagccggcagtaccttcaacttctttcaaggctgagtccctttctgcagccagttctgttttgtcttttttcaaggcttcaatctgtttttccatctgagctattctggtggcttgcgctgtttgaaatccaagtgtttgaggatgcaattatgacagcataaatcaatggaacagatctggatgattacctttggatgaaccactcagctcatagtttgaatcttggagctgagcgattcggtcccttaactctttttccgtctttttggcgcactccttggcctcatgcagctggtccctaactgcttctagtgttcccaaatgaggaaccagcttttccaaagttgtagtcttggcctcattgcgaagatggattctctgcatgatggatcatggttcagttctgctaaaaagaaaacaaagttaccgaaggccatcactcggaagacttacgtttacaatacgagtggcttctccgagcgctttcttcagctggcacacttcttcatcttctttctgacggtttatgactataccggcggcttgtgagttctcgtcccaccatttgatcaagataggaggacgagagtcgtcggtcgcctttatgcgagggatttcttctccgtcatcacctgatggtcctgatgtgtttccaagacattagacgggtacactgaggttatttaaatcgccattgtttgagaagacaactaacctgaagatgtgcctagctgggcgtgaggtgatctttgttctttacctgaagacccagctatcgagtcgttaccagcctccggtccttgcgaagtcgtcgtctgcgcttctacttcgggaatctcttgatcagggcctgcgtccgactggtttccagtcgggggctcttgagttgttgccgtttcagttgttgccgactggtttccagtcggcggcgggtcactcggattggctctatcgcacgaagcatgggcgccagtcggctgactttcagcggtcggctggttttcagcagtcggctcggggtccttggatatactctgctctgtcatggcaggatcggggtcttttccagatggatctatatcagatggtttcctgcaaagtgttctttcggtattcagcatcatttttatgagcaaaacatgccgaagcggaatcatatcgagagatctaatacctggaagatgttctgatctttggcattgcacggccggccagttttttcctgggcatggtacgctttgggggtttattaggcgaacctttatccccagatttatcatcgtcgccttcatcatcatcaagtaccagctttctcttgcgaggacctgtttgaccagccaatttggaagtctgaggttgcggatctggtctgattgttggccctccacctccctgagtggtgtgttggcgaggagaccggcgctgagagattggtggatctgacttcatcaatgcatattcctacacaagatgcttccatagttagtcaattcagcatgaagataaaactatgttctgatcatggtttgagggtttccgatgcatacctgtggaggcggattgaatgcattatatggcacgactggcagttggtgagagtagctgactacaattgcatttgagaagattttgtacatcctctccttcatgattttgaaatccaaggagtctggttcttcacggttgggatcatgtttgccgtcgaactcgaatgctgtgcgggatctttccttgattggcgccagtcggcatttgatgaagtgccgagtgatttgctctccctgtaagccttgttctttaaggtttaacatacgatccaacaactccaaggcttgtactgcttcatctccgatcggaagagagttccaagtgtcttggtacattggaggaagacaagagtacccgggaagagcaggctcgggattctgaacatagaaccagttcgcatgccatcctttgttcgaagtcttgaagggcatcgagaaatatttttggcttagagttccccttagttggaatcctgcccccccgactacacacggtttgttcttgtttggttggggtttgaggaagaagattcggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacgatctcatgagtatccggagacgggaaagcctcaccgtgcgctggtcgccacccgatgatttccttggcaggaagaacgccgtgcgccaccatctccttcagattttcttctgtcacgtcggatgtcgcccattggctttcgaagctttctccctcttccgccatcggtttcactcaaatgtgctgatttgattcgagggatggcttgggagaggtgagggattgaggcggtggatcacgggaaggattttgatgcacttttttgaggtggatttggccggagttgtgaaccctagttcgccggcgcagctttgcactgtagcagggagtggggaaaatggcgagagttccggcggggaagacgaagcgtcgcttggatataggatttttcagtttagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgctcaaatcctttttatgcggtcatataattctttggaattattgcaatgcaaattaaaaaggtgcccgacagaaaggcgttatgctatttttgcaagcttttttaggctacaaaagctgtttgggttaactaggaatgacttgtttttattatagtcatttccttggcgtgttatatgcctgttttcacggtaaatagtcatggcctaggctatttgacttttttattaccataatctttataatacttgatgggtaatctttagagtttttatattcggatacctgtcaagtgtgttcattcgtgaactttttagagtgtaaaccactcggatttcttttattatggctaaaaagcagtcggctaacatgcctatttaggcgccgcatacgcttttgtcatataatgcacaactgtgttattattttgtctttcaactatatgtttagtttgttaactaatcacatagttgggggctacacctaattaggtgcatctattcgatgcaccatattctttttcttttcgccctttacagtccacttggcaggttttggcttgaagagttagaagtactcggattattatctttgagaaggctatgatggtcgactgcaaaggactcgggggctactgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacaagtagggtgaggcatagctcctgcagctgctggttgcttgtcgtgcgcgataggaggtccggcggggatcccctgcactcgtcgtgtccggcggaggcggcgccgctggctgtggacgaggaggggaacagggacttgacgttgtcagagactcgatctgcgcccagcgaatgtggaaggaatgagccagcagcggacgcggagctggtcatggcgctgccggtgttgccgaatccgtaggacgtcgaggtcgcctgctcggtggcctctggctgctccgtcgacgccacgtcgggtggtggtggggcctcagcgcagtcgatcggggagctcgtcgatggcggccttggcgttgcacatgagccagtcgacgaccttgcggggctggtcgtagaaccgaatggcagtgtgccagtgtgcgcggcgaggcggatgcgccggtccccgctgcgtgtcccaaccgttgtccctcttcaaggatccatcgccagttgtttactagccgcgctgccgctgccacgaccaccgccgtctccgcggcttcctccagatctttcccatctttctgccaaacaatgggaaaacagatgaatttgaaaaagaagtaactggaatataaaaattactatggacttttttttgtaaaatgagatggtcaatgctaatgtggcactttcgctgaggtggaacaatggcgtggcaacttttgcatcatgagcgcacccacctagccaagtttttgtaccgctacgctcggttttcaagtttttgcacctaatcgcacccacctgccaaggtcttgtaccgtcaacgcaaattttacatgcttgaatagatgtttggagaacctatttgataggaagtctagatatgacacagagaaatttattttgatccatgataaatgaatcgaataatgataataaattatttactctggctacattaaacctatggaatttatcgtaaaaaacaaaattataaattttcctatatgcatatatatcatgttatcatttttttctatattatgcgtatgtatctgcgcattctaccaaatttcttataataatatgttgtactaaatgtcttaggtattaatttatatctctagaatatgcctaattatttaataacattgacatatatgcattttgtaacttatggggttagtttgtagattatattttattataggactaaaatgcaaaaaggtcattacatccccattcccccattgtacctctacacttccacagccctccttttcctttccattgctgtagctgttcctcattcttttttctctcccgctaatctgttatctgtggaggactccagatgataaaatgatgtggaattgtttgaccgacttcctccttttacatcggacggttaatatccattccaccttttctttgcttcttaatccaatggctatgaattaatacatgacgtggctcagtgttgtgaaatcttgaaatttacttttcacaaatgtagatatgcacagtttatagtcgacctttagattcagtcctcattgtttcgcagttcatgttatgatagataagggctgctgaataataacctggtgatcttaaagtctaatcaattcaattgcctgctcaattcctagcttgcctctaaatattttgagagggattaccagggaattgaatgggctgctgctgccatagcatcacaccccaattttcgttcgggattaaaaatcatttaataatttattttctagaaattaaattaaaattaaaagcaatttaacaggtgaatttaatgagggaaataaaatttacttttaaaatcatggctggaaatatttttgtaatattctccatgccctaaaatagtctctagaatttcccgtggatttttggaggtcaagaagtatttttaaaagcacaaacatcacttaatcaattaattaaattgaaaaacaaataaaaatctccttctttctatttgggccatttggactaagtccacttcgcctcccttgggcccgtccccttctctcttctcccggccggcttcgtccctccctagtgggcctcaagcccgctagcctcctcccttttcctctaagtcgaattgacgtccctccttctttcgtgtcgccaacaggaagagcccacctgtggggctcacctttaacctgcaggcacctctcccgaaactgccggcgttccgtgcctcttctccgcaccccatggaattggtgcggacgcgggtcacctcccttcctccaactttttgcccccatgtcctgcactgaggccctgtttagttagtaaaaaaaaaagttttggctttatgtgccacatcgaatatatagacacacatttgaagtattaaacgtagtctaataataaaacaaaatgcatattccacctgtaaaccgcgagacgaatttattaaacctaattaatcagtcattagcaaatgtttactatagcaccactctgtcaaattatggcgcaattaggtttaaaagattcgtctcgcaatttacacgcaatctgtgtgattgatttttttttctacatttaatactccatgcatatgtacaaacattcgatataatagcgtaaaaagtttctgcgtgagaactaaacagggcctgaatcaaagagaaccaacactatctgtgcttgctgatgcatggtaatgtggactcttttgcggttctatactagaaattttgtggacttgattactacgagaaactttgtggcaagatcatgttatgttgaaaaccatccgtgtagtagtaatttatttactaagagaaatcttgtggtgataccaatacgttaactctaagtaatttatttactaagagaaggtgtacaaaccaattaggagtactactatcctaagtaatttatttactaaagaagagctgagaacgaactaagagtaattcatttactaagaggaggaatcaaattgagaagggttgaaaacaacctgggagtaatacatttacctggtgcagctgacctgcaaagaatgcaaacatcaaaaaagaccagcaacgcataacatggctactaaaagtataattacatccagaaagtatgagattgggcagttagccatgaaagcaagattgcattctagaaattagtcaccttcttttcacccatgctctattgaacatgcaattatatctgtgcttatgttaactttttctgtgacacactagattgaacctaaaacagtatagttaatgcttatgttacattgctggaaagcagcatgagtgaatgctttttaataagtaggctagcaccagattttatgatatctcaggattagatttcacaattattcatcattgttttcatcctgagaaaactaacgagtgaaagaaccttaaacatgtgtcctctcggctctcggccacagcaggaggcatatatgtatgaagcaaaaacatactagtcaataggcattaatcgataagcaataacgcaatcaacagtacggtagaggacatgcgcatggtaagaacgcaatcaaattaggccaagttttagttccaaaatttttcttcaaacttctaacttttccatcacatcaaaactttcctacacacacgaacttgcaacttttccgtcacattgttccaatttcaaccaaactttcaattttagcgtgaactaaacacacccttaaccaaatgatgtaaatactctacaggaaggaatgcccacaatccagcagtacggaatgccacaaccaaattcacacatagccacaaatcaaaaatcaaataaaatctagccaccaagcaagcacacgaccaaaaatatacatcgtgtacgatcctatccgtgctccctcacctcaccggccaatcccccccaagccctagtttccccacacggacacacaacattaattaatgcacgaacaatctcggtgcgccgcgccccggtgagttcatccccggccgcgcgcgccgctcaccatcgatcctcgtctccggaggaatcaatcgccttcaccgccg

SEQ ID NO: 56584 - DNA, 9875 bp, Oryza sativa
gcccccccccccccccccctccccctaaccgctctctcgtctcctccttcctctcccccaccgatcgacctccaccgtataccaccgcgcgcgagctagcgatcaacaacctcgctctccggtctggagaacaacacctacacaccatttcgagacgagatccaatccaggaaggcagattagccggaggagaactcactttcccatggcagcgacgaaggtgaccggtgacgattgcgagcgattcgctcgaggtggtgggggtttctggggtttctctctctctctcgtctctcccccttctctcacaagtcagaactcaccagcggtcgaggctatatatttgaattctcgatcgttcagatccgaacgtgcggcagcgatgccatcggctcaccgcggcgcacgcgggaatgggcccacctgcttacctttgtgtaattccggtttggctgtgcaggcgcggcaaatatgggaatttctttttactactttactgtagatacatctcagctactgttgtcgctggttgtaaagcagcactacttagtttctaccagccatgttaggggagtttctaccggccacagcttctcagataatctcagcttccctaaacaacccagattatcaaccagattttaaaaatttataattatagaatctataaaataattagaaatcggaatggataacctagcttctctagaaatagggtcttggttgtgttgttcccactcctttcccaactaatctcctcgtttttcgtgcgcacacttcccaaactactaaacaatgtattttttaaaaaagtttttatacgaaaaattcttaaaaaatcatattaattttttaactaatacttaattaattatgaaaataaaccaccgtgtgtttccattcaatcccgaacacaacctaaataaactggtttaattcgttagcatgtaaaaaaagtaaatttcacaaaactacagaatttttatcaaattatcactaaactacatatttagtgtgatatattataaaactacatacttaacactaaatttctcacataactacatctttaaggtggagtatcgtaaaactacatatttagtaacaaaattattacaaaactatatgtttagtgacaatttaatctaaagttacatgtttataactcaaacataacactagtgcgaaggacttaaactctaaaatctatagtttcgtgataactttgttattaaatctgcagttttgtgatactccactttacatctgttgttttgtgataaatttagtgttaaatctgtagttttgtgatacatcatcttaaatatatagttttgtgataatttgatcaaagttttgtgatacgtagttttgtgaaatttacttaaaaaaagtttcaattcgtcgatagaggttccctcacctctcccggtcgcccacattgcctgagcttgagcttaatcggttccctcaccttcctcttctttttctctggaccgtcatagccctcgctcttattgttgtagactttccagtgccactcagtcatctcctacgccggccgccggccctctccccgccaacgggctctagagaaagtgagggggagagatggagagagtgaataggtgggagtggtataagtccatttacatgtgagtattacatattttttttattttttaactaagataccacgtcaaccaaacattgattcgtatgatctgtatgattttattcaacccagttttaaaatatggggttcaaaaatctgattttattctccttaggtttccgccgccaccgctcacggaactacgatccgacacgccctcgccgctcccccgcccgctcgcctgcacacacactctctctctctctcttcatgtatgttgtcggtggatttcccggatcctctttttttttccggctgttcctaagggagaaaacgtgtgattttcggtatcgcgtgagatttaccattctgctgtagttgctagaatgctactccctccatatcaaaatataagtattttttacttctatatagtcttcgagatgttgcttggactaacaatatcttaaaaaaataaaatgttttaaataaaaatgttgcatattatgattgtttgtttaatgataaatctagtaacgtcaattttacatgattgagctttttttctattaatagtcaaagttaaaaatgtttgacttgacaatatgctaaaaatgcttatatgttgggacagatggagtagttgttattattacttactgcaattgaaatgatcataagtagtaggttaagttaagaacaagttggttttgtggttgtatgaattcgttccggaatgtttgggatgccaccatgagcttatcattgttagaatcggactcaacgacccttacaatttacatatcataaacaataagcaggatcgttggtttttccctacaagcattggattttacacttactagttttgttacaaacggcccaacacagattctccatggagttaaacaaagaacatatcctcgtaagttctgctctccagttcccgtcgtaataattatattttttcatttttattaccgatgctttaattcattaatttagcacaatctaattattgtagcaagtggaggatgaagatagactcagcatgcttcatgatgatattttactatcaatcctggggagagttgacatttgtacagctgcaaaaacaagtgtcctgtcaacaaggtggaggcacctaccttggcagttaactaaactggataaccaccgtgtacattgacgaagctatgtcaactctcaccaaagcagcaaggagtctgctagctgtgccgcagagagaaaccttcattacaagtctatgccttaagctctacttgatgggcaattactcgagagataaaggatttctattaagtgaagcgattgatggtggaatagtaaaagatttggaccttgctattttgaacgagaaggaacctgaagattgcgatgacaaagatatgttttgtcaggccagagttctgaaagcctttgctggtgcttttcctcgtgtgcttcacttcctcacaaggctctctgtacaacgtgttatcttcaccgagacattcatcatattctgtttgactgttgcactcagctggacattgtaaggcttagaaattgtgatgctgggtccaatgctgtatggaaaatagatgcgccaaactcgaaactccgacattctggagctttcgttgtgcagcttttggagattcgagttagcctgcctcccatagcttgaggaggtccattgggagatttggttctgttcctatgcccccttgtcatttggcttcgtcccaagcctcagggaactatttcttgcatgtggtgcccaattgggcttcgaaggcttcatgttaagcgaagttttacaaggcaccaaagatttgcatactttgacaatagatttccaaggagaaaaggtaattgaatatgtcattttgatgaatcattattatttttttatactataactgctacagtgagtacatgcttttcattactatgaatctgttaattcagttgtgttggacttttgcacaagtcatgaggatctagcagtagaatgctgtcatagtttcagttggttcagttctagtactacttaggtgcattcaccttcagtttttattttaataaagaaacaacctacttaggagcatgcattcttcattaagaagaagaaagacatctgaatttgagttaaaaggacaccaacctaggtggtgtgctgtgcatctacacctctcagttttggttttaattcctcttcactcaagacttgtaattgtccagaaggattttattattaggaacaaactgagactaacccttgtttgtgcaatcatttaaactcatcggtgtgctttgtttctgttttttttttctcttttcagctttgggtacaacctgaacaaaaacaattctgccctgcattcaacaatctaaagactttatctattctttgtgtttatgttgaatttgacctgttatgggctttaaacctccttgaagctgcgccatccgttgagctacttttcattgatgtaagttttcctttcgttttttcaaaatgtaacaacatgacagtaaatgtagctggaaattctcactatttgcaaaagatttacacaaaccaatttctcacactaaatgcagacctgggaacatatatgcttggtggaccaaatggatgaagagggaagaaaggatatctatggagaaagaacacatccttcatgggagatatccgagtttactggcaccagaaaatggcgattgaaaaaactccagtttgccggctttaggccactcaagcaacagctggtatttttaaaagccatcatggatcttagggacaatatttcatcgccatctcagataattttcctgtgaatcagtagaatttgtgttctatagccgcttcagagttctatatgtaaaaattttactgtgcagcaatgatcagctcttgcatgttaatattatattttaattttgagtaaattgtatgcgatctagtgcaaaaaaattgaaaaatgagcaataccagtacaaaaacttgttcgctttgataagcacatctacaaagcatgcaagtcattgttcaactgcattggttctccaatgatcacaagctgaatacacaccggcagccaactgccaacctaaatatccaaagacatacttcaaatgcatacacttcttttgaacacattgcgtaaggaccattatatattgtagtcaaaggtttaagaaaaaacagtcaaaagaatacgttccgatccatatcctcgtagcaaatactagcaagttgtcaatgagacaaagttcaattcaaatatggacgatccaaaaaaggattacatcaaaagtaaggtacactctctgcagtatgatcaaatctctcaaatcatcagcaaacatacaatgcctaccaacaaaagaatcagttgattgaagggatgaactgaaggagcccagttggagccagggggagcaggggagtaatcacctgaacccgagctcgtgctgaggacaacgaccacccaatctccctcattcgcgatcccaacaccagagaacttggtgtcattcagatactggttgtactgtgacttggtgtagttggtcagaaccacatcaggtacaagtccgggaacgcaggccggcatcacctgaccgtctccggtcaccgacgcgttgagatggcaatggtcgaggtactttgggtagtcggggaactgctgctcggtgccagggacagtgtttgctccggtggtgttggtgcaaggttggtctttgaattgctgtgctagctgctcagccaagcaggcagcattcttgttctcggatagcgcagggactttgagggaagctctgtagctgttgatgcccttgagaagctgtgaatcacttcctggaaatgggaagcagtgtcaaacaaacaatgtaaaacaatgattgtatctccaagttttcctgatttaacagtggaatagttgcatgcatatcagatctcgaccagcaaaaggtagaattttatcgttcgatcttcagcaaatgataatcgtaataagtactgttaacaaatgacaagtgtatgaataaatgcatctcaataaactatgatacttcatatgtcaccaaaaattttcacttgaaagaattttcattcgaaaccatatgcataaaaactgtgccatatgtacctaaacacatcaactccaatacatagcaattgtgacttaagttactgaaaaattttctccttagcagactaccactgagtcctccccgcaaaaaataaaataaaataaaataaaaaatctaccgctgagtcctaaacatcagatcttgcacatcaaaagctggatttgtacgaaaacagcttcccaaacaagattttaactcaaaaaagaggaccaagcaaacctcgaaagtggctcacaaatcatgaccatgtgactagttacatcaaaatgtatagaacaccagtgaccagatctctgaccagcacaaatgcccagtgcaaccgcttgagcgttttctaagcgatcgaacagagacaaactaattcgtacggattgaaacaagaatcatcttctgcagactcccagatcccatgaaccaattaaaactcccagagtaattctcaattgaatttgagcaacagggcagctaaatcattgcactactacacagcagccaagaacacgcactccagcgaatcagatccagacacactacaacaaacaaataatcaaaacaaaactacaacaattctaaccatcgaagcccgaatcagattgcaggaagagcagcgagagccaataagccatttttaccatcagatctggcgcaatgcagcaaggaggaagcgaggacgaggaagcagacgagggagatcctggaatccattctcgccgacacaattcctcgctgctgcagcggtgttactgttgcctcggccggggaggaagaagagtgaggtgcgaggcaggcaagaagtaggagaggagtgaggaggaaggaggcgagttgctgtcaccaaccacttctttttaattttactctttattgaatcttgattaatctttactcttccttccggtctgtcctaaaaactttttagtaaaaagtggtgataaatgtttttattagggtccttattgtatatttacactggcaagataattcgattacttttgtatcttgtaccttctgggccatttttcactggcaagtggtaactttttgggttacagcctagctttagcagttgtagttaatttgcttaaaaattattgtggtcacataacttcaataaattctgaaaggaactgtataacagtttttatttattatatatccaagtcaccttcattacattttttatatatttataaataaatagtgcctaaagaaggtctagaaatagttttgttcctcatgtgaaaaataattatcccaaggaggcattagatgctttagtagtcataaatttccctgtataaaatcacggaaaaattgtgaatgatgcataaataacggtaatgatgcatgcgctgagtacattttatttatttatacatacaggtcgatattcatatgaaggaaatacaaatacaataatgtagattctgagaaaaaatagccccttatttcacctgactataactctataagttataacacttattagcgataatatatatatatatatatatatatatatatatatatatatatatatatatatatatatattcttaacgatttaaaaggtagtattgaaaaataaactacgatgaaaaatatcaaaatcaatttaaaattaaattttaaaatttaatttttggttatggctacgagctatttgtgttttaagttaatacatgtttatggcatggtggtcgtatagtactccctccgtcccaaaaatacttaatgagaagtggcaatgaatctgaactaccctttattcagattcgttgttctagtaggggtcacatcccctcgcttgagtttttttcggacgaagagagtatgaccctgtttagattccaatttttttcttcaaactttcaacttttttcgtcacatcgaactttcctacatgcacaaactttcaacttttctgtcacatcgtttcaatttcttcaaacttcaaattttagcgtggaactaaacacaacctatatttgcatgggcccacccccattatattctctgtgcttataaaacaaacttcatatactctacgaaaccccaagctgtcggtgtttctcaagtagttgctacaacgtgatcatctgagatgcggccacaaataacaaatttattcttatcaggaaaagaaaaaagaagcattagttgaattaagccatggacaacgtgaaacaaataaaagaagaaaggtgcttggtcgatgcttttcatcatcaaataattaatttcgctgcgtgtgcgtcttctccggttggtcctgcactgacgttaaaaaggttggtgtagatgatgatgatctgtgcagcgagcgagcgaacggcgggacagagagacagctcaccgtgtggcgacggcgatggtggaaccgacacagcgtacgccaacactcaacacgacgcggcggtgggtaatacgcagcgccagtgcactacgtacgtaccttacctcattgtttgctaaattttaatttcagaattgattttaaaatttttttaatgtagttttaaaatattagtttcctgaccacatatttacccctatattataacttataatcagctcttaataactaaccaatggaagagtgaatcactgtgcagtcgcagttgagtcacttacacaggacatttaaactatttgccacctttaatatgtgatgtttaataatttattactcacaatctatgacgtgcccttttacatatctacaagtacgtagtaaattgttaaatgtccacttacatataagccccgctctaacttttgtgcagttttcgacatttcctgtgaatattataactgtaaactgtgtatctctataactgtgtacaaggaagcctcacccaacaatggagttgtggttcattttagcaatgaagggcttttagtacttccaattctaacgcaacatattgaacgcacttaactgtatgaatatatcggacgcactcctacatcccgctgcgatgcaagtcgaccacggattcacgacccagagatccttttaacccctgatacaattttttgccaagattttcctgactcgtatttgcatacactcgaaaaacaatcgcactggttccaaggctaaacatctgcattcatgctctgaaactaaatctctttataaatatcaaatagagcactaatacgagtaaagctaaaagccgatatttcttatctacatgatgagactacgactagttcacggttgttgccaaataaggttaatatttacatcacctacgagcaatctcggttaggctacaaaaggctatggtaaatatttggccaggcgacaataggctgagtttgttttcacttttcagaaccacgggtgccatgtcggatccatcatgcacaggttcctcgaagataatgccgcttccacgagatccgtgacgcctctttggaccgactgaggtggctcagatgaattctcctcctgaaatagggagagaaaatgctcccagatgtgaatataagagcaggtaaaatagcaggctataagctagctataaacatattttaaagagataaaggaagagagactcccaagaagtaatgtgtatatgacagataggatcaggtattaatagtatagtaagcaactaatgtatgaattgggtattacattggctatagatgatttggagctagcaattggctatactattaaacttgatctaacttgaatgacttgataatgaatttggacttgctaatgttactatccaaaatggttttccagttgattgaagatagcaatcctaaaacatagtactaactgatagtaggtgcgcaacaaggtgaaatcagtagggaatatagtgcagtattggagcattgctatcatgtgaaattgtctaactaggaacaagcgagtgaaacacctcggcttgctgaatatttcactttgtgcataagtggcctctccaaataacaataactaagtaaagaaaggattagcagtgatagcattatcattttaaaagttaacggccagctagggaaataagcatgactgaaatcggaaaaaatgatatatccagagaaacaaaaatcaagtttaaagaaa

SEQ ID NO: 56585 - DNA, 4425 bp, Oryza sativa
cacaaagaaaacaatccgattacgtaggaaaaatagaaagatgaaccacaagggacaatcctaatattaaccaagacggaaaacaattaacagtaggagtactatcattagcgcatcctactataattcactctttaaagaatgatactcacttttggtgaaaccacagactgggcagcagaacacatggcagacacaatgagaccttcaacaccgaaatttgagaagaaagcttgcatattgcgtgtcagcctaaagggaactagctcattgaactcaatcattccatttggatcataagctgcagataagcaaatgtgagtaataataatttcacgtgcattatttacaattactggtaataatcaagaagagtacctggatggaaatcattctggaagatcttgccagtatttttagcaaataatattttgttaggagccctaccaccaatctgcaacatgtacgacatgaaacaggacagagccacttggattgcaaactgtttcttgaaggtccagaggtgattcccagttggtagaatcttatgcatgtattgagagaagatattatcattaacgatatttttagtaatttcattataggcttgcaagcgtaattccaccactgcttcaggggacacctgccctgagatggcttgatttagctgttctttgaaaattgtaataggtgaatcagcttctctattatgtcgggcacagttaatttcatacacctccaggaaagtgctgtacatcaaatcatcctctaccatccgaacctggatcaagggaaattaaacataaggccaggatattaccttggaagctgaaataaaacagctaaacatgattattatcaggtatggaagaatggaaggtatttcacctgtgaccaaacaggaataatgattggggtgtgaatagcaagatggcgctgcctcgactctttatgtttgtcaaacattttgtttagtacacggaatagctgcagcattctctcatcactccgggcatttggagtcaatgatgtctgaacaataaaatggcgctgtgaaccatcagagccaataagtgtcagacgtcggaagctactaccgtgcctccggacaataggaatatcaggtccaactctgtccaacttgacagtatgatcaggtgcaacctcctgcaaaagacaagtaaaacttaaaactagcacatagagaggtgaggaaccgtgcgagaagcataaaactttcacaagactggctaaccatccatatggtaagagataatgatgagtgacatattgacttcaatactgaggataaaaggtaatcactgtgaccaacctgatctgtgaagtactgcccgggaagttctatatcaacaacatggaagtccctgagaattttactttcttcctctagctttaaaattgcagggaaccgatcctcaacattactctgaagaacattcttccagtgcttcaatctctcagtgagttcagcaagtgttgctggaaaagtagtagcactttctgggtcaagatcacgttcaaaatcttgcttgtactccttgacaaaatcaacatgcttgttaacagcatcttgtgaaaagcaagctcggcatacaccagaaagttccttcttgagagattgtggaacctcgcctgtagttgcagttggatacttgtagcagcggtgaagcaatgcattaaccacagcaagaagtctttcctcgggaagagtaacaaatcttgatccaatttcagacagtaaaacctgaaaccagcaaaaataaaaatattagcatacttagaaacacaaacaacgaaagttctagcactagattgttgtttcttcatgtagatttcttcaagattctgtaatcccaacaattcaaatcaaatagtccctccagtcccattacaaacaatattagatttgttgtcttgtttgaaaatataaggcatacatttaaatttagtgcaagcctttcccccaagtctaaaagtatcccatcctctcttggactcctttaaacatttatgcttgacaaccaacacataccaccattttcgaagcacttaatggaagggcaataaagtcattctcttatggattcctacttcactttttgtccctggccaaaatatgccttactataggaaccaaagggcactgaatatgcatggaattctgttctcttaaatgccagctttgctacaaaataaaattcctggcaagcatgctaaaaatttctattgaaaaaaaggaatgggcaaagaaagaaatggcttattctataccattgtcatacacgttggcctgtatgtatggtaagactctaatttaataaaaaagtaatggtcgtagtcatctccaatttcctaaaggtttataaaccactttgttattacttcttacctcaagctcattggctagattggtatgcttgctcctaagagcttccattatatcctttgcagcatcaaatgcacttgctgcagaagttacccagccaagtccattattgcgtcttgctggcatttgcgaaccatctgcaccagttgaactcggttgaccttgatcatggccagcgcttgtaccaccctcaacattagatctgtctgactcttgtccttggagattacccccatcatgagaaactgccgcaccacctgactgggtagcttgatgaacttggttgtcagaagtcatgttcccacccccaagattagatgtcctcgcgttcccttcagataagttattggcagcattgtttgccagcatagcctgctgcatacgctgctgagctattcttcccatttcagtttttgtagcaacatcacgacgttccatcaagtatgtccgaagccaataatacaatgcctgcaagaaaacctctcagatatgcacatatacgagacaagaatatgcatcgtcaagttcaagaaatcgatatgaaaaaatgacatcacaatcacctgtggataaacttgggctattttcagcaaaactaatttgcagtgttgggcttcacttctctgtaatgatagcaataactgaggtatccacgaaagccaaacccaatggggcaactgctcaagatatttatccaaagcccttccagcaggttcattttgtgtatcgaagctcagaaggtagagaattcgtgcaagatggctccttgagtttgaaactccatatttgatgccttggaagaaacaacttacggcatactcaagccaaatctcatcttttgtctccttgaaaacctggcaacacacacacatcagatctggatgatgaagggatattattaagagcataaaggataacatgcataccatatcgcagtaattcccccagctaatccatgcttttggcaaatgcttaaaaagtgttatagcatttgaataagcaacatttgcattctcgcagtcattcatttttagcaggaagtcacctctcagacgaaatatttctgctttgttcttcacagggaaaaattccaaattggtgttattgattaagttaagaccactgactagttcgcctttcatctctaagtatgccttggcttgttcacatatcttcacaaatgcttcctgtaatcagattagaatgcaaacaggtaaataagatgatattgaacgcacactatgcagtactaaaaatttgatcacaaaggcaagtcacctgaacttccatggtagcatgaccatacatcttatcgagtatagttacacaaacgtcaggaagaccttgtttgcgagctatgtgagcaagcttgttcacattccaagctttgtctcggtaaccaagatgatgaagttgaggatttgtttggccaaaatctttgaatgcgtctattactgaattgtacatctcattcctccactggaggaggtcataccaaacagtcatattatcccattcattaggagttcgaagtctccatgtctcaagaatatccttgaggtcagcaaaggagttgtgatgattggaattggcaccagaatttcctgaagctggtttgttcccatttgcaatgtcaagcagaattttagaggattctttcacttcaaccaactgctgaaactgctgcagcagaggcattcgggactgcacagacatttcaggtaactgccaccattgttctagtgcaagttcaacacctttgctgacaaggttctcagcttcaccaacaccattagtacctttgtcatgaagagtgaaaaatgattgaataaggcgtaactttggtgtctcttctacctgagcttttggaataacattctccttcatatatgtccagtcaggcgccttccaaaggcagtctaagagaatctcgtaattctccacaccttttccaaaatcagccaatacttcccactgacctaattgagtggcacaagacaaccactgttcttcccaaa

SEQ ID NO: 56586 - DNA, 6422 bp, Oryza sativa
gaactcgagcagaatttgcagcgagtgtaattggctcattttcaactaatattgccaaaataagatccaggccttgcttcaaccagaaaacatcactcactgcttcccagtcctgggtctgtattataaactgcaatctagcaaataatgtttttccgacatagtcatggtaaagtttgaagaatcgcttcctcatttctgggtctttagctctaagtccaagcatgtattgcctctccaccttatgaaaatactcttgcctcaaagccatttgatacctgcataaaaagaccgtcaggaacactacaagatactaataagagcttgctgtatgtatgtacttacttagctgtatctccacagagtgagtaaagaagttgcaaatattttgcatcccattcttcttgtacagatgggggaaagctttttctgtcaactactgataacttctgaagataagctattatctcctttggattaagtgaactgacagagccagtagatgaagcaagtctgtagtcatcctcaatccaagcttttatcatgtccagtatgcatagaagaacgctaggatctgtgcctttttctgaaaggagtgcttgaagtgtttggcccatagatcgcctgaactcagaagaggccatcaccctctcacttatgagttttaagacggtcttcatgttagatatgaccatagggtctactgtggggcgtgaattaactgatgaatcctgttcaggcctctgtccctgagattatgccaggtcaatgccaaggtaaatggaccatcatgccaaatggaatcttgccaaaacatttactcatggtgttgatgatcaaatcacatagttaaacactaacaaaaaaaacatcctagatgtatctgtggatttttcatcttaaaaatagtaaacagttcaaaatgataacttcacataagaacctaacttacctatagataccaagacagaacaccaggttaataataatcagcacagtgaaaactagtcaactatacggatcaacaaagttaaataatatagaaatactgtgcaaacatacttgtcgaacatggttgccagcagaagatcccatgtcacgtgcaagacgttgcaggactcgaagaagcaaacctatgaacggatcaataaaattcttctgtacttctgcgagtgcgttgaggacaaacagtgcaaagcttatgatagagttagcattgctaggttcaagtgatatctggggagtggttacagcagcaagatgcttttgaatgagatcttgaactctttggtacaacaactttatatcttgtggtgttgtagctgcttcaaggggaaacgcgctgaataccatctttagcaatgaacaaagagacttgccagcatccaacattttgttgttgaagcaaggttccagtatctaaggaaaagagatcccagaatgtatcaaagagtcaacgtaagaaatatctgcattgatctccataaaatacaaatatagcaaaaagactaatccagagaataaggttcattcaagtaacttacttgagaaatatggttgatgttattccggatgaagaggcggggttgcttttctaagactttgttcataacatctaggccctgagcaagtgctgttgcaggatccttggactgagaaggtgtcaaattcccaagcaatttctcaagataattaaatttaacattggcatttggccagacttccaaagcttgagtcagtagatcaagagcttgcttgtacattgagctagattccttatcctttggttcaatcaccagcgacacctgttcaatcaacaaaactatatgagtattcaagacctcagatcaaaaaagttctgctgaagacactagtaaggtggcacaaagtgatcaacattctcattatatcagaaaggttcacatgagaggatggaaccactaataggaatgccttgtcaatccactactgcaatcaaatgttacactgtgctttgtctcttttcaggagaaaaggcaagccaggccgcatgcctcaaaagcaatcacaatgaattaggcaatgaggcaccaacaacaaaagcaagtaccatcagaatgtccagtattaattttttttaagaacattatcatgaaatctaatgaagcaacttgtaaaatttagagcataaaaggtaaacataaaaaggataatcacccttataaggaatgtaatgatcatctcctccatagcagcgttaggtttgtactcctcatctggttgcccggaagacccaggtgtctcgatattaggtattgatgcccccccaggcgacatcacgcaaaggggttgcaaccctggttcaactttcaccctcttactcaaatcatcaccaaatgtgggaacatccgatgagcgttttggatcaccgccaataacaggactaagcatatcaccaatttgactcgtgttctcactttcctgcacaactttcatctcactttgtctctgtctttcccacgccaccaccagtccagcaagttcaattgccagtcgtctattttctgctgttgtgttgtatggtagtccaagacggctaagggagttgaccatctggggaacaaaatgggctctgcaactgtagaagaggtctgcatgacgaacaataagctggaatatgtgaatcatgttgggaattgaatggccttcctccacaaggattttcttggtgtatctaatccatattggcatgcggctgtcccctggagggagtcttctaggaagggcaggcatgaggatgtcaagagcttgcttcaccagcagcttattttctggttggcatgtccgcagtagagcaataaaaacctggggaaataattcatcatattggctagctcggtgcaatgacctggttaaatgcacaattactcaggaagaatttaatgttatactacctgcagaataatcttttcaggagcttgataggcctctaagaaatgacacacgttcacaaaagcccattgcttgctggaattatcttcacgtttgagatggttccaaccgaactttatgagttcctttcgatggtgaacaagatcgctctgtagatacttcagaagtaatgttgcaagctgaaggagttctatcctcaagggttcatcatattcagcactgacctaaaaatatatacatataaaaaagcattgctgtcatggggaagtaacaaagagaaggctgacaggtattaaggtagagtggttcacttcccacctcttccggaggatcaagaagcttgtcaacaatagttttaataatagatggatcaacaacttcccaactttgcccattttggaaagaatgagctagcattggaaggataagtatctgcatagcaacgactaaatgatcttgtccataatgctttgactggaatatgttcagaaagtgattaagaataattttcttcaaatttggtgcatagccttcagcaacctatatggaaaatgtaaaaatggtaagaaacagaaagaactggagagcgacacaagtaactgtcatgaattagaaaaagaaatggtgtcacctctataacataaaattccttaagaaaactataatcaatgcggctacggtacaagaatattgatagcatatcaaatagcgcaccaacttccgtacgatcatgccttagataatttaggaagcattttatgagccgcttgctttccatcacctgttcagaaagtaagattgttaagatccaaaggtctagacacttgattagtgcagtatggaaagatgcaaggatgctaagaaactttaataaagcaatttattgagatgtaaagcacagataacatgtacgcatcatgtcagcaaaacctaaatcattgaattcaaagaaatcaagcgcataagagaaaataagcacccatactaccggacagtgtttgcccattgaacagaacatcataaaatccagaatgataatcctactagcatggcagagataacagtatataacagatagtagcagtagtaaacaaagatgccaaaatttaaatatcatgattccccgaaataattctatataaagaaccaagtatgcaacttgtccatcaactctaaatatcgcatcatgaatttaacatggcaattaaacaggtgaaagaagataaaaattacgtaatcggaacagggtagcaatagaaatacgtaaatctacgtaattggaagtaaccaattaggttaactatggaacccagaaatcgatcaccgatcaagtaagttattcagcttgagaactactataatttgttacccggataaaggtcactagcaattgaagagcagcaacaagagacaatacaaaaacacaaataaacgggcaatttacaaaggcacccaaagagaaaatgcaaaatgagaaaaataaaaggtaagtaggaacatcaatgactacctgcggtaaactcaattcctgctcattttgcaggcgatcaattcttgagggtgatttccaagcaagcaacaaagtgtcaaagacaacccggttgttacagagccattcaggcatcaattttacaagggttgaaataagttccagtccattaaagtaactgtcagaaccagtagccatgtttgatgatgattggcctgtaaaaccttcagttatggcaccagtaagtccctcatccttcactgaggaagattgattaccagcagcttcagtttgtgaatagaactgtgaaaaggcgctagcaagtattttttgaggcgattttgcaagctggtcccttaactccccagtatcagagcagattatgtacatgaacctgaaattttaaaagggaagtataatcagtctctggacatgtgtagatctgggtgttcacatgttcattaaagtataactttacagaacaagaagagcaagctagtgtgccacttatactacagtatgcatcaaaaataataacagcagggctcaatagctagtctcataaatcccaaggtatatgttaaaaacataaccagaatagcagtaatgatctaatacagactaaaagggaagtacactaatgtaaatgaacagcatgtgaggctaactgaacctttttgtaagtcttgcacaaaagtttcacaaagttgcagctaaacaaataagactaattttggtgaagtgcgtaccttctgaaatactttggatggcttaatcgagcaagaaaatagtcaacggcctccacggcatagcggttcaaaaattttgcaagtggagcacgataaggactgttgatttcactataaaattgatcttcaggaagtgccctctctaaatcaattaccaacgtaacaaggtcatccaaaaatttgctcgccgccgggggaagaaggtgaaaaagctcaatcatagctgcccaaaaaaaatagacattagttatataaactcctgactccaaccaaaggcaacatacaaagacgacagcaattggtcattttgatgtctgtaaacaagagaaaaattggacattttgaaccactttacaacaaggcaagacttgatccatttcatattatctagctcctataaatataagttggaggtgatggtacatccacctagatctttttgcgaatggatatgtgcatgcatatgtaaatccacctagatcttctatgaagcatttctacagtaaaattggaagataccgagagcacaagcatcatttggtacacatttgcgaaaaaaaggtttaagttctgtgtatcaaattagtacaataatatatgaaaagaatgaagatctggtttctaaatctcgtgtgatgtgtcctctttcaaacaaaatattgatagttagagaggaaaatgcaataaaattatgacagacctgcagctatttttggctcatctccagctttccaagatttttgactctgggcaagcttttctggctccagccattttttcaagtgatccaataacttagcacctaaagtgacattaaaccagtttgatagtaattcaagcagacgagccaatccctggagcaacggcatggtaagactccttgtatgtgctaagttaactaagatgggccttaaactgctttgcagaagatcttttggcatcctttgctgctgaacgacctgtaaaatgcaaatcatcaatgagaacatgctagatgctgcaagcgcaatctagaatttgaatttttaaagcaaaacaaaataaattagaaaaggaagaaaataaatattctctgaaattccatgtcaatataagaaagcaattgcagtaaacaccacctgacgaagtccctccttggcaacattgacaatctctgtagtcctgcatgtcagagatttgaagaacattgagataatctttgcacgtaagtcgctatgatttggagctttcagatctccccatgccattgcagt

SEQ ID NO: 56587 - DNA, 2189 bp, Oryza sativa
  unsure (1)..(2189): unsure at all n locations
tacataaatacaagtcatcattttggtatgaataaaaatccaaatttttaaataataaaaaggaggtaagaggcaaaagtttcaaacaataatggcatctaaatgcagctggacataattattccaaaaaaggcaacctacagattttagagagtatacgatcacaccgtttattgaacaataatgcggaagtttagcattgctatttgtggtaatacctgatttaccacttttatgcattaccaattagacatcaagagattgaatggaccacaagaaggctgtcactacttaataaaaataaaggtccatttggaacaagaaaccaactatagtccaaagaatggacatgactatgattgtaggttagtttggggaaaagggttaaatgaatacagaaaaatcataatgtgacatgttgtcattagtttacaagataacatggcatgctgaataataagcattaattaatttctgaaatcatgcaatgcagtactccctccgtcccaaaataagtccaattttcaccgattccacacataccaatacacaaccaaaacgactagaatgcccctactttatcaaataccaatgaaactattcttcactttatctactcccaatacaattattccctactttcacgaactccgatgcaatgattactctaataatgaacttatttattttgggacaaatggaaggagctaaaaatgaacttattacgggacagagggagtaaaatgtatcaattatgggagctactggacaatcccataactgcaattgaatgctaatcaatagtcaatacaagcctacgttgattttaacaatttcgatcacgacaaataactttgggacaatgtaagatcgatgatgtcaaatgtcagaagatgatcaagcagcgtgagcaaaatacataagtaatattaacaatatcaatactcaacatatattcaaaccaaccttcatatcagaagcatcattgcgacgccttgatggatccaaagaagatattagcagtgtcccaagaactccagggctcacaccctcaccgggtacattttcccgtaagtttaacaaagaatccaagcacactcgaataaactgaagagcctgtttcctgtagaaagcttccatactattaccttgcataactgcactgactgcaaagtgtatgcatctgtccagtggaactagaaacggtgttgcaggctcaaaagtcagaactaaacgaagtccatgttccgggttttccttgcattcaagtgcgaggggctccttcaaaaatcgcctatttcgaccccctagcttacctaacagttccaaggactttgtaccccatgtgtagggaggaggcctcaagtgagaccataaagcaagaatgacatcagacattaaattggccatgctaggttccaaaaaatcagggttgagactatcaatccaaaattctagtgtacgaagagctaagctcacaaggtcatcactccctttcagagcaagaacgagaggtttcatcaaacgaggaatgtgaggcagcaaagaactcaagcgagcaggtaatatcaggcaaagctccaaaatcaagtctcgcatatcttcactagttggtccatcaagcatggagagcaacatattgaggcaaggctgtaaagacggtataagatcacgcatcaatgaatcaaatttagcaatgttcaatgcacggaacatgctacggagaaggtgcatgtaaccaagaggtttctcaacttcagtggcactcttcatgcaaacttccattattactgggacatgtggctgaagagtgcgctcacaactttctggggcctttgctgcagcgacaaacaaaaagcgaaagagttgcaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56588 - DNA, 1163 bp, Oryza sativa
actgtttcagtttactgtaaatgtagtaatgcaagattgttacgttctataatatgtgcacataagtggatgtcctatttctgtgatcaatggatgcttcaagtcagaaatttccattttcattgttttaaaatctgatgacaggaacataaaactatcactttgctcataagccattttccacatttgcaaccaattgaggttgttggttcagagatgttgcttacttcctttttgtttgtcatcttgtagacatacttgcagtccatcagtaaaaggcttgaagagtggaggctccggcaaagagatatggaggagtggatgagacatcatcagctccctgatgaacttcaagatcgtgtccggcgattcgttcaggttaaatggcttgcaacacgaggagtagaagaggaatccatcttacaagctttgcctgctgatatacgccgggatgtacagcgccatctttgtttggaccttgttcgacgtgtaagttgtggttatttacttacatttcaactgaattagtagaatgttttagtttctgaaaggttttagatgttaaattttctagtggcattctgtcgtttggatggaaaaatcagtgacaaaagtaccaccagtgctacttcatagtctagcatgttttcttatcccttcctaaaatgcaggtcccatttttctcggagatggattaccaacttctagacgccatctgcgagcgtctggtgtctttcctgtgccctgagcgcacatacatttctcgtgagggtgatcctgtgaatgagatgctcttcgtcatacgcggtaagctagagagctccacaaccaacggaggccgcagcaacttcttcaactccatcatcctgcgccctggtgatttcgctggcgaggagctgctcacatgggctttacttccaaagaccaatgtccatttcccgctttcgacgaggacagtgcagagccttacagaggttgaggcctttgccctgagagccgaggacctcaagttcgtcgcgaaccagttcagaagactacacagcaagaagctccagcacacgttccggttctactcccaccattggaggacatgggctgcctgcttcatccaggctgcttggcggcagcaccagaggagaaagctggcagagagcctgagccgg

SEQ ID NO: 56589 - DNA, 1686 bp, Oryza sativa
acacaaacatgatataaaagacacatctttattatatcgataatatttacattattacaaaggcacttcaggcctgacaatcaaaaataaacagcagcggactagcgggcctacggctccatcttcacaggcgctcaactggggtataagccaggactccacctaagacatcttctccaaagcctctcttactgaagaggggaaagattgagcaagagtgagtacaaccacagtactcagcaagtcacaccggcagatgcatgattaatgcaagggggtacaaggggataataataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggctaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaatcacctaatgttgcctaattaatcagcgaagcatctacctaaatttatactagtggaaccatgaatagagtacccactagttggggttttgtttattctagggtgaacaaggtaataataacaatagcaataataatgtcttaacaaaggtaaataggcatggctaaataaaacagtgataacgcgggaataaaacgataatgcattaatttaaatcaaaataattttataaactgggattcaatatgctcaaggatgatgtgacttgccttgctcagagagaacggccttccgaaccttcggcgacggccgcgaaccacgcttcgggaacctccggaacgacgaagactacgcgaagcacacaagcaaagctacaagcctaaaaagaagcaataacaatacataaaaagaaagcacacggttctttaggttatacaaccattaggagacttgaacgggtcgattcagagctcgtatgaccaagatatgatc

SEQ ID NO: 56590 - DNA, 7985 bp, Oryza sativa
ttcctgcagccctacgtcaccgtgccgagggaggggacggcagcgccggctgacgcacgggcatggcgaaaggggcagccggaggagatgccgccgaggaggaaggagaagccggcgcgggcgacggtgttccggcgaaattcgggcgaggaggaggtgatgccggggatgagggcggcgtcgcggagccgagggaggtggtggcgacgtcgaccggcgctcaggcagggagatagaggcggctggaggcggccgacgcggaggaaagggaagggcgacggcgggaacgcagctccgggggtctccgcgggaaacggagggcaagccgggcaaggggaggcagctgctatgctggaggaggcgacggcacgaccggaagacgctccggcgaggagggagaggcggctggaggcggccggcggcacgggagagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccggcggcaaaggaaggcggccggacttggcgcgtccgttcccggcgattgggggcgccattcaagggggaattaagggggaaagagagaggagggaaaggggtttaattccccctaatcaatttgggaatcccatgcttgaatcgcgcggatttgagggaggaatggcgctagggttcacgggagagggagagaggacggccgggcgggaggaggacgatgacccgcctgacgcgcgggccccacgcggccggacgcgcggtcagcgcacgcgcggcgcgcgtgtgcacggccggctcggctcggcctggcttgggcgcggcttgggccgggcggccggcccaggaggagaggagggggaggcggcctgggagaaagagggaggaggagggagtgggccgggaggggaagaggggcccaagaggaggagggagagaaggagagggaggagagggagacttcggccgcgggccgaggggagagaaggaggactttgggccagacttggcccaaagggggggagagagattatttttaggtttttctttttaataaactctaataattgtttttgttgcttaataattatttccggtgctctgaaaattcaagtaaaatttaagggctccttttagaccaaggagaatttaacaaaaattccccgggccacattcgaatttttcttgtacgcattttagtgtttgccaatttcttttcgaattttaattaattctattattccttttagaaaataatttttattttgggatgaatttatcaggacgtgacatatatcgtacgatttcacatttcagttccatctcgttttgtttttctcgatctcgggttactctagctgggctgttcttgatggctgccgattgccacacttcacaggagacaattatcatgaaattccattattaggctttcttcgatcacaatcgctctgatcttccgagaatcgtttttggagattcaactttttaatccgttgttagaaagaagggttatgcatatagcttagctaacaatagatagaaatataagtctttgaggtggtatattaagtagtttttatgcctttaattaaattatttattcgtcctataacatatgcaataattagatgttactttatttaagcaaagatcggaataaattttattattatttttattaaaaaaaaaagtaagacaacgaattacagtaagtccaaaaaaaatcgtttgaatttcgaaagagatattgttggctgtgggctaaggtgggccggtaattttctagcctgtgggctgaagggccgcagttttccctcctttccatcgtcttccttccgtgggttagatcgatcgatctggctctctcgcggagatcgagcaagacggatgatggcatccatggcgaagggccgccgcttgtggaaaaccaagcatctcacactgcgcccgccctgccacggcggcggcgatggcgatggcgatggcggtcacccagactggattctcgtcgacgtccaggcctacatcgccgaccgccggaacgccaccaccgccaccgccatgctcagcaacggcggccaccaaatccaggtcaccatctgcgtcgcgccgccgccgctcgtctcctacatctgcgcctggtcccccaccacccaccccgccgagctcttcgacacggagcccaccgtcgaggccgtcgacgccgacctcctcctcctccgcatccacgtctcgctcaaccatgtccacgacctcgtctaccaggcatccatgttgccatcgctgacgctcatgcccagccaagatccttacctgcacgagcccaactgcatcgcgctcatcccccgctcctcccatggcttctacatctccacgctcgacacggatctccgcagtgggattgggcgatacaacctctgcctcttcgactccaccaactccaaatggagccatgaatcgctctctctggatcagctgcgcaatccgcctgacaaaaacgaggtgctccatatcacggagaaggtgatcaccttcatcaacgatccacatctggttgccttcgttgatctctggcggggcatcatcatctgtgacatacttgacaccaaaactcaaactgcaagctatgtgccgatgctcaaggagatcatcaacctccgcagaacccgagcatcgtcgatcaccagggacattgctgtcgtcaatggccgcctcaccgtcgtcaggctcaccactgtctttgatccagatatcaatggttgggactgggatctgtccacatggagcagggcagtggattgtttggagcaggaggattggcgcgaggactctctggtcgaggcctctgacatcttaatcgaccacaacatctgcaacgttgagctcttgcctaagatacaggggcaacctaccatggctaaactccacgttgctcttcccactctcagcttgactgatgctcaggttgtttatgtcatgggcaaggttaacgaatccgatgaaaaggctgtgctgctgtctattgacatggccaacagaaggcttgatgcagtatcagtgtatgacgctgcaagaatcctccactactttgatgtctgctacacgcagtctaccatcttccgatattccgccccttcttcaggtgattaattccctggctattctttctacttgtttttcttctggccaaacctttggatcaattgatagtaaacctgattcgtattgttgtgtttgctgatatatttgaacacatatatgtatgtggctgttgctatagtgctaggctgctagctagacttgctagtttagtcggctgttagttggaggctagtgttagctagactgctagttgagacaacattagtgtgaggctaggtatacttttagtcgtcattcattcattcattaagctgccagattagttatagagtatggttctagataaacaaatcatgaaatgcaagcccatatggcacatgtagccagttaaatgcaagggaatgttagctttcacattgccttcagatgaaaaagaaaatgttgctgtgggtgcatgctgtatcaaaaaacgctcataaaacaaatgagccattgaacgagatggttggaaatgaaaacatcgacaagatttctgccaagagagatatatagcagaccattgtaggtgcttttgcattcttgaaatagaatgaaaacttgttgaattatgtgtaaatggttaagcacatatatgtgtaaattattttgcactaacacatttccctttgttttgctgggtgcaggtttaaatggaaacctgaaacgaccagggaagttccctatgccatatcctcgcaagcaacaggctgtaaatgagccatttcttccggatgctgggagaggtttagaaactgaagatagggatactatggactgggagtagttatgtaatttggagctgaaacctgaatagacataaattgatcacagctgtttattttgcttctagttactacatggattgctacaaatgcagctactctagaagacatcagcctgcatagagaaatttactttggcagcaacaaagagtcgaacttggctatctcaatctttgagcatctgccgtcatctcacaacaattactgtcgtgaaactccatcattaggcttttcttcggcacaattgttctgatcttccaagagattcacgctttatgtgaacacagaaccatttcagattataacgcatttgaaattaattactgacaaaaatgacctgtaaattctggtaaaacactttgactggttcggggatctggagtatgattatagataagagtattattcacatttagacatagaagcgcccatggcctaatggataaggcgtctgacttctaatcaggcgattgggggttcgagtcccactgggcgtgtttattattttttttctcttttaagactcagaaacagaaaactttttttataatttgtaattagcaaatacaagtacagatagacctacctcattcacctctaatttctgacaagaaactagttagctagtttttgtgagaaagcaggttggagaattgctacacgtcgccgcagcccacccaactcacagtattacggcccaaccaggcctcccgtaacgggccgggctacatgcagtttccattgcgaccagcatgctggcccacggtcaggttagcgtgggccaatttgactggcccagttagtaggcaaatggactgcatgaaatgggccgtagtcctcctattttagctaggtcgacttctttttccgagacatttaacttcttgcaacttttaaaatatggcaattaattatttgtcactcgctgtatgacatgtgggtccagtggtaaataatttagcaccactgcaccactcgtaagagtggcaaatagttaattgttcttctttttcccttttaacacgagcactgctacacgtactaattttttcttactaaatctttactaacaatcatctcaaccgtttgatttaggtagatggaagttattaaaaatctagatgcactcatagcatgacacatcactgttagtaagaatttagtaagaaaaagttagtacgtatagccttttccttttaacactatctccattttttaatatatgacgttgttgattcctttacacatgtttgatcatccttcttatttaaaatttttatataagcataagaaaatataattcatgcttaaagaacttttagtgttaaataaatagagagagtaggttcaccttgaaaaaggaaaatctcctgatcatctcgtctcatctctcatgtcatctgacacattgcagcatgcaagcaaagaagttcagcagcctgtctgatgctgcagctactacgaaaggggcgatttcgcatgcttaatcactgctagaggtgctcaagtgaactggggctgtgtttagattcaaagtttggatccaaatttcagttcttttccatcacatcaacctgttatacacacacacacaacttttcaatcacatcatttttcatttcaaccaaaatttaaactttacgctgaactaaacacagtctagagtaatcagtaactagctacaaatcgatctacactactgatccatcagcgatcagtcgtcgtcaacatctattgatgcaaagcagctggctatctatcaataatctggactgcagagattaattgaattcaaccatgcgtgcatgaccgatcgattctcctcgtcatccgtgggtacggattaattggactcttgctccgaatgggtgatacactcgggtggcagctagggcacacagctagctaactctgatcctctctcgtgtttgtgttagctcacatgactgcgtatactcatcatgttaagagatcttgatcactgacttgttcagcaggaagaagctaccttaccttagcttaattagcttttgcttagcttaggaaatagccactaacacacgccattaaatcgtcttgtcatctaactacacctaaatacgtgtatctagctagctcaatcaattaatttcagctgcagatagacgaaccattttcatatagttacaatagctagctagttgggtcgatcggttgcttgcatttcttgcatcttgtgtatatatgcatgggcaagagatcgccaacagaaaggaattttttttaaaggagttcgagaacaactgttcttcaataaacagataatgcgtttttaattgcagttgcagacaatgcaaacttcatttcccctgggcagctagctgatcttgttccataaattaactggacgatgtcctgacaagctgcgaccgacgtacgagcaaatttaattacttgtcgtgatcacaagttaatcaactatgcttatcattgacgacattatgcgcaggttcgtcgtcgcagaacaagttaagtcaaatcgattctactccagcagctgcatccatagatcgatcgatcagtctgatcacacactaaaaagcatctttgaaaaaacgtcatatcatcgcaacagtggtttaatcatgttccccagttaagttgcagtttacagctgatcataccggatgcgtgcagcaggaggactttgtgtcgaaagagtaattgtgtgtcaacaaagcatacatgcactatgacgctctgtggttgggtttgttgttgggtcagtaaacatctaatcaatcaattaattcatcttgctgcatgctgatttaatcttgagctcatacttacgtgttgatatatcgatgattctaatgaatcagcagtatagctagctagcagctggtagctaattaattaattgccgttagcagtaattaggagtagaaggtaaagactcttgcagcagataagcaatttccaagttaaattaaactggaaagaacctcatttcaagtatgcaagatcccaaggaaaaaggatatatacattgttactgaacagtacttacagctgcactcaaacagcatgcagcttggtcaccttactaacttttttggactgatcaccttactatgatgatattattctatcaccttactatattactgattattattattattattttgtttgtgattgattggtcatttgagatagatcgttgttaattggtgggaatgggcagatagctagattcatgcatgtactagtttctactagctgctaatactaattttaaacaagaaaaaaatgggggaaaaccctgatgctttaagagttgtaactaagtaaaggattaaaaaaccatgagacgcacgaaatgtcgagataaattcggcttgatcgtgatatatgttttagtgcatatagtaaagcttctggtcattctcttagaacaataaaaagaggcaaattctccttgctaggatgaaaaggaagaaacactcaaacacatgatgaacacagcttgatccaatacaagaacacaaagacatactatgcaaaggattaatccacacacaatttatatattctctggggtacctaattaagcataggctcatccaaacatgtatacagatcgatcaaggagatcaattacgtactgaattaatgagatgtatattattgaactatatatatctctctctcaaagatcagggctatatatatgaattagccgatcaaacaattgcactagaaatcaatcaatcgcggttccagagacgcaacaagtactcgatccaacgctagctacctacgacatatgcatggattcatcacgatttgattaattaattaattaattaattaattaattaattaagccgtcatatacgtaatcaggttaattagctcagagcttcagcgacaagtcgatctcctccccattccggccgtagcgcccgccgccgcagccgccgtcggccggtggcgg

SEQ ID NO: 56591 - DNA, 787 bp, Oryza sativa
acataaatataaccaccctgagaaatgatgctccaaatctcgggagcctgggaatattacaaagcaatggtgaaaaagggaaataaaacactacaccttatattaaacaaaaaggatcatttcatgtaccttctctgccattttgtgctgaacatactcctttgaaggaccctcacgagaaaaggctacaatcaattcagacagcgcaccggtctcaacaaaattgttgagctcatcctcatatatgaagtcctgaacagagaaaatactggtgaggggagttatttaagaggctaggaagttttctaattgccaatcaccaataagatactctcctacactcaaactacaatgcagaaaagttttctgaaagacaaggagagctctgacaaagcacatatgtgcataaccacattgtgcaacatcaatggcagatgtgttgatatttttaattactaagatttataagaatacctatgaccaacagatttcgtatattgtaaagttttctaagtacaaactgcatatgaatatgaataaagtaggaatgtatgtcataccatctttcgatttctgcacccaaagaataggacggcatggcctagttccacaccagtctcttttagagctaatctttcctgccagtgccaaatgcataatataatcaattgaattataagagtcaatatttgaggaaagggggaggaaaaacaaacctgtaagaagcccctaaaaggtgcaagaccagttccaggacctatcattataataggcacagtaggatcag

SEQ ID NO: 56592 - DNA, 2445 bp, Oryza sativa
aattcgtggatttggctgtgtatatcatttgtggatctagaggccggattaatgaaaatccattatctaaaaaaagtagaatgatacatacgatggctgtcagtcaaaaaatattaacaaaaggaactcaacaactttcttcaggctagttactgattctaaaactgcttctataatcccccactgaatggggacaatcatatcatttattgcattttacttttacagctaactatctcttcgtacatggtgaagtcggatcaatcaaagacatacatttggtgcacaagaacaccaaaaactacaagcctgctttctggattctggacgatcggttggtgtttcaatcaccctgaacctgaaattcataagcccaaaagtcagaagaactgctcacagcgaaacaagatgaaatagaaagtgtaaacatcattcaacatgtttgattacaatgaaaaccgcgctttcagttggcacttccaagcaacttaaaagaagatcaaaaaagataatttttgagatgtatttgaagatggaagcatttaaaagttcagaaattcagatcggtttcaacttgagggcataaatgctaatccttgaattgtttggtgtgctaaccttgccttttatcaatacaaagtaaacataattgcactagcacaaaccaatacttagccctgatagtactggtacatgatcacttgatgattgattctgaatatatgctaagctgaacagatttagcaacctgtgtcgattttctcataatctaatttcctcttatgcatgaaaaggcttacatggtccattttgataagatatggaatattagcgtattcaatcaaatcagataaatatatgcacagatgcacttaaacacatccataggctgatccagtattttttttctccagaatatttgtaagttcaatttgtatagattatggtagcattatacagtcagaatcactttcaacaagcatgcaattgctctttcatttttatgaattggacacctctagggttatacgaattttggattcgcttttgaaggagagtaggagaacatagcaaaattttgtctattcatggcttaacccagtaggagtatttttatagcatgccatcagcacagttgattatattttcattacaattttattacttagcggttgtatacaatctttttaatgtaaggtctgatcatttaggtaattcaggtaacatgtgtttgcaacatggaagatcgctctgctgaggtcgcacgtaattgtactttttgcagatcgcaatttagtctatgcactccacaatcaaaatcttgtactaacgaaacatcatgtgtttgcactataccacacatgcaatcaagccgttctgtatttcagaacatgcactcagaaaatatcagcttctatcgatatagttgtaccgaactccaaaaatttggaactcaaagactatgtagcgcataattacactagacaaaactcaacagctggaacttcctaatctattagtgaactccagatatagcaaatgccaagtaggagtacttaacttcaaattgcatggaatgtttgatagctatggaatgtaaagaacaacatatacccctattaagttagttaactacaaccagtttattcgcaaattgtcatgttgatactaaccattttctcctttcttggcatggttgtccacttcagctgttacagatgagctaccaccagtcttgctgctgcactccttcaatctctttgcgaaaagcttagcgatctgcaagtgcgtctttgccataatctctgtcctcttgagctccatctcacccttcttaatctcagcctcaaccctcatcctctctgtttccctgtacaggtccattcttgcgcgctcaatcttcaagaatgagcttgccagcaactcgatgctcttcgcgatatcaaactccgtgttcttcctcttcttggacatgtcccataccttgtccacctcctcggcatcctcgttcgcctccttgatcctcggagagctcacattgacatcactctctgcagctctcccctcaacatgcccactgttctcaaccttgtccaatttctcttgaatcgagccgtttgcatatgcactcaccaattcagaaagtgcacccggccctgcatcagctaactgactgacgaaatctgcatcgacatcgacctcaacctttgcaggaggaggagctcgcaggtctatgctgttgctcaactccgcctgcggctggccggagccggcggggcctttgagcaagccgtccatgcgggcgaagaaccgccacgacgggccagcaccggcggcggcggggccggcgcgcgccgccgcggcggactccggcctgtaccgcttcttcatggactcgatcttgttcttgcactggttgggcgtcttggccgtgctgctcccggg

SEQ ID NO: 56593 - DNA, 2761 bp, Oryza sativa
ttaacaatcgccaaaatgccggtccgcgtgctcacacaaagtgacaaggtgtcaactccctcgacgccattgacttcagcatagcgttggacctaggtgcaaaagtaaaataagtttctaagggttcatttataagagtttttttaaaaggttcattcgtaaaataagtttttagggaagggctgaaatgtaagaaaatacaggcgcctcgcttgcctcggcgccaacggccatccaccaaaggcgcgcgccgtcgctttcggttggggtttggggcttccacttgtccgcggttggtgggtggcggcagccgcctgcagcggcatcttttttccttttctttgccctcgcatcgcaggcagccaactcccaactccagcctgcgctgcactcaactgcaccgagtactgcctcttctccgttaaaaaaaaataataataacccaaaaggaagtaccatgaatctgaataaagaattattcagatttgcagtactaaaaagatagattagtttttttaacagagataatactctctccgttccctaatataaagtattttgatattttacatactatgtttgaccactcgtcttattaaaaaaattatgtaaatataaaaaatgaaaagttgtgcttaaaatactttagataataaagtaagtcataaacaaaataaataataattttaaaattttgtaaataagatgaatagtcaaatagtgtaagtaaaatgttaaaatctcttataatagatatagatagcggagggagtatactagtagtactctactgtactctacctctatcattgttctgttcaactggttgaccattagtgggatcttgcaacatctacggcctacggcagttaagtggaagtcaataattatagagaaagtcaagcatatggtactggcgtactgctactatcatcaccgtatatgcaagactagttgcagttatctgatgcttgcatattaagtgcagaactgtgcacaagtgcaatttatttaatgttaaaaaaaaagtgcaatttatttagctcactgctcaccagagtttttgagtctgatcatgcactcctacccttgtggatttaaaatcagtagggttggcttgtggtacgatgtgattactgtacagtgtactaatcccatcaaaacttatacactagagacaggtacagttcatttgtacttagtatagtactaagatttttcatgtactccaactctcttctttgaaacacaacggggcagccgttctcatgttcagattatcagatattggctattttagtttgtactactagcaattagcaagggcataaacaatgcccacttgattgctccactatttaaactcttctctctctttttggctgtgtttagttcctgaaaaaaagttaaaagtttagggaaagttggtagtttggaaaaaaaaagttaagagtgtaggaaaattttggatatgatgtgatgtgatggaaagttggaagttggaggtgaactaaacacggcctttatctatgtgtgatatctgcaaaatcttagatcatgtcatagttactatacagcccaagcatacaaattggcaaattctctagatgaaggatgatgaatcaactgatgaccacattttcaaaaccatatgcattgccctaacggaaaggactttaaagttgcatggagaatatgccatccaagtcagtggtgagcacaaaagagtgtactcatcctccaaatcctacctaggattatgatggttgagtggtgcccactgatcaatccacaaacatggagcagaggagacgtccaggtcaagctcctcttgaatcttgatgatgagcaagcagcagcagcagcagcagtagagggacacttgccgacctgccgaccactctgctgctgtctgctccatgtttaaccacacgtttcccattcactgccagctttgaggagccatgaaatagtaacacggcacttaaccagacatttctctcactgaaactataggatgcagtcatgttgctgctcatgttcgggagaacgtactctctccgtcaaaaaaaaccatcttcacttgtccggattcattccaagaagctttttttttttttggatagagggacttcagttaaggagatgcaaaagaatttgacgatactgtttcttcagggaagaaaaaagaatttgacaataccagctggtaccagtgaaacactgcatgttcagtgtacagtcagtaatgaaacatgatcagataggcagcactgatgtctgatggtgtcgaggcactcatgatagcagcataggaagcctttcatggagacattatcaagagactggacgccttcatggaaacagaatgactgaatgagagttggaagatgtgtgcacagtgttttggaaaataatgagcgtataattgtgactgtcagacaaagcagacatgtaatttcagacgcctaattgctgactttacattcattgcgtcttcacaggcccatggaacaaattcatgagtggcataaactttgaataaaagctgtaaagctctgataagtccgaatgttttttagtacactggtactactagtttcagcttccaatactcaataaaaatgcagggattgtgacaaaagagaaggttggtaaaatgactgtaggagtagtagtcagagtgatatcacaatttagacttgcaccaggattataaattattggtactgtgtgtaaggcattatttggcatgaatatg

SEQ ID NO: 56594 - DNA, 1387 bp, Oryza sativa
acaaagctgatcatgacgtagactatggctgtgtttagtccagcgcaaagtttgaattttggttgaaattggagatgatgtgactgaaaagttgtgtgtgtatgacaggttgatgtgatggaaaaggactgaagtttggatccaaactttggatcttaacacagcctatgtgattgctgtcaaaattcataagtacgctgttcatagctcccaaacctgcagcccgtgaattcttctcacctctgacgactaatgagtttttctgccgtttcagttccagaaacgaaggctccatgcctccatatggtagagtagcatgctgagtctgagacatgcaattttatgaaaaagatatgcagatcaatcgttgatataccgacctgcatgccagcctctggatgccgcaccgatggatcgacatacaacaacaattcagagtttcagacatccccaagaacgtgacattttatatcaattcagaactaaaatcacatactttgatccacctcatatctcttcaacgagttgtatctttatataatacagcaaatgtattggtcaacgatgacgtctaacccaattaagaacgtccaacccaattaaggatgactgcattattaagaaaacgaaacagagaatcggatgcgacagtttatgtacccttgaatataatgcacatacacaacctgatcagcatagtcaagtggacagggaaggtcaggggcatctctctcacagcagggcagacagaatcgttgcaatcagaaatgaaacattaaagaaacttcatgagcagctacacacaatctattcatcaggcgttcacaatctaacagaatcactgaatatcacatgggcacgaacattcagcaccagaaacaagcattctcttcatgtattttataatatccatctatgattcgacatcagtatgaagatgtcgttcagaaagcgcagataacagaggacacaagtgacaggatcaagtgattactacaaccagcagcaagatatgatccatcaaatgaaaagtgattactacaatcagcagcaagatatgatccatcaaacgagggacactgattaatttattgtcagaggactagagtactgaacaaaacaaactttcctgcacattacagcatgtgacaagcatatcatattttgaaaaagggcgagggttctaagactgttttctgttttcctacaaggcctggataaatgttagtactctacagatcaagtatgataaagtcatctatttctacatggaattctcagagaacatttccatcatgcaaaaatccagagtggtcttcaaagattggtgaagcacttgaataccttatgcataaggtatgaaacccaccaaacattgaagttcact

SEQ ID NO: 56595 - DNA, 2407 bp, Oryza sativa
taacgaccaaatgactaggtgcctcctcgtcctccttgatacgaaccactgtttctactttataatcacaagattcacaacgccatatcaaaaaacccagacgaagttaccagataccaattcaacagcagaacttggctgttctggatagagcataggtttcgacagaattgaagtggactgcctaagcaagggtatgatattccctctggtactggtctgagtcaagagcaacaagcacatagactgcgtagatgatgccagggacatagccaaggatggtgagaagcaagcagatgcagaactccatctgtttaagacataataaatatcaacactattagtatgttaccacgaggggcggaaaagatagaatgcagaactgtcagtagtgttatcagcacaaaaaaaaaaaagcttgttcatcgctgattcattcggactatgcctatggtttaacttttgatatcaacacaggcagatgtagcagagtcaagaaaactatgccattatcactagtcaaaattcaaacataatccccatgctctttgtgcagcacttccacttgagcataaaaattggcctggggatgactaagttgacaatatatgcgctataatacatcgaagaaccagtttaaaataaaataacaccaggcagattatatggacttgtgacaaaatttcagcctactctcttggatcagttatcagtagatagggattgcataattaccagaaattctagggtacttacactgcaaggattaacataaatcataaatcacaaaccgacagtagcactttcatatgaactccagatgaaaaatggttagagagagaaaccaaaggaagcccaattgcataggatagccattgcacgaagcagagctacatcgagagttgtccacccaagattcagcgctggcagcgcagcgtttggagctcggggattcgcaaccactcccagtatcctcgaattattattactggatgcgagcaaaatcgacctaccagatcgcaaaaaattcgccccccgaaattgaaattctaacgaccagatgcacacgagacaacgaatccccccgatccacctatccacgaacagtagcagagcgagcgggagatcgtcggggaggcaaggagagagatagggagggcaagaaaggggattcgtggcggcgtacgctgcagcatccgaagcggaggaagacgccgaggggcgggaggatgatggcgagcaggatctcgaggaacgtgcagcaccggccggacgccatgggtggaggatctcggatcggatccggggggatcagaggcgagcgggatctaagctatctcctcctcctcctcgtcgtcctgctgctgcttccgctggctgtgtgtcgcgtgcgcgtcgtctcgccttgtcgcgttggtcggtggcgtggcgtcgcgccgaggagattattacaggacggacggggtatggccgacacgtcgcctagccttaattacttatcattggttagtttatgagtaaggcttaatcatgatttgtatgatggttaattacttattccaaatgtttcaaattgatttatcattctatctttaatctaacttatgtcacgttgaacgagtccgatgaaagattaagtatagagacataaaaatgagaaatcattagcacggacttccttcatttcatattataagtcgtttgattttttcctaattaaattttattagcttttatcaagtttgtagaaaaatttagcgatattaaattagttttatcaaatttaatattaaatgtatttctataatatgttacttaaaaaggtcaaacaacttataatatttataatatataacggatagagtatgattcattgatttttgattatttcaagattaaaaataaatttatatgatatttgaaaaaacttttatatagaaagtttttcacgtaaaatatatcgtttagtagtttaaaaaacttgttaacaaaaacaaataaaatatgtgtttcaattgtgaaagaatatggattaaacatgtctatgtctatttttaccattaacttttgaaaaatcgtttattttaagacttatataaattacgaattcttatgctaaataaaaactttgtgatattagaatatacgaatttataagaaataatagttaaaatagacatgctcgacataacccaaaactaaaacgatatctgacaatggttaatggattgattgattagctcagcaccctcaaaaccggacacgggagcctgcagtatcatcgacgcgacaccggtatcgtgtacggattctctccttgttcttttcctctttgtttagaaaaacacaaatcatatccctcttttaattaattttattaaaatgcattgtccccgattccatcgta

SEQ ID NO: 56596 - DNA, 2162 bp, Oryza sativa
  unsure (1)..(2162): unsure at all n locations
tattattataatgttatcggctcaattaatccataggctcccagagttagtggccaacacggcaacacatgccaggatcccagctctgcntgcagaagcacacacgaaacaacctaaaactaccctgaaactgaaagtctcaactctgaaanaatggctggaaaagcgacagatgatcaggagaaaaatattcggaaaaatggcgagatctctttactctaattggctggctggatgtgtgcatatatgaaggattgtactgtgattctggtgaagattcaggaacataattaatgaagttcttagctatgtgagtttgatccgtaatcttcttgttctgaaagagaaaaacgaactctgaatctgaagagattatgataagctacaggagcatactacgtacagagtatcctcctggcatgattagtagcgtaccgactttaattaaccctttaagaataatgtatactagtagaatactgttggagattagctgacgtgtggctgtcttaaggtctccttaattatatattatggaggttaagtacagtgggatagcaaagcattgtgatgtttgcataattgcattttttgccgccattaaaaaggctgtgtagccttgacatgccgacatgtgtgaccatctaatcgcttttgcttaacaactacaattagcttatctaattttatcctccaagaaatcaatcaaacaaagggtgacagatgttcagagagcttgacatcccagctgtaaatttttgttcatacactgaagccaatacttttgagacatcagttagaaagtagaaaagaaaaaatctatcttgatgtgtggtgtttagccacctggggcttgaaagtttgatggtgacaaatcaaacggtgagataatcactatatatcctgtcaaactccgtttgatccttgcgagtatgaacagagtttcgttcagaagtgtatccacaggttaataatgaatacttttccgttcatccaatatgagaagtaattttccgtgccacgtgaatagataaagctttttgcacaaggtgacaatggaaggtagatactcacatttgtagcattgcaatttgatgatggaaggtagttttggatcaatgtcattcatgttttaagctattaattaagctgcataaagtacataatgtttcgtttttatggaacaaaataaacgtgtgagtattgtacgagaaactagtacacctaagaagttgccaaaagaaactagtagttgccatgataaatgtgccacgatttaacctatattcttagcttctgaattattatgtgcacgtttcctaagcaactaaatagattttttaagaaacattatatatagaaatttcttagatacttttcaaaatccatctttatttttttatatttaattcattttatatgtgcctttgaattgtaataaaaaaccaaaatattaactataattatcggctgcaatctaattcgaatgtagtaaagcctctactatggatgtggttgagaatactattatttcatcatatatactcagtaatggctcaaatctaattgcaattaacaataatcatttataggtataccgtaaaagtaaacttcgatataagaaaaggaaaagtaaataaagcaaactattcaatcactagattaattcttacaactatatgctcatgttaaaaacattagattattctcacaagagttattcgatgataatacgatcgtgatgtaataactgcagatatattttaacaaagaagcacaaatcaaaacaagaaattatttctttactagagataaattctctatttcaaaagaaagaaaaggctagagataaattctgaggcaggagtatatgtatctgttgataaccaccaaaacggtggatcggtgatctaccggaggaggagagggcattgcaacagggcggcgagcgagagagagaagggagggtggcggtgaatagaaaaaggagatacgcaatcttccccgaatcccccacccctcctcatctccctccttcccttccgcctccgcctccgactcctcctctccggctctcctctcctcttcccgtcgcttccgccccctacaaatactcgcccacctcctcctcccctccccttcgcttcctcctcacctcgcct

SEQ ID NO: 56597 - DNA, 2238 bp, Oryza sativa
ctctgtttccccttccacattacattattgttggcttctgctttctggttgattcgccaccaccctaggacccggaattcgcaactgttttttaggtcaggattgtctctcgtagatttgcttgattggttagccgccaaaagttgttgttccggggaactggctacgtggattgattccaattgcgttcgccaatggtggtgttctgttgccccaatgataagactcacggtagccttttgttgcgccttgtcacttgcatttggagtccagtgccgatactagggcagataaattgatcacgatgattagcactaggagtgccgttcgacattgagttctcattgatttggcatgacattagggaccgtttcaggtgaaattagattgaattagtggctgtacctgttctttaaacgcttattgagtgcatccttacattgcagcacactgccctgccacgcctggacgaatgcacatccttttttggtgtctatgatggccatggaggtaagttttttcattgattttctgttcatgtccaactcgctattatgttgcatcttcagatctaaacaaagacgagtgcgatttaatgcctaccatttggtgattgaattaatatcatcttacaactttatccattactagttgcaaatgattggtgcctctgtagtttcgatggcataaccttagcaagttcaattaagcatcgccaactttcacctaacaaactacacatattaggtaacctgagctgtgttgagttgatgataatctcatccattcatttattcatcatctcatccattcatgcagattaggtaaacttagctgtgttgagtttggtagtccagtaacctaacagggaaataacaatcaaacagtccaacattttcacattccctttttgatcgttgtaaaaggtagaagtgcattgagtaggtttaaattgattcatctttttcatatattttttttgaaaccaaaacttaatgcgcttctatgttgtccttttatccacatcatggacaaaactctttatgttgtgacttgacaaactgtcctttgtaattccagggaaggcagtatctaagttttgtgcgaaacatctacacttgcaagtactgaaaaatgaggcttattcatctggtgatttggctacttctgtcttaaagtcatttttcaggtatgtagcatgtacctcttttgaacatgaagtgcttttcagtgaaactatcgtatgcttggtggttttaatgagtctgcaccgctttttaccctttcagaatggatgagatgatgaaagggcaaagggggtggagggaactggctgaattgggggacaagggacaaaagtttactggcatgttagaaggcataatatggtccccgaaacctggagagtcagataaacctgaggacacttggactgaggaggtaaaactgctattctaaaagttccttcattaccaaccatttttgctggatgatggaattgaggggccatctttgatgtcatgatgcttcagagttattccttggtagaacaagcatttgacgggataaaatactaaaaactgattcgatgctagtaattctgaattcatatttaaagaggcttgtcttgagtggtgctgctcttaagtatgtggattggtgaagggggcttggtcctgcttgttatgtgattagggtttctgcagagagggatgtctttcttaaaatacccatttaaatccttaagggatgtctctctagtagttatcttgaaaatatgagaagtgctcttgagtcaggagtgcctatgatcgttgcatctgaaacttaggtcaacactagtttatattagaaggtgatgtccagttatttttaagcatgataacatgtgatctaaaattcatttggtgaaatacattattacaaaatatgtttgtacaaataaggaaaacaaagggaatatgcaccattcgttagcactgagcatatatgtaacttacgaaacatcagctccagagttctatatttttatacatgaccttgtttcctaaaaagaaactgttcttgtgaaattctagtgaatgtagagttcaactaaactgctctaactaagttacttaaccagggtcctcattctcattttcctgggccaacatctggaagcactgcttgtgtggctatcataagaaatgatgaactcattgttgcaaatgctggtgattcccggtctgtgctctc

SEQ ID NO: 56598 - DNA, 11664 bp, Oryza sativa
aggatactgaatgctggtggtttcattgttgctgggcgggtcaatggaagtttgaacttggcaagggcaataggtagcaccctctcttctcatcgaaaaacaattccttagctacacgcataatttttatttatccttttgtgcttttccaccaggggatatggaattgaagcagaatgaatttctcccagccgagagacagattgtcactgctgaacctgaattaaacacagtgggttttgttgacaatttctgtcactgtatttgctttggacaacattttttgtaacatggaatttattcggcttgctcaggttaaactttctgaggatgatgagttcatcgttttagcatgtgatggcatatggtatgtcctttgcaccaatcattctctcttgaatatcttattgagataaacaattttagctatttttaccatctggtgtagctgctgctgatttttgacaactcaattttccaacaacagttttagtttattagcagatttgatttttttagtaaaaagaaacaatagttgtaattagggtaagtccaaagaaatgacatcatcttctattggtaaaccatttggacagcccttggagatagtaattcacaattctttttagatgatgtgtactagtgcactgtgtggcgtgcagatgctgatatgtaacttcttttataatggatcccagatacataaacatccagataactttgtatactagatgtgaagctgattttttatacctgcagttattttgaaatggtgctagatcttttgtcaactcttctatggattattctgtattctttgtagtttcactggatagtttatctgagacgtaaatttatcttatgacagggattgcatgtcaagtcaagaagtggtggactttgttcacaaagaaatgaacactgtaagcaactgatattcacagaatttacattatgcactaaaaatatatagttcatagtgttgtgttttgcaatatgcttatgttatggtttcctaatttactgggaaaacaactacaggaggatagcctatctgctgtctgcgagaagttgcttgaccattgcttggcacctgtatccggtggtgatggctgtgataatatgacagtgatcatagtcaagttcaagaagccaagcaagtcagctgctacttcaagcacaaatcaatctgtctcttcagaagagatgcgaccaaagtgagcttcctttaaccgtcgcacctaaaccatattccagatcacgaaatctcgcattgtaaaagcctgagttcccctttcagaatttgagcccttacctttgtgaacagcgagcttgatgatggcccaagcgatccaaacaagtagcaggccgagaccgaaccatggagttccaaccggtgatagacaaaaaggatagtaagtggtgtatataagaaaagggattctattctacagtcactatagggtttgttctttctttcaactagcatctttttcttgcaccacaacctgtaatacatgccatgttgcttaatcgaactgggttgtgtgaaatgcatgaattttccaatgctccatcctgtcgctgctttctccgcctggaaattttttcctgaatcctgatgctctatcatgaaccaatattcttgctgaattaatacttgaatataaatctgattttggtgctacattaatcaagtccctgataaaaatgcgagcaaaacacacaatgtgccaatgttcttgagttcttccaagcacaagtgcagagattaattaatcatggcaatatggcgacagctgcggcggccacggcgagcactgccatccacacggcggcgcccggcatggcggcagcggcggcctcctgtgcggctccgtcgccgccgtggttcttggcgccgtcgccggtggcattgtgcttcagcgggtggacggtgatggcgaccttcatgccggcctggcagaagccgttgccgcagatgaagtagtagcggcgtgagtcgttgagcgggatgaagtccttgccggaggtccagttgccggcgaccccggccatggtgcagttgtcgtaccccgtctggttcacctcgaacacgttgtgcgtccccttctggtacctgaacgctgcaacgccggcacaagcacaagcatctcgtcgtcggaaatcattgctgctggagcgaaagaaaggaggagatggagagaggaggcttacagatgaggtcgccgacgtagaaggtctggttgccggaccagagggagtagtcgatgtttgggttccagccgtggttagcgccgacgatatggtccgtcgcaccggcgaggctcacggcgaagccggcgacgacggcgacgagcagcaggtggcacgccattgcgccgccgccgagctcaacccagggagccaatggaagggtaagaggaggggagagagaagcacgggcgatttgatttgatttatgtgccgttcgtgtcagaaatctggacccttttttgttcagcctttggcctgaacaaggtaccatggattagtgcaaattgggcgaaatttgaatcatcacgcgccaccgccctcgacgccggcggcaaacacgccgccctggccccagcttgtcgccgccgtctacacgccgtggaacgtgaaaacatgcggacgcccacatggcagggcaactcagacgacaagactgaaaaagacattgatcatggcaagttgatattgattccatgtctcccgacggtctgagaaatcatgccacagaatgcggagcaatttcataccgatgcctccaaagttccaaccacaagcaaaattaaaaatgggagaaatgtcacacacccagagcacaccaccaacacccaggttggatagtacttgaaagcaaaagggacatttcattctaataatataacagtgattaaattgttactggtacatcatattgatttcatactggtgccagagtcaataataccattgattagagtacaagcagttcataatcaattgaattcttataccagtccattaaaaaaatttcaccaaaaaacaactccatcacaatgtgttctatccttgtagtcttgtactccaaattactacagtaagatgtatcgtttagccataacaaacataaattgttcataaactaaaacctaaaatgtaacttcactgaaaatttctttaaaaaaacccaggggattgatccccacttcgaacatacaattcccatgactcagaaggcttaaaaacatatgctgtgctctgtagtgttgcaactaatcaatcttcacagatgagtaaatcaacctcgtgaaccagaaacaagcgcagaaaccgatagtaccagtaagcacaaagaacgctaatgaagcaagcaacatgtacccaaagtacaagatgccagacaccagcttagtaatctgcagcttcgtgaagaagtagaaagcagcatataagaagagataaagtgctgaggatcccgaagtgaggtaagatctccaccaccacatgtagtcctcactgcacagttggaaatagcagagcacgaccgtaatctcggcacaggtgatgatgaggataacaaagacgaggaagaggaagccaaagatatagtagaattggtgaagccagatagaggtgaggatgaagaatagctcaatgaaaacagcaccaaatggtagaatgccaccaattagaatagtgaagattggattcatgtaccaagcttgctcggggatctgccttggaatcttgttggttttaactggaggttccagggcaggttttttgaatccaagatagctcccaacgaacacaagaggcactgagataccaaaccaaaggaggaccaaggcgaacatagtggtgaaagggacggcaccagatgacttctccccccaaataagagcattcaatatgaagaagataacaaaagcaatccctggaaataagaaggctgtgcgcatagttattctcttccactctgaacccttgaacatcttgtagaggcgtgaagaagcataaccagcaagcaaccccatcaagacccagacaagaagcatcgcggtcatcaatcctccccgatttgatggagaaaggaaacccagaactgcaaaaatcatcgtaaccagcagcatgccgaagaattggacaccagtaccaacataaacgcagagtaaatcagagttggttggggggcggaacacatctccatgaacaagcttccagccagtttcctcttgcgcttcttcttgagtttcaagttggttgtatctagagatatctctatatagagtgcgaagcattatcattgcgaccataccagacaggaaaagcacgatcatgagagagttgacaatagaaaaccagtgaatctgatcatcagtcatcaacagataggtgtcccaacgggaagcccacttgatgtcactctcctgcaatgagggaaaaagattcaatggaaatcattgcaataaatttaacattaagagaataggcaactatcacatgaagggggaaacagaatccaaacaaaacatgcaaaactagtacctcaaagtgaacatcataggtgaatatgatttctttgccagcttcgacctcctgaggagagtcagaacttgttacaagcttgttagcatgagggtcacatgtgctcaggcgagtgttcacgccatcccatttatcatcaagctgatgcttaatgctgccataacagtatataaataacacatgcattaggctcatttatatagagcatatgcaagtaaaacatcaaagcacaaagtagaaagaaaacctgtatggcttgacctcaaatcccactattctagaaagttctgaatcatcgtccttgtggtacttcactaaaaatgacaaatggttgtgaatgaagtacttctcttccttgctctgtgaatacatttatatatcacagtttgttaatccagagcatatatgaataaatagaaggtcaagcaagcatcaattgagtgcacaacttactccggtgtactggcccttgacaccaacatgatagccaccttggtaagcaatgttcttatcttgccttaacacagaaacaactagcgggagattgtcaagaatcctgcaaaacaaatcatgtcactttggaagatactgtgacttgaagtgcaacattacctatatatcccttacatgttcacacgatattcatcctctatcttttccttgagctcctttgcttctttctcaccaacagttaatttgcagacaatctggcacatcttgggctctctcatttgaaactgtagctcaaacaaaaagaatgatggcaaacagagattaaggcatattacttcaaggacataaacttcaaaatatgagttacccggtactaaccacatatggagagttctcaatgcgatcaccacgaagaacctcaccgagattttcagcactgtcaacgatagtttctggcttgcagaaaggaagggagtaatatgcatagggtagttgagtttttactgatgtcagcttattcaccttcacgggaagtgaatcaccctgtagataaacaggaaaggcaattataagggaaatcctggccacaaataaaatgttatgatgccctaaactattccttgttaaaggtaacatttatttggacttaacatatcaagatgcggcatggcatgtgtacacatgaaactacaagtgcaaagaaacaggaagatgagccaaaccagtctgatctaacaaatgaatcttctttggaaaagaactaagcagaacaatagttataattatgatcgatgaagcagtgaaccaatgcattattgggtgactcaccaacccaatttcagaaaccagtgcccatgcattgttctatgttaactttgtgatcatctaattccataggcaaaatcagataagctggaataaccactggacctagatacaccagaggaaaagaaggcaagcaaagaattacagttcagatcatttaagcgatggccttcttttagtgtaatggcaatggatttttaatgagtaacccttcagaagatgatcttgtggtatgcaattactgtgagttgagttttttccgagacggaacttctgcttggctcggatggccagtgcacatccgtttattgagcttaactttggttcaaaccaatggattttctcagaatcacctattccaatacaatacttgttggaaacacacacgtttaacgagaggtagtttaatgttactactcagaacaaccaaaatctgatgtcaaagtttatacaaaatcaaccaaactagctatttttggcttaaatccaccattactacaagagtttgatgatgcatgcaacctacacactccaaatggaccaaatggaagtatttggaacaagcgaattgttggtgcaaccgtgtgaatcccaagctcagatatatatcccaccaccaataatcgaatcaggagtacctaacacccaaagccagatctacgagatcccatcccatcccagccatggaaccgaacccccaccccgttgaccaacgacccagatccaaacccgagcacgcgcgcagcaattcctagctcgacgaagagggggatgggatcagagcagcgattcgaaccttcccgaagtcggtgggggcgacgccgggcaggtagaacccggcggccggcgcggcggcgagcagagccacgagcgccgccgccgcggcgagccaccggagcatctccggcgctcgcatcgctcggcgagagaccatgtctcaggggtctggatctgagcgcggcggcggcgatgcggcgggggcggcggcgacggcgacgacccgcgcgcggaggaggaagaaagcttggggcgtcgggtggatctttcccggggtttttatcggatagaagtttattttttttgcgttttggaccttcaagtttcgtgtaattatgtttacagtgtcggcttcgtcgtttgaccacgtggctctgcacatgcgggcggcgtcgtttgacccggcgaggcagccgatgctggtaaattcaaattttctttttttgaaaactttggtaaatgcaaatattcaaacggtagattgtgtgaagcttctgggtctaaattaaggacttttctattttattgaaaaatcaaccacaccgaaattcggcaatatcaaattttgatatgatactaaattttggtagcattggataagttggtttagagctaaggctctgttcgctatccggcacgtaaaacgatgttcgcattaacgtgtgattaattaaatattagctattttttaaagaatagattaatatgattttttaaacaacttttgtatagaaactttttgcaaaaaaacacaccgtttagtagtttgaaaagcgtacgcacgaaaatgagggtggggagttggaaaccctggggaacgaacgtagccttaaatttcggtggaatttttggggcactcctaccgatcggttgcccgatcgaatttgagaaaaatcgggcgctgacatcagcgcccgatttacgtgcaaaaactactttaaactgatttctcttaaattacttatccaaatcatgatccgattgcaccattaaattcgttgcaattaaatcttcaaaataagaccacacatgaatatattccgatgaatttttttagcttattattgaattatttttaaatgttgcatgatgttccaacaaatatatcagaattgtttcactaagtagatcgaaaatgtttcactcatttaaatcgggtgttatttcaccctatataaaaataatgtttcagtaaatagcgaaagaatgtttcagttcactgtaacattagatctatacataagtgaaacattatgagtacactaggtgcaacatttttcggtggaaaaaaaaataaactaaattcccttaatagggggtttccaaaatatgtaggttttttttgttgcaatggaatgttttgttcactgcaacattagatctatacatagtgaaacattgttaatacactgggtgaaacatttttggtggaacaaaaaataaaccaaattcctttaatggagaatttccaaaatatgtgggtttctttttttaaaaaaagtattttaattcactgcaacattagatctataaatagtgaaacattataaatacactgaatgaaacatcttttgtggaaaaatgagaaagaagtgggcgggcccacacgtggggggaggggtgcgaggggggagcgcccgatccggctcccccgcgccgggcgaccgacgtcaatcattctcagaatttctgtgagcgaaaactttcgaagttacaaaattatgataggttgataacggtaaggcttgtgtagtttgttaaactattaaattttgataacaccaaattatcaagttttgttgggttgaaatcagcaatgtagtgaacacggcataattctatctttatctcctggacaagcaaagaatgcctttaaaatctttcatcgattggagaacaaaaaatccatcgaatcctgcccttgccagctagcgacctttgtcccactataaagcttgtcacggtgtacaaatgccaaattcagacaaaattcggtagaaaacacggcgctgaataaactcattcacatgtaaatgaacatacatgtgcaacaagttacaagtgtctctaggacctagtttttacatgttataaataaatatacatgtaaaaaataaatgcagtgttaacttctttgggtgaaaagattttgttatatcctcgcagttggagctatatatatggctgcttgttaaccttcacgcaaaatgtacatcatgtacatgtttgggttctaaatgttcagttggaaagaaaggcagtataagaatatgaataaatatttgagttatcatttatcattggtaaatatgcaatgcaagcctgtaagtcctctcaacatctcacatttctgatacaacattttagccatcaacttcaattgtttgaatgttcaactcagacagttccattattgtactagctgaaagaagaaaaaaaatagttttctatactgcacatgtaacatgcggactaaagtacatgatcaagaatttctgttctaacaggattactgcaaacaatacatacatgcagccttctaatatctattgacgacagatttcatgcctgaaaataacccaatttggtgacatgattttcagagtccatgttactcagcgcaagtggtgaatcgaagaacgaactccgcatgatgatcagttctataccaagcagatggtatgagactgattaccttgctctatgcaccataacaagcaaggactggaaccaacgagtggcaataggaattaatccttgggagttgattggtatagcactagcttcaatcaggaggggcatacaaccagatcatgttaatggtcagggcatgaagctgaaatgcaccacatatagtgcaaaaaaaaaggtattggagctggctataggcctacatatacgaacgatcatacaaaatgttacttcaacattgacaggttagctatcaaggggaaacaattaaaaagaaccaccacctagcgattctagttgacaagatctacttgttccatagctctcttcttcaatttcttattatatgcagatcacttctatgcggcactgatattacattttagtggtgactgcaaaaaaaaaataaaacaagttcacctgattaatgtctcaatttctgatgttactgatatattgtcacaaagagaagacctaaaaacttgcactgctttttcattgatgtaaaacaaccaaataaacttgccatgataacctagcaattcactatttataatagtattgatgtgattgcagtgactatagttttccacagcacagattcaattcaattcctggatagttaccagatattagtttaagaaaaaaaatattaagcaaatttaggattttcaatctatattcatgcattttagtattgtttccagtgattggttatcaagtaaatccagtattgcttccagtatatgaaactctgactcaaaccagttggttttaatggcctacagaaatatacatgtaacatgtagctttggcaaaattttcacatattaagtcccagcccaaaacagggctatcagaggatttactctaaccaagcataggatgtctgtagtcaaaaaaaaaaaggagcaatataacttgtctacatggaatctgttcattatcatcttgaaaatataatattaatataaaaactaataaatgtgaacaaacataatttgccaatctaaaaacagaagttcctacttcctgaaaaaataaaatccaattcatggagatccgggtgagagtttaccggttttcaattgagcagacaatctttcacgtagtcagtcccaagttttgctccaaagcaatcgattgagtttaccggagttactccggcggcccggccggcggcggcatctcgcggcggctgcggcgtgacgcaggcgtggacgcgactgttgtgggcttccaaacgcgcgtgtaatttagcccgtgggcctttcatccggggaatgggccggtaacccgagctgccaaatgagcctaccaggtttttccccctccattcatatatcgcgatctcgagtgaaaatttgaatgatgggttcatgataccatgattgagacacattacattgttttagggatatttttatttcatacacatgagttcaaattttctcaagaggagcactagaatttattcagtggattaatccgtttctattctacaaataaggtttacaaattaaccatcaaatcatcgcacatgcattgcccttcaaataatcatcccacaggcaatatcatataggagcactagtttaaaccagggtctaacatcgcacattctagtgtcacaaaacatagcacgatgacatgtgcaaagccacagaacatctctcgcaaaagaatgatctacgtctattgctatgttgaacaaaaccaatactttcggagttaccatactatgtgtaccacggtagctaatgcttccaattaatactaccccatttgctttacaatagtcatcttctaaaacttggataagagaaattgagtggcagcctcagagtcaaaatcaataaccgactgaagatgatatagaaattaaaatcttcctggtttttacacatactagctcaaggtaatctactgtcgatttttgtgctcactgaatttatcactttcgttttttttttgtttttctacattctgtaaaaagtgatatcgatattcagtttcaacaataaacaaacaaacaaataaattgaccaaaactttgttttttttttgagatagaccaaacttttgttgataggacataaaatggtcaaagtttctcgagagaacataaaatggtcttcttctcttaacagttcaagtggtttgcgactgcctccttccgaccttccctacgaagcatcgcacattcccacgcggcgcacggcctccatcagtccaccacccaaagtggatctcggccaccccacctccaccccgcccgctcgcctcgcctcgccccactccgccgcagccgcagccgcgagcaagcgagcgagcccaactcaactcaactcatccaaccaa

SEQ ID NO: 56599 - DNA, 7870 bp, Oryza sativa
  unsure (1)..(7870): unsure at all n locations
gccccgctcccgcccctcctcgcgctcttcgaccccgacacttcctccgacctcggccacgtcttcctccccgtctccgcctccgcctccgcctccaacgccaccgatgattccggcgtcgcctcgccctcgccgtcgccggagcctgttcccaccatgttcgacaactgcctccctctcgccgagaacaagtaccgtctccgttggacgctcaatgcctccgccggcacagtcgagatcggcctcgaggccgccgtgggctccgagtactacatggcgttcgggtgggctgatcccaaggccaattctcccgccatgatccattccgatgttgccgtcgccggattcaccgaggaaggtatgccattcgccgaggactactacataaccgactacagcgagtgcacgctggggaccgatgaatcgccggtatctggtgtgtgccctgacaaggtttatgatgaggggaagaatgattcattgctggtgtacggtcaccggcgggatggagtgtctttcgtgaggtatcagaggaagcttgacactggggataccaagtatgatgtgctggtgagtgccacggaggagatggcggttgtctgggccattgggaagctgcggccgccggatactctgaggccacactacctcccgcagaaccatggggggccgagggacacaacctatgggtttgcaagggtgaatttgtcggaaacggtggacagctgcaacggaccattggatgctgacaacaaggaggatcaggagaggatcatcgcggatgcaaagacacccctggtggtgacatctgctccagccgtccgctacccaaacccaccaaaccctgacaaggtgatttacatcaacaagaaggaggctcctctgctgaaggttgagagaggtgtgccagtgaagttctcagtgcaggctgggcatgatgttgcactttacatcacgtcggatccaattggggggaatgctacactgcggaataaaacagaggtcatatatgctggcagccgggatgctcatggtgtaccagcaactcctacagagctgctttggctgcctgatcggaatacacctgatctagtctactaccagtcattgtatgaaccgaagatgggttggaaagttcaagttgttgatggaggccttagtgacatgtataatagcagcgtccttttggatgatcagcaggttactctgttctggactctgtcccatgattctatatctatagcagctcgaggtgagaagaaaagtgggtaccttgctgttgggttcgggagtggcatgctgaacagttatgcttatgttggctgggttggcaatgatggagttgggcgagtcaagagttactggattgatggaaagagtgcagcgggcatccacccaacatctgagaacttaacctacgtcaggtgtaggtcagaaaatggcattattacatttgagtttactcgtcctcttaggccttcctgtagtggaagggtagagtgtaagaacattattgatccaaccacgccccttaaggtcgtttgggctatgggtgcaagctggtcaggtaacagtcttacagatagtaacatgcattctatcacaagcagtcgccccatacgtgtgcttttgttgagaggttctgctgaggcagaacaggacttgcgtcctgttctggctgttcatgggtttatgatgtttgttgcctggggcatcttgcttcctggtggaatactggctgcccggtatttgaagaacttgaaaggtgacgggtggtaccaaatacatgtctatctgcaatactcaggaattgctataatgttccttggtgtccttttcgctgcagctgaactcagaggtttttatgtcagctcagtgcatgttaaatttggtgtcacggctctgctgttggcaggtcttcagccactaaatgcctacttccggcccacgagaccagctaatggggaggcttcatcctggaatcgtgtcctctgggaataccttcatgttatcacaggcaggtcggcaatcatagtcggaattgtggcacttttcactggaatgaagcatntaggccataggtatgatagcgagaatgtagaggagctcacttgggccttgatgctgtgggtgctttctgctatagttataacactttacttggagtataaagaggtcaaacggaggagcggcgacacaagctctagagggcactgggtgttaggtaacaccgaggaagacgattcagttgatcttttgcatcctgacagtacagacaggaattcagaatcaagtccttctggtgtgatggaggtccagcttgaacctcttgctagatgacatatatcaacatatatttatcccccagagtcagatacaaatacaccaattcctatttcacatatatgggtgagatccacaggtcgtgataatttgctgcttcacaagaatctagtatttatatggcaggatgatgccaggcaacacaagatctccaaactgtcttaaatttcctatttacattgtatagtgtacatttttgacaaatagacaggcacaatttattacattacccaagtgattctttttcagtcagtttagagataagagagggatgctagttgaggtgtttatttgcacattcgcagcatcattagctgagctgtgtattgaagagaatgctagaaaccatgtatcatatccactctgaagtcggatactattcattttgagaagaggcaaagcgattttacactattatggttgtctgtctgtgtcctgtgctctctagatacagtacatctgtcaaatacttcattctctccatatttgttgggaaatcctaattttgttgttgctgttttgtccatcctgtttctgatatgattttatatagtgggcttgttgcctgactgtttttaattaatgtttgatttcccaaataatatgactgtttactccagtttttccaaagcttcgtcacctgccaactcctgatcattaaccagctcaatgaaacgaaaacaacgcacctccagaagcaatgaagcctttgtgagttgcagcttgtaattatattatattattttgtttaccaggcgtcacacaaagaacgtgatattccttatataagatgatgataattaaagttgtaggtggtatgaccttaattagttaactagtactacttggttttaaatcgctttttgtgagattcagagatgtaacatttttttcagttgtttcgcgtgttctttgtggagtgggcagcttcccaacccggacaccacacacgcccaaaaaaaagcgctccctttcttcacgctgaaacgcgccgtatcggtcaacacttcagtggaaacgggggtaataaagtactaattctccttccataattaaatatacttccgtactttgatgaaaaatttgtgccactacgaccaccagattatttatagataaacaaaattcgtccgagcgagcgagcgacgtgcacgaaccagaccagagttcaggttggttttcgtagacgtatcaccaggaggctgtctgttggcttggctgttccagcaagtcatcaataatcatatcgtcgtcttctctgggagatccggagagtgtagcttcctccctagctgtccgcgactccgcgaccgacggcggcggcggcagatggagaggaaccagcaccgcgacggcgacggcgacggtgagggacgccatcatcatgtcgtccaggtcccagcgtcaggtctgtccttcttcttttcttctctgttttttttcctaattgccgagcaaaacctagtgagcttcctcccttgattctaccaattctcatcgtcggtgtgaataattcgtgctcatctgcgtagttttaggacaaaagaaggccatggcactacgttttgtgtgtaccttcaattgggaaggattttctgagttatttgggagtagagtattactgcttcttgagcttggtagctactgtaaaaattaacaacccttcaaaaaaaaggcttcttttttttcacttgaagctgactccctttgcaaagttgatgtcgcagtcctaattcaactcttctatttttgtttcttgattttggagactctgatgtgccatgagaattgttgaggttgttgcggggccatgacaattgtgtgcgtgtttttcctgtagcagattttcgcgtatttttttttcttatttgtctcctgcatgccgaaagttttggatttttttttacataatacgattttaatggaaaattgcaaaaatataggtcggttaggcgaaatcgcaagtttagtaccctgttgaacaaccacgattcgacaggagaacctatcgaacatctgcatatcgacgggtatttgtcgaactgtggcaatttaacaaggtagttggtcaagaaaaaaaaatttaaaaagtacgcagagacatatcaagcaagcaaagaacgataggaggacatatcgaacaggcagtgttcgacagggatgatgctacagtgatgctacaatgtttttttctctttttttaaattattttattacctgtcgaactgataggtgtcctatcgaactacggttgttcgatagggtgctcgatttcacctaatcgacatatattttttacgatttttcattaaaatcgtattatttccaaaaaaaaattcaaaagttttgcagacctggaaacaaacacaaaagaaggtttgtttggttatacaataatgttattatgcatggtacaattgtcatgaagaattaataaatatggtgggaaaacattaataagtatggtacaattgtaatattatattttgtttttttaaaataattttggatttgtgggatccaaacaacatcattgttatttagcaataatgaaatttattttgttggatcatactagtattgcagaaatctctaggcactcaaccattcactctgttttatttctggagttactaccaatctaaccatgttttcaaatgttaacacaacgttattgttcagaaaatactcctcttcaccaagctggagctgtagacagaatccgaaatcttctgaattttattcagataatgatgaaatcttctgaatatttgtccctgtcatgaacagcagtagaagttgcagcaatggaggagacctcatcagaggcagcagatcgctctctgcgtcagaaggcagcagcgatggttgcctcctccatggagacgtaccggagcaagcccatgtccttctggctgctgctcgtcctcagcgccggcgcgatgctcacagcgttcccggcgtcgagcctcctgtcgcggctgtactacaacaacggcgggcagagcaagtggatcctgtctggtccgccgtcgccggctggccgctgccggcgctcctcctgctgccgtgctacctcgccggcaaggcggcgccgacgccgctgtcgccgaagctgtgcgcctggtacgcgctgctcggcctcctgagcgccgccgacaacctcatgtacgcctgggcctacgcctacctcccggcgtccacggcgtcgctcgtcgccgcgtcgtcgctagcgttctcggcgctgttcggctgcgccatcgcgaagaacaggctgcggctgtcgtcgctgaacgccgtcgtcgtcataaccgccggcgtggtgatcatcgcgctggactccgggtcggacaggtaccccgggatcacgggcaggcagtacgcgctggggctcgtctgggacgtgctcgggtcggcgctccacggcctcatcttcgcgctgtcggagctggtgttcgtnngggtcctcggccggaggtcgttccacgtcgtgctggagcagcaggcgatggtgtcgctctgcgccttcgcgttcaccaccgtcgggctcgccgtgagcggcggcggcttcccggcgatgcggcgggaggcggcggcgttcaggcacggcgaggcgtcgtacgcgatggtgatggtgtggtcggcggtgacgttccagctcggggtgctggggggcaccggcgtgctgttcctggcgtcgaccgtcctcgccggcgtgctcaacgccgtgagggtgccggtgacgagcatcgcggcggtgatctggttccatgaccccatgagcggcttcaagatcctgtctctgctcatcaccgtatgggggttcggctcctacatggttggccactcctctaccaagaaagcatccacaaattgatgtactcttattgttcttctcctggaacatgaaaaatatgtgaactgagtatgttcttgtattgaccaatgctgctgtgctctcattctcctgaaaacatccagtgcgttctgcttctgcgccaaatattcgatcatcgtccagcaaggacacggagagggatgagtagcgagagatggacgttgcaggtgaagaggttggggttggggcattgcgtcgaacagctggcgggctgttgggcgcaaggtgaccagactgcctcccatatgcggcatagcacgtaggagtgaaaacggtacggaaacggacggaaaccatctttatcgttttcgttttcatattttttttcagagtcgaaatcggaaaccccggatacgaaaacggaatcgaatattatcgaaaccgaaaacggagcgaaaatgaaccggcgcgaatacggtaacgaaaatttatcgaaataaaaaacccatcaaagtgataaatccaattgaaagagtaatgttgttgataaattccaatgtaggacaaaaaatattcttatgtaattttagatttgcataacacatattttttatnnnnnttcagccaaacaccatggtattcactatttagtgcttaaaaaaagaatccagggtattttagtcacaaaatttctagtacttctgagaaaattttcggaaagtttcggaccgattccgagttccgacggaaactgcccttatcatttccgattcagtttccaagaaaatatttccgaattcgtttccgttttcgaaaaaattccgaccgacagattccattttcgaaaataggtccgaatccggaagttttcctaatagcacgccgttgttcatagtgttaagcctaaggccttgtttagttttcaaataaatttgccaaaaaaacgtcacttcgaatctttggacatatgcatggagcattaaatatagattaaaaaaactaattgcacagtttacataaatcgcgagacgaatcttttgaacttaattagtctataattagtcataagtactataataacccacatgtgattagccataagtgctatagtaacctatatgtgctaatggcgaattaattaggtttaataaatacgtttcgcaattttcagaggagttatgaaaaatttagatacctcaggaacttaaaattccctcaacatgatgtggtaagttgaggatgagctagtggagaatttcggttcagagatgactgtcagaccctgggacaaatcaagggacctctagtgaacttattctattccacaaaggagaatcgggccgcaatgttaggcagcccaggtcaggtcgccgccgccgccgcgtcgtctatccttccttcaaccaaccctcgcctctaggcagacgcttcgcagaggcaaaagctcgaacacatggcgcgcgccctagtccgccgggctctctccctcgccgccgcggcctcctccccggcgaaaccatccttctccaccgtcgtcgcgccgctgcgctccccgatggacgaccgccttctccggctcctgcgcctcgagatcaactacatctccgaacgccgccctccctacccgtatcctctcatcctaacgtgcctatcccccatcttagctctctctctctctctctctctctg

SEQ ID NO: 56600 - DNA, 7711 bp, Oryza sativa
tagtctaaatggagaaagagattatagatcaataaagttatggctgtcaattttgcagtcaccagaaaatttggagaccctgaacattttgtcttggcttccttttctgttagttgagtcatacgacctgtagactgtagaacaagtggtactagagtaggcaggacattcaattatcaagattctaaaaggtggcaagggctattgtgttgtcacctgcattgcagtgcttacagccttacatggcatagctggcctattgtgtggcttaagcagtacaaggttaggatcccgttccttgtgcggccctgtaaatcttgttttagaacattgttattgatgcactgagggtactgagttacagccagatgttggttctgaagtttcttcctatcaatcatacagagtatggaacaggcagtttctttctggtttttggtggatgaacatgcagtttcttaggtagtgtatctgtcagagtaacccttctacacaggccagtaggttaccattggtaatttctggcaaggctaataatctataagtgaccttcatatataagttcccaatagtttctagtaaggcgagcatggacatatttaagtgaccttcgtcaataagcagtttacatcactggcatagctggcataatgtgggcatagctggcatattgtggctcaagcagtacaaggttaggaactaggatccctttccttgtgtgcgaccttgtagaccttatgttaacattggtattgatgtactaaagatactaagttacaatcatatgttggttctgagatttcttcctatcaatattcaatcatactctagtatgcaacatgcagtttctttctagttttggtggatgaatatgcagtctcttaaataatgtatctgtcagagtgtgaaacgatattaactctttcacccaagccggtaggttagcatcgttaatttatagcaaggccaacaatccaatatgacgtccaagagcatggacatatttaagtgaccttcatcagtaagcagtttacattactggaatgagatttggtaactatatgtgcctgatcacctcatttacattttggagtgtcctatttcaaatcaagtaggagcatcaacaattagtcttgttcatcctttttatcaattaattacccctgaattaacaatcagtgttgtccatttgtcattgtaatttggtttcctgaaacctttgaagtctgaactccattttgcatttgcaggagttccttgctggtatccgcatgactctggacttatttcaaagttcaaactatgggaactgaaaacaaatagcgtctgggaagtgatgataagagctgctgtcctacacaccatgtaaattatccacctcagtggttcaatcccattgttcgtgctgtatgactctagcaatgagctgggttttcagcatattctgtggttcaattctagtcacatttgagaagatcactaggcacgctcgtctgattatattggtgctatggagcactaccatttgctgtggaatacagacaattcttatgcggttggttgtatggcaattgctcgcctattcatttttattttaaacaatataagtagatctcctactgtgcttgttttgaattgctattggttgtattatcgccggtggtgatttgcttgtgcctgacgatagcctgatgtctggtaaggccactcgagcaatctgctttcctgatcagatcaggcggtggacgtctcagatcgatctgtagcatatgaactactccctccgattctattttaattgacgttttggacaatgacatggtttacaaaatatatctctgaccttatttttctattataatatatacaataaataaatgtatgtttacttttattatagtgctttaaaaaacaaatctatatgtgttgttttagttgttttaaactaaatatttttaaagttattaatggtcaaagttataaaaatttgatctcaactatgtccaaaacgtcaattaatatagaataggagggagtatgcgtattggcgaatacatttcgttggcggaggaggtcaagtcgtggcgaacgaccactctccgcaacaaactctattatctggtttcatgaaaatggagcagcgggcttcccctgctatttctgaattgtagagtaggaaaaaaatatttctgaaacagaattataaattaaatcaatatgttaacaccaggctccaaagacaactctctgaacgatcaaacagagccaacaagagcatgaacatatccattcaaggcaaatctaaaatgtagacatgcagtcatgcacaataaccaaaatacataacgggcatgcttttcaacagctagctctaattaatttatgcccgggcattattttcaacagctcaacttaatttataataatttatgcccgggcatgattcataacagctctaattaatttatgcccgtttagtgcatgcatggctattccaagtccataggaataacgctgtcttcagtttcgtctttagttcccataccagatccagtatccagttgcaatggctcatgcaagtcaataggattatcgctcctgctgattgtttcacccagccgcttgtgaggatattgcatatgaaatttcaaaggtctcttcaggtttccctttacacctgcacccagtaaaacagcaaaacaaagggcccatgaattagtgcatatagcctacacacaaatgtacctaacccttcatcccaagccctatgagagtatgacaaaaagaaaacctacgagagcatcaaccaatttagttcaagaatgtttaaaaaatgcaagagcacctaaaatggtcttctctctctccactttgttgggggcagaaaaattgtttctgttttcatttctgacaatttcttttaaaggctcactttgtttatgtgtatgttcttgatatagcgtgcactgacaagaaaattttcatatgaaggcaatctagaatccaaaatgcagttgcatttgactgggtttgtgttccacatagcttgcatgtcatgtgctctctacatcttgtctggaactgtactctataacttgtctagaatctcaccaaaggcttccataattagagaggtaaagagtctagcgaggttcaaaataattccagcctaaactaacaagtccaactagcactatagcagcagccacacaggtttaaaatacatcagcaatcacaactttgaatcaggtttactgtcgtatgcaacacaaagttaccgaaaaaaaaagcaataagtagaaagaacagcgcaagaattaagtaatcacctgcagctgtagtgaaatattgggagatggtagactgcgtgtaggagtaatcaaagtcgttgatgatcctctcagcatcatacacagacaccatttgaagccttttgttggccatgtcaaccatcaacaccaccgccttctcgtcagaggcgtcaaccttgcccatgacgtacacaacattagcatccgtcaagctgagcgtaggaagagctacctgcagctttgccatggccgggcgaccctccagcttaggcaggagctcgacgttgcaacaagtggcgtcgaccgtgatgtcactagaatctaccatgaagcccttttgccagtccttgctgttgtccagatgagccaccggtttgctccatgtggacagatcccaggaccagcaatcagtgtctgaatcaaagaaagtacgcagtccgacaatggtgagaagaccattaacgatggcaatgtcccggcaaagaagctcattcgagagctggtgagctctggcggcagtggcaggtaacttccaggacagccatgggcgagcacgttgcagatgtggattccccgcttgagatcaatgaaggccactactccctgtccatcatcatccagagtaattaccctgctcgtattatagacgatcatttgacgcagctggggtagaaggaggctctccaggctccacttgccatcgccatggatggtggactcgtagaggcagagtttgtaagctgccgtagatggtgtgactcgatggaggtccagatccagagagcacgacggaggagggcaatgttgtggagcgaacgcaggtaatccctctgtaagctggcggcgtcgacgtcgacggggtcccggatgagcgtgagcgaagggcggccaccggcgcggtagacgaggtcgtagactacctcgctgtagaggcggaggaagacgaggtcggcgttgacgcagcctacgaggggctcattggcgaagatccgggcggggtcgccggtcgggcaccaggcgcagatgtaggagacctgcggcggtggggcggtgaagatggtgatctcgattcgatggccattgccgagatcggccgcggcggtggtggcgttccggcggtcggcgatgtaggcgcggacgtcgaggaggatccatggtagaggctggtgtgcatccagagggtccccgccatggcagggcgggcgcagagtgaggtgttcggttttattccacatatagcggtcgacggtagccatggctgaggcttctcctcccgccggcgatcgtcgtccgcccagctgggcttagcttaagtagagcagagtagaggagtcggagtcggagacgacatgcaaatcgatctcagcaatcacaggcaagttggaatcggaggacgaaacatgatttggataggaacggattgccggcgaccgacgatccgcacgatcttccgccgcgtcgggtcactcgagcatggcatggcccgcgcatccacctcagcgtcatcgtcgagttgaggtcgattgatttcgcgctctggttcatgcggtttgtgaattctgtacgctgtgaatgattcgcaggaagttggaggttgaagagatggaatcggcgaagaaattcttggaggggagggaggttgatgacgaacgagccgagttcttgaaaacaggtgagttttatacagtcttaactgactgagtttgagcttgagacgtaatgcagctaattgactgaacctatactttcctgacatttgcctgaccacctcattcacatttttggagcatcaacaattagtcttgttcatcctttttatcaattcattaaccctgaattaacaatcagtgttgtccatttgtcgttgtaatttggtttcctgaaacctttaagtctgaactcccttctgcatttgcaggagttccttgctggtatccgcatgacttgggaactgaaaacaaatatactccaggcgacggttctactccacatgtagtggtcgacggtagacatggctgcggcctctcctccagccggcgatcgtccgcccggccgggctagcttaagtagagcagagcagagtagaggagccggagaggtttaaccatgatgattttttttgacaccttaaccatgatgatttggaatcaagacaagttggaatcggcgaaagatgatttggatagaaacggattgccagcctaatcaaagacgcagcatagtttacagtcttaactctagtacagaaatggtgaggaggtaagaaataatcgctgattacaagtgagacaaaatgtgtagtattttaatatgtagagattttgaaacttaaattttcttgatgtctatgatgagtttacccctgactagtctaaatggataaagagataatagatcaataagttatggctgtcaattttgcagtcaccacaaaatttgatttttggagaccctggacattttgccttgattcccttttctgttgagttgagccatacgacctgtagactgcagaacaggtagtactaggaaattcaattcctttgatcattttttatcaagattctaaaagatgtcaagggttatgtgttgtcgcctgccttacatggcatagctggcctattgtgtggcttaagcagtacaaggttaagatccattcctttgtgcggccttgtagaccttgttttagaacattgttattgatgcactaaatgtatactgagttacacaatcagatgttggttctgaggtttcttcctatcaatcatactccagtatggaacatgcagtttcttaaataatgtatctgttagtgtgagacgttaacccttttacccaagcaggtaggttagcattgttaacttatagcaaggccaataatccaatacgaaattcaggagtatggacatgttttaagtgaccttcatctataagtttacatcactggaatgagaaattcggtaactatatgtgcctgaccaccttgttcacattttggagtgtgatatttcaaattgagtaggaatatcgacagccaatctagttcttttataattcattacccagaattagcaatcagtcttatccatttgtcattgtaatttgatttcctgaatgtttgaagtctgaatgttcgagttccttgctggtatcagcaagactttggagatagtttcaacctgtgggaactgaaaactaaggctgcaggcctctgggaagtggtgttaaaagttgctctcatacatgccatgtaaattatccacctcaacagctcaatcctattgttcaagccatgtatgactctagtaataagatgggttttagcttattcagtggctcagttctagtagaaaaactgcaattccatttgagaaaatcactaagcacgctcatctgattatattggtgctctggtgcactaccatttgttgttgaatacagacaattcgtatgcggttggttgtatcgcaattcgtatactaattaatccaactccataggattattcccatcttcagtttcatctctaattttcgaaccaggtccaccctgccgcttgtgaggatattgtatatggaacttcaaaggtcgcttcaggtttcgctttaaacctgcaaaccagtaaaacggcaaaacaaattaagtgcccatgtgttagtgcaaatagcctacagatacatgtgcctaacccttcacgccaagtcctatgaaagtatgatatgataaaaaaaaagtcctatgagagccaactttgaatcaggtttactatggtattcatcacaaggtttccccaaaagaaaaacaagatgcagaaagaaaaaaaaacaggccaggaatgaatcaataactttgtcccgtgctgatctttctttgattgtaaataacttttatttctcataatgtgaaaaatgcgtcactggcgtattcccgaaaaaaaaaaaagagaatcaatcacctgcagctgctgtagtgaaatattgggaaatggtagagtgcgtgtaggcgtaatcaaaatcgttgacaattctttcggcgtcatacacagatacctcttgtagcctcttgtttgccatgtcaacggtgagcaccagtgccttctcatcggagacgtcaaccttgcccatgatgtaaacaatgtgggcgtccatcaagctgagtgttggatgagctaactggagcgtatccgttgtcgggcaaccatcatccagcttgggcaggaggcaggcgttccgagtgctgttgtcaatcgagacgtcactggactcgatcatgaagtcctcacgccattcatcgtccaaacaagaactgactggcttgctccatgtggtcagatcccaagtgcagtaatcgtcatcgtccgaatcgtcatcatctgaatcgaggaggtaaagactcagtct

SEQ ID NO: 56601 - DNA, 1666 bp, Oryza sativa
aggccactagcaataatcttctttcctgatcagatcagcctatgggttatgcataattggcgattacatttcgttggcgaaggaggtcaagtcgtggcgaacgaccaccctcaaactctattttctggtttcaagaaaatggaaagcagtgggcttcccctgctatttctgaattgtagagtacgaaaaaatatttctgaaacagaattatagatgaaatcaatatgttaacaccacgctccaaagacaactctcgatctgaacgatcaaatacagtccaacaagagcataaacatatccattcaaggcaaatctaaaatgtagacatgcagtcatgcacaacaaccaaaatacataacggggcatgcatgattttcaaaatttcaacagctctaattaggccttgtttagttccaaaaaatttcagagttgctagaaatatggcgccatatgttacagtcgatttttttttagccacttacaccgtagttacacctcatttacaccccacttgcatatgtaattagtatgtaattttcgaatttacatatgtaattttagtacttacatatgtaattttgagacttacattgtaaatacactaaaattacatatgtaatttagggacttaaaatgtaaatacatgccgactatttttcgatgaaaaatatggcgccataaatatagctacactaaaaaattttgcctaaaaacgtcacatcgaattttttgacacatatatggagcattaaatatagataaaaaaactaattgcacagtttgcacggaaatcacgagacgaatcttttgagcctaattagtccatgattagccataagtgctacaataacccacatgtgctaatgacggattaattaggcttaataaattcgtctcgcggtttccaggcgagttatgaaattagtttttttccgaaaaccccttccgacatccggtcaaacatccgatgtgacacacaaaaattttcatttcgtgaactaaacacacccttaatttatgcccgggcatgattttcaacagctcaaattaatctataataatttatgcccggacatgattctcaacagctctaattaatttatgcccatttagtttcactcaaaaggcatggctattccaagtccataggattatcgctgccttcagttccgtctgtagttcccatgtcagatccagcatccagttgcaatggctcatgcaagtccataggatcgctcctattgattgtttcacccaaccgcttgtgaggatattgaatatgaaacttcaaaggtctcttcaggcttccctttacacctgcacccagcaaaacaaaagtccccatgtgtcagcgcaaatagcctacgtattactccctccgtttctaaatatttatcgccgttaatttttttaaatatgtttgaccgttcgttttattaaaaaatttaagtaattactaattcttttcctatcatttgattcattgttaaatatacttatatgtatacatatagttttacatattacacggaagtttttaaaaagacgaacggttaaatatgtgctaaaaagttaacggtgtcaaatatttaaaaacagaggagtacatatataatatattaatatgcctaacccttcacgcgacgagggtgaccaaaatggaagt

SEQ ID NO: 56602 - DNA, 1722 bp, Oryza sativa
atcagttatcacaacggtcaacgggagtggattttgatccttgagaggatatcccctcattatttgcatattaatcaaattgttttaaaaaaattaaaaaaaattgagaagatgtattaacatgtgatatatcactccacaaacatacaagttcaaattcagcttctacatctcgcaacgaaaaaaataaatttgtctgtgaatatacattaactagttgtatagtttaatttattttttttccttgcgagatgtaaaaattgaattttaacttgaatgtttgtggcgtgatatatcacacgttaatacatcttctcaaattttttcacattttttaataaccatttgagtaacatgcaaacgacaaagatattgatatcccctcgagggatcaaaatagtttcccctatcactactttgaattaggtttactatcatattcatcacaaggtttccccaaaagaaaaggcaaaagtagaaaaaaaaaacaaggctaggaattaatcaatcacctgcagctgctgtagtgaaatactgggagatggtagagtgcgtgtaggcataatcaaaatcgtttacaattctttcggcgtcatacatagatacctcttgtagcctcttgtttgccatgtcaacggtgagcaccagcgccttctcatcggagacgtcaaccttacccatgatgtaaacaatgtgagcgtccaccaagctgagtgttggatgagctaactggagcgtctccgttgttgggcaaccatcatccagcttgggcaggaggcaggcgttccgagtgctgtcgtcaatcgagacgtcactggacttgatcttcaagtcctcacgccactcatcatccaaacaggtgactggcttgctccatgtggtcagatcccaagcgcagcaatcgtcgtcatcatcatcgtctgaatcatcatctgaatcgaggtaaaggcacagcctgacaacggtgagacggccattgacgatagcaatgtcacgggaaatggatgaagtgtaggtgttgtggatgttgaagatctcggatggcatcggcatgtagctgcttcccccaggtgtgctgctgttgtcgagcacgttgcagatgaccatgccccgccagggatcaacgaaggccactagtggttgttcatcatccaggataagtaccttctctgttaaatggagcacgatatctttgtctggcgcattgcggagttggtcaagaagaaggatgttgttgctccatttgcagtccatggaatcgtcttcgtcgtagaggcagagcttgaagtggccaatatcgaagcggtgatcccgatcgagcgagctaacatagaagtgaccgctgttgttgtcatcatcatcagcgccggcggcatggcggcggtcagggaggatgacaacgttgtcgatacgacgaaggtagtcgtatgggttgtaggggctgtaggggttgtggatgagcttgagagatgggcgagagctggcatggtagatgagatcgtagatttgatcgctatggacgcggaggaagacgaggttgtcgttgacgaacccgacggcgggctccttggcgaagaacacggcggggtcggtggcaggggaccaggcgcagatgtaggagacgagcggcggcggcgcgatgcagaatgtgatctggattttgcggccgttgctgaagacgatggtggcggtggtggagttccggcggtcggcgatgtaggc

SEQ ID NO: 56603 - DNA, 5467 bp, Oryza sativa
tcctgatcaagactgcagacatagaagccggtggagtcgtcgtcgtggtcgtcaccggcaccggcacggcggcgggagaggatggcaatgctgccgagctcactaaggtaatgacagcgatggaaggggcggtcggggtgccggacaagcgtgagcgaagggcggcggcggcggctgtcaccaccgccgccggcgtggtagaccaggtggtagacttgatcgctgtggactcggaggaagacgaggtcggcgttgacgcaggcgacgacgggttccttggcgaagacgagggcggggtcggcgttggggaccaggcgcagacgtaggagacgagcggcggcggcgcggcgcagatggtgatctggagcttgcggccgctggtgagagaggtggtggcggtggtggcgttctggcggtcggcgatgtaggcgcggacgtcgaggacgatccatgggtgagcgtcgggagggtggccgtgggtgggtggacgctcggtgagatgcttggttttagtccaacggtaggggaagacggtagccatggccggcgatctgcacacaagtttattcgttttagatagaaaaactatctatgtgtgaagatgaatagaaggtatgatactagagtcaggtttccgattatgaaagagaaaaaaaaataaagatgtagccaaactaaatcctatttggaccctaagtcggagcccgtacgtctagttcatgcggtttgtgaatcctatctatcttctgagaatgaaattgtttagccagacattactacagtatgtcagtatatctgtctatctagctgttatcaatacatgcatgcatgcgtataggttttgcatgatgcaaaaatcataggaggactcctattttcatcaatcaaataatgtgtgagattaaaattgcttcaacacattagaacgcacatgcattttctctaatattttcaacacaaaaaactattaatatatatttaatgctagatttagttaaactaatttggtgctataaatattgctaaatttttctataaatttgatcaaacttctagtaagtttgacttaagaaatcaaagcgacttataattaaaaaacggagggacgtttcatattataagtcgttttgattttatagagaaatatagtaatattttcaacacaaagcaaacatataatcaaaatattttcgatgttatatttaatgaaactaatttaatttatatattcatagttttataatgtcttatctgatagtactatatatattgctatattcatgggatgaaagcagtatccagcaaatggttttcagcatggttttcagctttgtggctcaacgctcttatcaaaagttaaaaactggtattattccgttcaagaaaatcactgaactcactcacagttatctgattacgttggcatttctttgtggaatacatacaatcgtgaatgctggacgattggattgcagtttcttgcctacgcatatatctgttcaacaatcgatcttcgtgttttgaattgatgaattgttgtatcttcgtctcccttattttttttacttcatctattttatattataagtcgtttgacttttttctaactaaatttctttcattttatcaagtttatagaaaaatataatagtgtttttaataaaaaaacaaacacatttaatgttaggtttaataaaattaatttgatattttagatattgctaaattttttttaaaactcgatcaagcttaataaaatttaaatagggaaaaatatggaacagagggatcacttgctctttaatttacatgatagtatcggatactccggtaaacgtgatgtctccccgaccaaccattggatcagtcgttaaacggctgagatcaacatgttaggcgaagaagcttcttgacctcgtggcgaacgggcccacttgcagctgcagattcaactcaacggctagttcctcctcccttctccccaaccgttgggccgtagcccaacaaaacccgttccccttcactctctcaccaccatctccctctctctctctctcacgctcccctcctcgcctcgcctgagcagccaccggagcagcagcagcagcagctcgccgccgacgagtcgccgacgacgatggggtacacgtacacgccgacgtactactcgggcctgcacgacaccatcgcgtcgctgtgcaagtccatcctccccttcggcggcttcaggtccggccgccgcctcaccgccgaccaggccgcggcgaggcgccacgccgacgcgctcaagtggcagcaggaatcgttccaccgcatcctccacctctccgcgctccaccgcgagggcatcgtcccgccctccgacgtcgacgccttccgcgccgacatgctcgccaccctcgccgccgccccgcccccgcccgcccaccccgaccagcccgccatcctccgcgacaagctcctcttcctccaggtactacccacccgcatcgccttcttcttcttcttgttctacctccctccctccaatccgagcgagcaattgatcgaacgcttctcccttctccttttgcaggagctcttgtacgccaagtgcatctcggcggcggagtacaactccaccaagagcccactcgtgcagcgcctcgcggcgttcggtgtcgtggtcgactgccccgacgcggacgtcggcgatggcggcgcggcttcgcggcggcaccagcctcgtcgtcttccatggaggagtggtcggagatcgacctccgggacccgccgcccgccgcggcggcctccgacaagccgaagcacaaggccttcgtcccgccatggaagagcagaggcaagaaggagctggacgcatcgaggccaccgttagcccccgtcgaccagaacaacagcaagaacgccccatccgtcctcatggccgagagctcgccgtcggaagccatgcccaccgccagaccgacaaggggaagaggaggcacctgacggcgatgttccacaacggcggcaatggcagcgagaacaaggagcccccggcggcgttcatggaaggcacagatcaggagaaggatgcgtcaaagagcaagaagaagagttcggggggggttcgatgcctcaagaagtggaagaaggaaacaacgatgaggcgacggccggcgtgagccgccggagcacgctgggccgtggtcttcgtacagtgagtgccggcttgaggcgagcccggctgttgccaaggatgcaaagagagccaagaagaagctgaatacggccaccggcgacgatgattctgcttccgatttagcgaatgataaggtattgcaaagtggttgatctctccatcgtgtttagtttcagtaaacagattgtgcaggtgtccattgattggtacttggtagtttcagaattactggactgaactgagctttttgtatctgaacttactgaaggttttggtggagaacacaaagaaagagctttcaaggattcaggctgagttgtcatccaccaaccgaaacttgaacttttcgtaagttttaatctgtctgttttgccaatgaattttttgatcaattactgttgtttgaagtgtgtaaaatgtatgtcctggcatcattgtagggatcaacaaattgaggccatctcaacaaggcttccagtggacaaatctgacctcaagaccttcttcccaaagtactgaaaacttcacaattccgtcatcattcagatttaacagacatggttcagaaattctgagatgatagtatctgtttttgcagggcatggtgcgatgaacacggagacaacgtgatcaacgtggcgaagaaagagttcaaggagcacgtcgaagagatggagaagcagagggacatcaccggcggcggtgatggctgggttgcattcggagacagccatgacgaaaatttcaacccgagagcattctctcagcatcaggctgcagtgaagggtaacgtccatgacagtcttagcagcagtcaacatttcacaaaccctttctatgacgagaagaatcctttcttgactccaagctacgattgatactgcgagtgaatgtaattggtcttttgtgttggaaatttctgtgatagttttacctccaagttactgatgttgtactttaaggttcaattgttatattggacctaggttgtgtatgaattttctatgaattatgagcttgttccatgagcacaattcccagtacctacgacaacaatgtcccgggaaatcaacgagttacgggttctatcaaggtcagtggccttctccagcagcggcaagtagcttccaattttgctgccgagcacgggagaggaagtctaaattaattctaaatccattctaaatttaagtttggatgtctaaattatcagtgccagattaagtccctacagtttattcatatatacagtgcgcacattacaatgtttaaacagcactacaaacatacgaccgaagtacactatcttagttcagatatctcctgcagcctctcgatctacagaagcaggggattctttgcccttcatcttctcggttgaagtgataatcgtaggtaatttcctcccccggatttatgtggcgttccgcgaagaacactacctggacaatgataaaaacacattagaatagaaacagataaatttgccaggaaagaaagagggctggggcgaatattttgaaacgacaacatcgaaataaagaaaaggggtaccttcttctcgttccttactgagattatttttgcgacacagtttggctgatccagcaaagattggaagaaaacaaaacatgcattagaaacattcagttttagatggacgaaaaaagacacagatgagcatattatttgttacttggcaagagtggttgatgaatcttgcgatcccacccttgcgggtggcatcgatgatatgttcctttccaatcttgaagaagtaacaagcactcttatattgctgccgtttcccggactggtattcaatctctcttttgtcagcaacgcattgcccaacaatttcaccaacatactgtacaacctgaaatattttcatgcagaagttaacaatttcttcatttgctaaattcttgtgtcagattatcgactaaggaaagaataactgatgaattaccatagagccacgtggaataaactccgatgtgtagagaccaagcccatgaatgctagatttgtacactaccaaatgcttccatccctttaactgcttgtagtggacatattccttctaaaaatgagaatgaagacatgtaaacagctcatccagtatgtacatgcaaactttgataccccgctaaagcagagtacattacaatgtactatattgaagataaccaactgcattgcagtgaaggattagaagttacctgtcctctcatgcaagatttcgatccatttatgcgtatccaagcattgatctgttcttgg

SEQ ID NO: 56604 - DNA, 6479 bp, Oryza sativa
  unsure (1)..(6479): unsure at all n locations
atatgcatgtagggaactcacggtatttcttttggcaggtgaagcccctgatatatcaaaagcactcattgtgattgtatttgggcattttgtaccaggtgtccacaacccacagaccacatgaacccactgccttgttcgtggaccaagtagactggaattgcgattagaggtccacgacttgctgataatgtccccacgtgcactacctattgaagcttcttttataccaaaagaagatatagcattgaagcttcttgatctgtgtccattaaatgaatcatgcctgacatattccccatgtaacttgcttgtacactcactgttcacatttcctgatgaataaacatatttatctgatctttttgcagttgcaatacccctcagcaagcttttgagaatattctgggctttcaatgcccttgtcatagctccacctccataaccacacagaacacagacctggcaaaggaaaacgtaaagagataccgatatacaattaatcactactaaatgtatctaacaatgaggatgttagtgttagtaagattaattttgactgaagtattttccatgctagtgcagcgtccatacatctataccagcagtgtatccctaaatggttgtatcaccttgatgtaattatcttgatttcaataaaagcttcattctacaaatagccctaaaagaatcagtgaaaaattctatagtgcttgcacacagtaatctgcaagcacaaagatggctgttctggcctacatggctacatcatgccctattaaatgccttaaatgaaactactctgaaattgaattttcttactgtgtcctgggtattgatcttgcagggcttacagaaccattgtcctcttggaacttttagaacaccatagcaagcttggtgcacctacagaaaaaaaaaatgcaaggctctatgtgaatagactccagtactaggttctggtaagggaatatgacaaaccttgataaagcacttgctgcactctatcaactgattggaaggctccaggtttgagataccacaaacacaacatgaagcatctaaactaggcctttgtatatatctgcataaggtattatgcagaactttgtcagatcagtctgtaaaagcaagataaattaataaaaacgaaatattttctatggaacatatccttcaaaggaaatctgtagaatgcacctggagttacaacctttcaaattttgttacacaggcttgaaccgcagcgtgtttatcgccacaaggactgcatgctgattcatttgtaaattcttcacacctctccatcctattaagagatatgcatgctctttgattcttacttcctgcatatggttggtagatcgtgttggtaaaacttctttagcatctcatgtggaaattaagcaaatgagaagtttgctatgcatgcgatgcagtttttcagtaaagatgacaactaatgaccatgttactagttaatctgtaatgtcacacagtgcatcattttgacaaaaatggaatcaaattttccaataaataaccaaaaaaatctaaccaaatatgttatggctgtccttgtcctagactcctacctctacttcttgatgctgacagctgacttgtccccatatctgcaaggctaagaggctcatcttcttcaagtactgaaaaagaaagattcttttgtcaattccatttttctaaaaggaacactgtaagttacttagctatatgttgatactatctgtaatgcagttttcagaattataccacagcagggactttggcagtcagtcttgacgtgtggcctcgagacattagatgaatacctattctttttgggagaccacagttcatcttgtggactgaaacttctgtcaccagaggaagatttatctgcagaaccatctgaactcttttcctcagaaaaatggatattttctgtcttactgaggggtttgatagcatgacatctcttagcctttttaagaatcagattgagtggaacaattttgggagatttccgattatcattagttattcctgtagcaatcaaactagaatcaatactggcactcccactacaggcatcttcactgttagtttcatttacaatgcaattcagagacacatattttggcagtttgcggacaagcaatcgactcccttgctgttggcattttgttctatccaaagtggtcatattatcttcttgcttttttctatcagaggaatttgattctccaacataaatgccctcatcatctgaccgttcattgtcaacattgagaactttgcagttgctgtgaagccgtttcacatgtttattcagatgcgtgggaggatgtttcctcttggtttttgatactctgcgtgaaaatggaccagccttatgctgcggttgagaatccccttcccgggatgacagatcaattttcctagtacaatcatcggattctgatttgtttgcacagcacctcaatgttcgtgttttctttgacatttcagaacattgtccctcattctcatgttctttccgtgtacttccctcagaaatttgattatttttgtgcttcactaaagatggctccaggtgaaatctagaaaaactattttgggcttcttcacatcctgtactaataggcaaatagctggatgaggaacatttctcaattcgtgacccttcatcaaacacaagatttttgtgttcaagaccatacttgttcaattcaggtgatgcagaaaacttggtcacaacatcgctggagaatccagaagagaaaccggattttagttctttaaatattccagaatctctacaagcactcgctttctcttttacagtttcatagggccaatggccacctacagccgatgcttctgttacattcttcagctgctgtaatgtaggaacacaaggtcggttcaatacttcagtagagacctcattctggaaagaagctttagagtcgctttttctagcaattatctcgcttgagcactggcatattaatttttcactctcccctagcgtgcaacatctggcagcagcttgcatgccatcatccttgctcttttgtactgtatgatcagtttgatcgattctagcaacacagtgctttgtaaatccataacctgccaaacattttggggctaaagagcagcagcattttccatcccggtaaggactacattctgtattattaggtgcatcaagcagagtgttcttagtcaagctgttggctgtgtgtcccatagaactgcaataagtaaataaaagaatatgaaagggagcacagcgatagcttcaagagcacattttgcatgatagcgcatgtatgctatcattgacatgtgtatatagatatagcatcaaacaaacgtctaagctcatttccttgaaaactaagtgtaaccttcagcaaaaattgatgtcatcaatttatcttgtaatgatgtgaaacagcacacataagcatatgtcaaaatggaaacaacgaagaaaggctcatctatacaacctgtttgacaggccgcctgcccattttccagtactcaaatcaattaaaaggctggtcttaagagcattgctaagaacaggaaatagcaagtgctttcaggccaaattagcattatacatacactaggcagtagctatcatctattagaagnataggatcagaatcaaggctagaatttgaatatgtgaagagtaaatcttggtagcagtgatggaactgaaatactccctccgtttcacaatgtaagtcattctagcattttccccattcatattgatgctcatgaatctagacatatatatctatctagattcattagcatcaatatgaatgtgggaaatattagaatgacttacattgtaaaacggaggaagtagtcattaacaggaatatgtgaaattcaagataagaaaaagattgagtaagggcctgttcactttgatgccaaaaaaagccttaccaatttttggcattaccaaaattttggtatagttgccaaaattttggaggatttcttatatagttaccaaaatttggcagcaaactaaatgtagtcacttttttggcaactttaccaaaatttggtaaggttgaaaatggcatcaaagtgaataggccctaaatcaaaataccttctgtagtacccatcaatgggacatgcatggcaacaggactgcaacataagctctctagaacataatgaggatcttggtatgaaagtagagcgggtgcgcacttcatctagccctgaaatatgagaaagtgtgccactgaattaaaacaagacaacattcaagaaaataatcagaaataagaagtgatgtctatcatatcacttgcactgtgaagaaaccaaccttcaacaatagacctatgggctggaactggagtgccatcattacagaaatgagatcggcagaaattgccagctctaaaaccaagtttggaagaatcttcttgagctttgcaacagcatctatgcattgattttcctattggcgattgatcattttggccaaagctaggtagaaactcattagctgtagaacaaaaggctcttccacactgataattggtagctctcaaacttttatgtgtgcacaagtcatcagcacattcaaaagaaatatatctcctggcctgcacataatgcttgaagaatcaaaagacattttggtggttggcagtggtgacagtggttacttgtgctatgagaaagtgtaagatcaacttaccgttctatcataaaaacagggagccccagtctcagaatgtgcaagatgggatttgtagcaacatgattacaacacctgcaattncactggagaagaaacttctgcgcaaattttggagattccggcgttaggttgactaggcagcaaatgtggcaggcagtccccatttattaaaggctcttgactatttgcatgaagtacatcttgatgaacatatcccttggaagccactggaactggaagagacctgctatctgatatccttttcgtgtgaataatggcaggtgccaacttcaactgattatcatttgcccttgtctcaacttgtgtacttgcagtttttaaacgatcggaactatatgcaacatctggagccttaagaaggtaatgctcattactgttgagaacatcatcaatggactcagatgtatatttctctcaagatgtgaaagaaataatgaaataaatgaattctttgctgcatcatctgtaatctcattgagttcagaatggctggttccattagaaacatcaagtgatcgtttcctattacctgtaccaaatgatggctcaatgttttctatagttttgttggctttggtagtttgcttcggataagcatctgcaccaagtgattctggcattatatgaacattacaggggaaatgctctcattttacactaaaaaaaagaactaagcaaaattgtgtttcttctatggtgttaatgtgttataaaatcataccagaactatgttgttgttcacattcattgtgctagtactagcagcttcttatggtgtttttgtcgttttgtgtattcagtcagcacctagcataacaattaacaagctcttgcatatctagcgagaaagcaaacagaactacacatgtgtggatgtgccatattaatagttaatacaagttaaattctacccaaatgataatgtggataacaaaacaattacatttgcagctaataacaggaaagctcacttggagttgtgaattgcaggtggtgctgaggtttctgaaattcgattattgtcgactgcaccgatggaaatagggtagccatagattgatgataagatgattgccccagcttcagttcggtgtttgatgctctacctgaaccatcttgaattattttgtgaggtacatcaggcatgcatgccctactgtcattgctcaaaactcttgtagaactaggaccaggactacgagacaagttatttaagtttttctccagaaagtttgcataatcatgtgccaaatgatttctactgtaagttattcccatgtttgctgttgaatatgttcgttcacttggcctgctaatagagttcatgttcatgtcatggatcatatgatttgctaagtttattttcgaactctgctgtatagctggattctttgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56605 - DNA, 1133 bp, Oryza sativa
ttaccatatttcttgagaatgttctacttcatgtaatcacattcatatcacactgttgcagaggttcctggccttatactatctgcggcaatagtggacaagattgggcgcaaactctcaatgtcctctatgctttatatcagttgcctgtgcatagctccccttatggtccctcaaacagagtccctgacaactatcttcctgttcggtgcacgcatttgcatctccgcaagcttcattgtcttgcacatctatgctcctgaggtttgcttgatcactcccaacatccccaatacttggttacatcgcttgcaacaataaaaagggaaataaaatcacaaaccattgcctcatgtattatcttctttccttgcagatatacccaaccgcagtcagggctaccggagtcgggtttgcgagctcaatcgctcgtttcggtgggatcttgtgccctcttgtggccgttggtttggtgcacgcgtgccatcagactgcagccatcctgatattcatcacggtgatgctcgtctcaggtgttgcagtctcatactttcccctggaaacaagcggccggaaattgagtgaccacatcgcggcgtaagagctaagttgcgagcagaatctgacagtgttgcaagtgctagtttctttagctatacaaaattacaggattgagctcctagaggccattcagattttttttttctttcagttcgtttaaagatcatatatatagaatagaaatgaaagatggtggatttcagattttaaatgtcattacattgttttaaccagacatatgtaaactgccaaatcgagatgcttgctttgctctcttgaaatgggatgatcaatatgttttgaaggaattatagtgcgtcgatcccccttacgcctcttttctttttgcaacagtactgtatagttttacatggcttataatattatagttcaaaaaaaaattcctcgctagaaataaaaagtgttgttcagaaaacgttcggtacactacaggcaatagggggaaaataccagtaaaaaagtggtattgaactatttttttcttttcttttttattttggctgctgcttaattaatgggccgtgttgggccggcccactgacagttggcac

SEQ ID NO: 56606 - DNA, 1137 bp, Oryza sativa
acttgtcggggcttggattaagcggcacgctaggttatcagctatcgagcttgaaatcagtaaccaaattgtgagttgcccctgtgatttcctgtactgatcatcctagttatgcaacttagtgaattttttctctttcatagtacagcgatgtcagcaagaacaatttaaatggtgaaatcccataccagcttccaccaaatgtggttcagttgtaagtttctggatttgtccatacgtacttgctgttttcatgggtaatacaagtgtttttttctctagcacttttttaaagggttttcttatattctcttttctctaatacagaaatcttcgaggaaatgccttcagcggtggtgttccttattcgatatctcagatgactgatctggaaacgctgtaggaacttttcattcataccactatattagtattttcagttgttttgttttcctgtacttacgcatgattctgatatctgttttgttgataacttgaaatcttttttccccatggattacagaaatcttggtaagaatcaattgagcgggcagttgacagatatgttttctcagctgccaaagcttacaacaatgtaagcatgatttataagtttttccacacaccaaagaaagaaaaaaataagagttctctgtactttttctattacatacctacataattgtaatttcgcgcaatgcaaagtaatcatggtgccaattctcatgttacttctattgcccaaatcttatatatcagttgtgtcttcagggatttgtcattcaatagcttctcaggtaacctgcctccgagttttcaatacctcaagaacctcaaaacactgtaagaaactgaattttatgaactatagtaattcatcgataagttattttggatgctcaattgactgccattgtttccaaaatatatacagagatgtggagagcaaccaattcagtggtcatataaatgtgctggccaaactttctcttgaggatctgtaagtgctattcaagtgaaaactgcatccggaactactcttatcattgtccttcaaaatatattattcctaaatggctcacagcggcaataccgaagtattgatgttatcaaatatcaagagctgttaataaaatt

SEQ ID NO: 56607 - DNA, 6832 bp, Oryza sativa
  unsure (1)..(6832): unsure at all n locations
ttctggtcacatgatgaaggactggtgggaactcttggtcatctgggccagctcctcctggcatggagaaggagtcttcggcaggaagctcaaatggaagggatgatagcggaatcaatggtttcgccattggagcaatggtgatagctgtgcttcttgcagctctgattctcttgtctgtgctgaggaggaatcattcctctcccgtctcatctcattactacacggatgagtcaggtcagaaccaaccatttaccccgctagttgatgactcgagaagtatttatgcacactgtatctcttgaattatagaaaactacgtgggttcctttcagccgtgcatcattttgtgatgtgtagggaactacgaataattaatgtgatatgtgattctggtaatttaagtttgagacgtgcactaagagttctcatcttgcttcattttctaggccgtaggaattcttcagcagtcaacatgaagtcactggagcattccccatcgatgggctgtaagacaccgcctgctgttcctcgcaagtcgatgagtgacaatgagtttgagaacaaactgaatcattcgaggcgaagcacagaccccatcagcttgatgaatcattcatcatcagacctacaagcagctactggcaacttctctagtaacagacaactaggtcaggggacaaccggttgcgttttcagggcaaaatatgctgatggacgggtaggctcctactgtttgctttctaagatctttccaaataaacttgtttacaggctcaattcaggtaatcatctgagtaaaaattgaagtgacacaaagatcatgtcaaatatgcatgtaaaacacattgcagtaaccaaattattaaactgaactagatactaaggtctcaaagaagaatgcttgaagagttcaaagaggtcatataccttgaattatgtgtgtactagctcatcaattaccatgaacaaatttcaggtactggctgtcaagaagtttgatccattgagcttctcaggaagcagtgacttcatggacaccgtcaacggcattgccaagctgcgccatacaaatatctctgaacttgttggttactgctcagagcctgggcactacatgctggtctatgattaccatatgaatggatccctgtatgatttcctgcacttgtcagatgactacagcaggcctctgacctgggacacccgagttcggatagctgcctgtacagcccatgctctggagtaagttgacaagtaggagtaacattgaatcctagaatccaaaaatacatcaatttgaattcatgtgtaagattgtatccctttcttgtcattcattcaggtacctacatgaggtctgttcacctccagtgctccacaaaaacataaagtcttcaaatgtcttgcttgatgctgatctcaaccctcacctctcggattgcggcctttcattcttctatgaggtttgcatgcagagtggctcttctttaacaattgatgaacaaagtataataattgtaagaacaatgtggtctaacggtagggaaatctctacaggacgcaagtgagaacttgggacctgggtacagtgctccagagtgctcaagaccatcagcttacgtgatgaagagcgatgtctacagcttcggagtcatcatgctggagctactaaccggccgaaagccttatgataggtgaattaagggggcaaaaagataaaaccttgaaattcactactgatatccataatgtgatgcatcatctaatgtctgcactctgcacattatgcttactttctctatgtggctgtctgatggttctacagctccaagccaagaacagagcagtgcttggtcaagtatgtggctccacagctccatgacagcgatgcgttgggatcactggcagatccagctctacgcggtctctacccaccaaaggcgctctcccgcttcgccgattgtatcgctctctgcgttcaggtgagctccttattgtcgaagagatatccccatcaatgtgctccatgtctgaactctgaagtaatttcagacatagtatgctatgtcattcaacctgagtagcaccccaaggtccttagttcaaatctatatatgagcgaatttcatattggttatttgagggctaagttcctaactttataaaggctgtatatatccggttgaatgtagagtctaggtaaaaaaaaaaccttctattaaaaaaataaaaaaaaaggtctgaactctcaagtcatttcagacatactatgaagctagtagtctgaactctcaagtaacttcagtacagtatgaagctatgtctgagctctgtactgtactgataatgggaaatggggggtgggattgggattgggaaatgaatgaagggttaggattaaatagaagagggagaatgaatggttaggatttaaagatgggtgggaaatcatttccctttcccatttgccaaacactacctgaagttactgaatttggtcttgttggtggtgatgcaggctgatccagagttccggccgtccatgtcggaggtggtgcagtcgctcctccgctgcgtgcagcgcaccatcagcaacagggggatggccggatacttaagcaactcacagcggagcgacatctccgattggtgatggtgatgcacttcaccgaatcattgccgactttgattgaggtttatctgaagcaaaactgcccgtcaagtcgttcgtgccatagtacaaaaagaaacggctttgaggttaagagtaatcaattggttaatttttagagaagacggcaagaatgcgttattgtattctacttgtagtgtatattgtactgatttgttcttccccctttgttttgtttttatcgctctaaggagcacatgtaaaagtctgatactggagtagatagttagtaaatgaatacacatgtaaaaggcctctctacctagccaacctaggtaacagcaagttcagtaacaggcattgctgacatagcatgaatcccctgttgtaagatgacaaaacatgaattcacaagctcaatgatcactacttatgagaccaaatctcacaacacagctaaaaacagccgtttcctagcaacagaagatccaagcttaactagcaaactatagatgaatttgcagaactcatctagtcttgcacatagtacccaaaccgagtatacattgtcacacaattacagggctacaacaaaatgaaatgggtgcactcaatcactgcagcatgacattgaagtttgaacatacactagggggtacattgctaggggaagtatttcacatcgcagtggccatgatagtttcatttcctctgcacactctactcaaaactttcctacaggagagaaaagatgttcaaattaagtaacagaacagatgagatgcatccaggcattttcaatggacaatgtagattacctgcatggtgcaacctcacagacttttgtcagtttaaatgcaagctgtgcaatggcaattctgattgctggctctgtagatccacttttgcagcttcctccaataaagcaaggaactccttctgtgctctcacagacacaaaaagttgacttggcttataaatcatgctcaaatccgctacctaggacaacaataaaacccacaatatgaataaagcgtataagctttcttggcattagcagttattgcgaaacataaatagactacaagtgaactacctgttgaagccaaggcaatgccaaatcaaacatttttttattcagaaactggccagctataaccctcaaaagttcacttgttgtttcacgtgacaatttctcaagaacaggtccagttctatccattacgtcaatcagataatcacagtcaccactgttcagggcttctacatatgcagacgccatgtcatcattaccatcaaattctttagaagcacnnnnnnnnnnnnnnnnnnnnggctgctcacaggaattggtaagtgaaactggaaagtttcccttaacccctgatgctcgagtccttgctgagcttggaacatatcttcccagagcactttccgatctcacaaccccaggctttctagttttgtcatgagtatgactctttagaaattccccctcttttacacccatgtttaagccctttgatggttgatcttgcatccactttttctcttgtttcaaatgaggaattggtggtggcttatagttagcatccacagatgatctaggtgtagaagtagaaaccctcggtgaagaagtggcactttggttcttaataaacttggaaccaggaaggtgatagcggctttcactttgagtaattgtatacacagttttgtctacagcattctccaaattatgcactttcatgcttaatactgacatgttctccactgagttagacatgaattcctgcacagtgaaagaaagtaagcaattaggacaatatttaggacccccccccccctatactttcattacataattgacttgtgcagtgctctttcctacacgatattatggaggatagcaaaagacaatcactggtatgagtgaagatcatgatgcctattgtcattatcaatttccctttttgtttaatctggcaatggacttatatatataggtaactgaaatgcacagagcttattgattttcaaacaatataatttccctcataactttaatcaaaaccttgctattacattctgaagaaaaaccattgctgaacttaacaatcagacacatatataaacatttttccagaaacaaccaaactatagagagtagaataaaaaaaacaacacaaaataacaagaattacctgcaacatatcaaagatatttgcttgcttcctctccatctcttgaagctgcttcctgatatgagatagttctttcattgcacccaaacagcaagtatgtgtcccatgtgaagtgatatctgtaacagtggagtctatgctcttactcttttgagccctggggaattgctcaatgtctcttgcagaatcacaatcctcaacgcattcctgagcagaagtgacatgctttgtctcacaactcctgctggctacttctgacatagaggagcaatcttgtttatcatccatggggtcatactcatacttgctgtcattgtctacgatttcatatggacttctatttgaaccctttagcatggaaccattgccagacaccttttcttcaaaatcaactaatggtatcatattctgcttaggaacagatatctcaacatgccaatcgctcaacttcgagcgttgctgatttgcagcattattcagggctattttattgatagacagaggagatctcttctttgatgaagtaatagaattgccactgattgcagaaacagaagatgcaggatcaactctcctgaaagaagtgtctcgtgatccaccatcatttatacttctaccatcatgatggtcaccaaagaagttttctgccataaatgaaatcaataaacaaaaaagggagaaatttatgtggctgctgtaaacttcaaacagattctatgttaagctcgtaaaggactaacaagaaaatttaagaaaagagaccatagagatctggaaatctggggaaaaaaatcctgatccttggacagacctaagcagtagatagacttggcatgcaacaagcaacattgaatagcaaatcattgataaaccccttatcttttgggtcaatgcactagttctcaagaaactaaaaagtattatgagagtacaaattgctaaaaaaaacaaagggattagtattgtcaacaagcttcagaaagtagtatccaatctcttcttttaatttgcagaagtcagaagatcacaccaggccaaaaatctacttataaggattgtaataccttttgtggatgatccagcttctgatggctcgggagtatcagaccctggaataaccttccacaactgaatggcttgggtaattgcatcacgcactggtttgacctgtgacagaagtcagaaaaataagtgtagcatatgcaagaaaatattacagcatgaatgtttagtatgctgaccttgtcaaatttagaacgttcaagggagcgaaggcaggaagttctaaaggaggcaaccagatatccagaactgagagcaatactagatagagctattgaagctgctttccttgtagtccaatcactactcttcagggcatccataatacttgttagagcagatgttaaagactgctctgtagaagcaccttcagcctgaaaagtgggacagcagaaaaataagaaatgttataaaagatcaatctcctgttttggctaacacttgtaggacgaaatcaaaggatgaatatgactaatctacttccaagaaggaaaatttgatctatgacaccaaaaggatgaacatagctaacacaattatcctgacaattgtattgctgaaaatccatagaaagagacagccatattaacagtctcaagatgaaactagaagtttgaaataaaaatagacactcgactttttgagaactcctttttttatgtgaaactgactgagcagtcatataataaagtactcctggctcattatactaattactccattgcaattacttatgctaagctacttaaacaaccaccagagataagcatggaatgcaatcaccttaaaatactgaaagcacattaattaggtactactagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56608 - DNA, 21563 bp, Oryza sativa
  unsure (1)..(21563): unsure at all n locations
aaactaacatccaaaagcataaacttatattaaaaaccaacctttccagcaggagatgctagatgtcttagcctctcagcatctttgggatcagatgcatgggaagccaaagcaattaaagcactctgcatcaacaaattaaaaaatattaacatcaatacaaatatccagaaaaaatgcatatagaatgtaacaagatagatctgcaaaagttcaccttcttaggaaaactcagaaggtcagcatatctggcaagtgcagtccccacagtacagggggacgggaaaggaggtggcaaagaacccccaaaaagtggagtgccatcctcttggtcagcatgaattgagaataaggtatctggtgaataacctaacagattttctacctcctctacagtctctgtgcagttttctgcatatacaccaacatgatctccagtctcatatctgttaagaaaatgggggtcatcagcagtctaaacaccagtaagaaaaccgtgcctgcaattttgtcaaccaactactaaatttggaaagtaacaaattcagatacttacgtaagaccagtccctgaaatatcaaactctaaatgaatgcaggaccggtaagaagccggcgtgtgaagctcccgccgcacagccacatttgctctgcaaggaaagcatgatcagaatttgttcagaccacacccagtgtcccagtgcagtcaaattaaagaaataatctcatacctgcaaggatgctgaatgtcatatacagcagaccattactgagactaaaggatttgttgatatgcatggcttcctctggcttgaccaatacaactctatattcaggaatagcagctgtgtagggagttggtgctgccgatttatcatcttcaacacggagcaatttatccaattctggccatagaagttccttcctttagttgaacaaccaaagcattagcttttgttttatgtctcaaagtctaaagttgatatcaatgtttaaaaagtgtgcacaaatagaatcagtgtcaaaatgatgcctgagttcaaagttgagacaaagactaagctaattacggtacgtaccatgcattgaagtcatcctcaatgcattgatcatcatctccaagaccaagaggaacaatgcgttttccacctaaaagagatgtggagaaaagttaaccaccaccaaatgatacagaacacgacagacaggaaaatcatgtgaccagaatgttgcaaagatcaacaatatctcactgaattattacatggtaaacctgttgttcagatctatcggagacaagtccgatttgatttagttgcacacttacactacattaatactagctccccttctgagtctaaaacactctacagaatatcggtagacagaaaaggatgaagacaaaaaaggcacagcattaaagtcttaaagcatatgatcctagtagcaaaccaccctgataaaattatgatgctttccagagcacgttactaactacctacataaaaagattagataagttgtatcccttatcctgtactcttctcatacagtataatttctgacaatgtttagtggcatacaattcttaggtgagcatgaacagtacaggcaaagttatgcctttgtaatatagatgaaaaaaatagtgcattgtagttattcgaacgatggttaccttgttcagcgaggagttggtcaaccacctttccaaccttcagtttaaaaagacaatgtaagtatacaaattgggctctatataaaagcnnanttcaatgtagaagcaccagcaaaccttgttaaaatgctcgtactgcctatttccgaggccaaagaccccaaaccgaagattactcaaccattcacctctctcattcccctgcactccagccaaacaaacaggccgtcaacagaaaatacaacgctcacccatgaaagggccatatgaactgtggatttgagagcaacctctccaaaccatttatagaacctcgccgcattgtcagttggttccccatccccataccttcaacgagaacaagaatgcaactcagatattcattggaatcaaaattcaaccattctagtttctcctgaattaatcaatatcccgtcagaagtatagtaaaaagtggagatggcacctacgttgccacgaagaacaaggcgatgatctccttcttaagcttctgctcatactcctcatcatccgcagcatactcatcctgaaccccagaacgaaacaggcatgaatcaatcaatacatagaatgcaaaagcacatgaaattctgaagcagcgttagtggcaaatcgtggcggcttaccagatcgagcaccttgaagacggccttgtcgtacctcgacttggcctcctccgcaagcgcctgcgaatccgcaaccaattaagacccagggttttgctgcacgagaggtgacagacagagagcgagaaaatctatccaaccttggcgaagccctcggcggtgccggtctgcgtgccgaagaagacggcgaccctctgcctgccgtcgtcggggtcaggctcggcctcctgcttcctcttcgcgggggcgggggcccgcggctgcggctcctgcgccctcacggcgggcgcggagatggaggagcggcggacgagcagcgcgacgccgcagccgacgaggacggcgagggaggtggtgagcaggacgatgaggtggcggttctcggcgagcgagggcggccacccctcctcctccggtcgtccccgccccgtgagcagcgccgccaccaggtccagcgccgacggcctcagcgccccgccgccgccgccgncgncggagtccatagcgcgcgatgggatcgangcggangcggangcggaggcngcggcgcgcgcgtgcggngtggtggccctagtacgtgggagaaattgggcgaaatatttttggggttttgtggagttgagcgaaacggacggtgatgtgcgatcgatcggtacgtggtgtggtctgtggtggcgcggtgtgagtgtgtgacacgtcccgtcgggttgaggagagcgatgcacgtttcggcgccgccgcgacgtttggtggtgcgagtgcgagtgcgagtgcgagtggctcgtgcgccgcatggtttcactgttttactatagaacgccctcgaagcctctcgccataaccatcgccgtcaacaacaacgtacaacaaccacaaccctgcgaacgccttccagttgctcgtcaccatcgtcttgattctcgagccgtcgagcgtgttcgatcctaccaaattttgatggggggaaaaaactgaacatgttcttaccaatgctattctgttaaattttgctaattctaaaagttttcgctcttcagaactatacaaaattttgataagatttcgaatcaaatatattcaacactacttaaatttgataatatcaaaatgtacctaaatttaatattatcaaatattggtttggttgaaagctcctataaagtaaacaagaccactatctctagattcttgttggcgctgacagtaagtacactaaagcattggtaggccgcgttgctcggtgagaccaatatgattatcacagtcacctcttgttcgggcaaaattccctccacatggagtctttgctttcagcccattgcaacccaaaagtctaacaaatatgagccattgatttatgccttgatcaatgatggaaattgtctcatctctttatgatggaaagaaaaaccctaccttccattgggggagagatagtagcggcgattggggtgaagaagaaactagcaaaacacaagagagggaaaggagaggggagaagatgtgcagtttgttcagcttgggagctcttaccctatcttcatcaagttagcgattagaggctcgaacgtggttggattggcactaaacttggtaagtttgtttctcactttgagcacttcaatctggtcgatttgtataaggatgggttgaatatagcaccggatttgagtggtggtttgtcagctcgagttactgcagttacagcttgcgcaacaattggtagaatgtcagtttgaggggtcaaacagtgtccggttggactgtttttttggatagcttggaagggactcgtataccatcatttctgccaagtttcgtgtaatttgcatctgtggtttgggagaactcacctgagaaccgaagatggcctcttgttagctttgatggttaatgttgatgatgccaagtgtgtaacttaatgttatagctgctgttataatatgcctctagatttttcagagaagactccatgtatatcctaattgattatagttgaagcttggagtggaccgttggttccgtggtttttttatcctcacaccgaggaggtttttccacataaatcattgtgtctttatgtgcatgtgtttattattgttccgctgctgatctgctagtcgaaaccatcctcaaagtttatggcaagataagggtttgattgtgtgaaatatgtttatcagttggtgaattgtaatttgcacattgaagagatgtggttgagctccaacacctcacacattaacacaacccattcgttgttatttgtagcctctcagttaagtaaaagcagatatcttaatttcacatcttgactttatgtttttatttttacgttatttgcaacctctcggttaattaaaagcaaaggccttaattcaacattttaaattagtttttaactttattgttttttctttattatttgactccaccacaatacgagaattcactattgccaaaaggttgggttttttttttcaagttcttgtggtaaccatagatgtgtcgtggttatattcatgccacccagcatgaataatgaactgttccaaaattactttaaatgcatgttgaataaagcatgctcgcaatgcacctgtgttgcaccaacctggccgtactcttttttttttttttagaaaaacatggctgtactcagccgaacaaacttgtgctgtctgagtatattttcgcttggttttcctttgaaaactctgaaataataaactgctaaaaaaatcgaattgcatgtgtatgtccatgctgaataatactcctacatggtagtgattccaatcaaatcaaagagatttaattaagagtcgtgtttaactagaggaggagacctcggccaggtcggtctcgaacgctttgacgaggttcccaaagtattgccgcgtcaccctggtgagcccggcgagcttctccctgtacgccctgtacttgtcgaagtcgacggcggccttgtcgtcggcgccggcggcgaagagctccctcctctccctctcggcgcagccgtgcagccgctccagcgacgcgttggcgtcctcctgcaggtactcgaacagctgccgcttggtgaagtcgcggtccgggtcgaggtagtagccgtaggcgtgcgcccagccgagcacccgccgcccctcgccgacctgctcgtacgcctccgtcacgaagcccatctccgtcgccggcacgcccgccgccgaggccatcgcctccagctccgaccgctccaggctctccatgtcgcggagcgccacgcgcagcgacttgaggttggcgtcccaccgctcgtagtggtagaggtacctgtccagggacgccttggcctgccgccgccgctcgtcgtcggcgttggcgccggccagcgccaccaccgtgccgttgggctggtaccgggagcacgccgcgtggccgtgccatggcttgaggcagatccagcagaactcgtggaggcacggcggccggcatgtcatgtgcatgcacccgaggttcttctcgatcggcagccggcacttggggcagtgctttgtgtgggcgagcagccacgtcgccgtctccgactccgagctgttcttctccacccacttcgccaccgtcttgcacgacaccggccggtgcgcctcctcgccgcaccaccagcacagcccgtgcccgcacgagcagaacacctcgctgctctcctcgccgtcgccgccgcccacgaactccacggcgcggctgcacccgggccccgggcaccacctcatcccggagctctcctccacgtacgaccggagcgcgaaccagccgaaccggtccctgtcctcgccgtcggccaccgtgtctaccagctcgcgcacgacggccgccgggcacgacggatccgggcaccggagcgacaggcaccgcgcgccgtcgcccaccgccgcgcggacgtacccgcgccagcaggagacgcagtagaagtgggagcaccccgccgacctcatcccgccggtgtcgaacacgtcgaagcagatggcgcaggtgagccgccgccggttgacccgcgcgggcacctcgccgccgccgccgtccgccggcaggaggccggcggcgtcgcgtatgcggcgctcgtccaggaaccactcctcctggagcaggacggccctccacctgtacagccggaggaggacggcggcggcgcccggcgagagcgagagcacctcgcacaccttggcaatgtcctcctcctgccgcgcgcgtacgtcgtcctcggttagaacaacgtacgtcttctccatcgccggcgcctccgtttcctcgaccacctgcccaccatagtcgtcgccatcgtcatccatgtaatcgccgtcgtcgccataatcctcgtcggagtcgccgaagtagtcgtcgtcgacgtcgctgtagccggactccatgctagtagctgtccgagatggcgacggcgaggacggattaattatcgatcagccagggtttaattaaccctaaccctcacaatttggcctcgcgcgcgagcctttatcggatcgagatcgcctcgtgataataaactgtttcgtttttaaagattgcttgctaaaataaatcggaatcgccttttttaaataaataaattcggaatcggcttcttagctaaattgtacttccggatattgcacgcgtgtttctgtgcggctgttatgggtggccgaagattggaaaggcctaggcccttagcccggcccattactgagaattcgattacggcccctttgttctcatgttattaggacgtcttttatacaagtacatacaaaacataacgagcctagacacctcccggtaaaaaaaaaagcaatattttaaattttctttataatctatgacgtgtgattttttttcatataataatttaagtgattatgaaagcaccttcaaaatccaaatcatcacatgctgtttttatgttttcaaattaactttttaatattattaataatcaacattttaaaagtttaatcaaatcgcatacaaaatgtcaaatactaataactgaagggagcattggtgatacacgcttataattggtagccaatgagcctttattccaatttaaatagagtaatacctagagaatttcgtgctataatctttataattttgaaaacattatttcacttgatcattttattggcagaagttagggtttatccaatcacttcttttttttaattccttctttttcatttatgggacttgttggctgtgtgcacatggccacttgggtataaggagcatattgatccatgtatttttgaaagaaataaaccatagtatttgttaagtgtaccttataaaatatgaattcctaattcgtaaaaaatgttggcccaaccaatggatcaaggtacaaattttcctgatgtaattgagtgatcatcaagtattctagtactacaaaagtgttgtcgttaatttgcacgtgatcctacgagctgtcgtcttgatgaagaggctgaagaggatcaacaggatcgtcggagctctcggccggacctgtagctacggcggctgcggcggcggcggcaacagcaggtcccacctccaacaggccgtcctggaacgtcttgacgaggttacggaagaagatcttgcagacgccggtgagcccggagagcttctgccggtaagccacgaccatgtcgaccatctcgccggccttatcctccatcttcttcttcgactcctcgccgtcgttgtccttgaggatagcgttcaacttgatggttcgttccacctcggcgaggagctcctccctctcgtgctcggcgcagtcgtgcagcttctccagctgccgctcggcctccccctgcgcgcactccaccatggtgcgccgctcctcgtcgccgtcgagccccgtgcccaggtggtagtacccgtacgcgtacgtccaccggagcagccgccggcactcggcgatctgctggtacgcctccgccaggaagcagagctccgtcaccggcatggccaccgcggcggacagcttctcggcgcaggcgtcgaggccggccatgtcgtccaccgcgctctgccgcgccttcccgtgcgccgcccaccgctcgtagaagtgcatgtacctgtccagcgacgccatgccctgctcccgccgccgcttgtcgtcgctggcctcgccgttggccttggccgcgtcgtagacgttgcagttgtagtactcgctgctccggtgatcgctccacgggctgaggcagagccagcagaactcgtgcaggcatggcggccggcacgtcatgtgcatgcacccccggttcttctcgatcggcagccggcacttggggcagtgcttcgtgttcgccagcacccagctcgccgtctcggacttcatggcgttcttctccgaccacgcgtacaccgtctcgcacgacaccggccggtgcgcctcctcgccgcaccggaagcagaacccgtgcccgtgcctgcactccacgtcgtcctgctttttcttgccggcggcggcggcgaagaacttcatgggcaaggggccccccggcccccggccacaattggatcttcgggccttcttccacgtccaaccggacaaaaacgtcccgtaccgggctctgtccgcgtcgccggccacctggtcaacaagctcacgcaccacggcggcggagcacgctgggtccgggcaccggaccaacaggcgccgcgtggacgtacccgcgccagcagccgacgcagtagaagtgggagcacccggccgatctcatctcgccggcggggtgctcgtcgaagcagatggcgcagacgagcgggtgggcgttgcgcgacacgggggcgccgccgagcgccacgccggtggcggcgccggctcggtcgccgtcgcagaacagcctgtcctggagctcgacgaggctccacttgtagtgccggaggaggacggcggcgaaccccggcgggatcgcgaagagctcgccgacgttggccgtgtccgcgtcctgccgcgcgcggacttgctcctcggacagattccggtacctcctgtcgatcttggtgaggttgacggcggcggccgccttctttttcttggcctcgtcgtcgtcgtcgtcatctacctcctcttcctccagatcccaactctcgccgtcgtcgtcgacgttgctgtccacctcgtcggtgtaatcgtcgccatcgtcggtatagtagctttcgtagctctgagcgtcgtcctcgccgtcgctcgccatgcctgcgctgcgtgctagcaatctaggtcgacaactgattctcagggtcaaggttgaatttttgtatgcacaattttccgtctattttttccgctaaaaaaattccatctatttccgaccccgagttgggatcagtctcgaactcagatcctgaacggattcgcttcttaacaacaattttaagttctcaataactttagtcaattcaaactgagtacggtttatttttcgttcaacctctctttgaccgatttcgtaaccaagattgatccctgcttcaaaacacaacacagtgctgtaaaaaaagaaacaaaagctacaaatgacttgacatgcatcacaaaaaaaaaaacaaaaaatcagacagcacagcatacaccattaacgtcagaatgtatgattggttggttaatggaagaaacgtccacaaactttattagtacattataaatacctatcacaaaatttattatagattgttattatctgtctcttctgctcccgtgctaagaacaggacaatgctgattgagctttactttactagacataccaagaatgccaatctctaccgtcggaaaacacgatttgtgttccgaacaaagccgcaccggcagacatcaccggcgccggcgccgccaccgccgccgcggcggccattgtgagaccccttgcactgtcccaagcaagcactccacatcatggctctgccattactccttcccttgctgcttgcaccgaagaggatccctgcgacgtgcatcccctgcatctccagcttcaccctgccatccttcttctccagggatgcctccatgaccccgatcatggggtcaccaatggcggcgtacccttgctcgggatccctcacctgaatcaggaccacagagaccatggaatccttcgtcgcctggtgcctccggtcgccgtcgtcgtcgccggcagccgtggacgaggcagagtcagccgtcgaggccatgcgaatctttaggccttgttggaccagtccttccatcttgtccatttccatgaagaggagagcctccaagaagtcgtcgccggagctgagcctcgccgagcggcggatgactttgccgggattcttccggccggcgatgtccttgatcggcatcatctttgacagtaacttgcacaggttctctgcgctcgtctctgtcatcttgtcaagaacctagagatcacaatgccacagattgtcgaacgaaaacaatgtgcagtgcaatggatgatagacttcattggcatccatggatcttgacagcgatcgaggtggctcacctccgacgcggtggcggcgttctcggcgacgacgggctgcgacacctgcagcgccagccgctcccagggcatgcccaccacccgtttgatctcgtgcaggtagccaccgccttccagcctcaccatttcccgcacgccgccgtggccaccgacggtgacgcgcttgttggccgccgtggcgccgatgccgctgcaggcgctgctcacccgatctctggtggccatggcgccgccattggcgctcctgccgtgctcggcgagcctactgccgagcctcctgatctcctcctccaggaactgcaccctccgccggtactgctccgcggatgctctagtggtcgccgccgtcgcgccatcgacgacgttggcgcgcgcaggcggcggccgcggcgcgcggcggtggaaggagaggcaggacgcgagggcggagcagccggtggtcgccacgggcggcgccggctgcttgttgtggccgccgggcatgccaatcttgccgatcgatcggtgtggcggcggtgcggtctccgacccgctcgctcgccggcgccgtgcaatttgacgcgtttgtttatcttgtataggcgccgcgccgcggctagctagtgaggttagttgcgatctatgcgtggggaggccggatcgatcatcggaggcgcgattttggagtttgaattcgaaccccaaactccaaaggtgtttgtcttggccaacttcatcttggagcagcaaatattgcgttgcgacgtgacgacgcggtgcattggatcgtgtgttgtacagccgcggtattcattgcatatcagttatcaccagtacaaatccattggatgtatccagtatccgtgcctgtaagggcctgtttagttaggctgtgtttagttcacaccaaaattaaaagtttagttaaaaataaaatgatgtgacggaaaagttggaattttgtggataggaaagttttgatgtgatggaaaagttaaaagtttaaagaaaaatttgcaactaaatacagccttggtgaaatgaaaatttttgggtgtcacatcggacgtttgaccggatgttggaaggggcttccattgtaggagtaattacttggggcttacgtgtatactaccgtgcagtaccgcactgctgctgatgccttgttgatacaactgtgggaacagtttcaaaagtacgaagagaacaaaaatctctaatattttgtatgtcgaagtttagaggttgcgatcttgtagattttcggtctcatcatttggtttttttccctaacaagtcaaaacggtttattagggaaaaaaataaatttataggtatatatatatatatatatatatatatatatatatatatatatatatatatatatatatatatatatatatatatatattgttggtgacttaaaagttaatgctaaaaaagaaattacgttgaaaaaaaatctcaaaatcaatgtcaaaattaagtttgaaaatttaaaatttagctttctatttggctgattaggccatccaataggagcctttcaataatcgttttagtctcatatgttgattttattattttagttcttattgttgtatgagtatttgctctctttgagataattttataataaatggttgtaccttctttgaagcaaaggtccgaacttttatttcattatcttatcttaggccctgtttagttcctaaaacaaaaattttcacgttgtcggcttgtcgcatcgaatgtttaaacacatgcattaaatattaaatgtatgaaaaaactaattacatagattgcgtgttaattgcgagacgaatcttttaagcttaattgtgccatgatttgacaatgtggtgttataataaatatttgctaatgacaaaataattaaacttaataaattcgtctcgcagtttcctagaggaatctgtaatttgttttattattagactacgtttaatactttaaatgtgtgtccgtatattcgatgtgacaactaaaccaaaaattttccacaacaaaaaaaaaggccttaaaataagacaaaaagtacaaatacatttactactagtagtacatagtacacacgatgataggagatgtgaccgtatgagtggggccgtgtttagttcccctccaccagcttcaaactttcaactttccatcacatcaaaaactttcctacgtatataaacttgcaacttttttttcaaacttctaattttcttcaaacttcactctttttccaccaactaaatacagcctgaggtgagcttcctaaaatagggaaaaaagaagataaaaagaaaaggtgtaggacacatgggctttagtgttgcaggactttggtccttgtgggccttgtaatgctgagctcaggctcatccgacacgtgtgcctcgcgggccttgcaatgctgagctctggcccatcacggcgaagacacatgcgccggggagcggcggtggaggggaggattgcccgccgcgccgcccgccgcggccgtcttcctcctccctccatctctccctcggaccctcccaatggcggctcctcggcgcggagtgcagcgagcaggcgcagcagcttttgtgtgtgggcgaccgccgtggggctgcacaaggccgtctcccgcatccctcgagggctccgacgccatcgatgatcgcccgcaccaccaaccccaactccggcgaccggccaccgggccaccaagtggtactgccatactctcctctcctctcccctcccgattgctggtcatcgatgatgagcaccaagctctccgcctttgtgtgtacctgtaccctcgatttttttttttgttggaaggactactctggaaatcccattgttgactgttgaggatactggctcttagcatatgcttctccaagaattgttcatgtttgatgcaaacatatcttgtgtttctgttcatgtaattactggtaacttgatgccttgctaaaaaaagagaactaattaacctgagatagttttaagtaaacgtatggatatgtttctgctcccaacatctatgtccttatagaagctttattgttttctggaacaacactgctttagaatcatttagatgccaatatgccataatcaacagagatgttttggttttgaccacctaattcgcatgaaagatgaaatatcttagggcggggaatctgggaacaatgatgcttttcagggataaatgttcaaatattgatgaaaggcttggttttccattccacgaggagttgttttcttgtgtcctactattggacacacgtgtcactacttcttgttatgttctgaagccttttcaacaatctgaattccttgaatttgagaataggaacatccaagacaagtgcctgacttcctatcttactttcaaacatgttggcttcgtactttggcagatctgctcttactccagaagcagcatgaatccatttttttcaaataaaaatgtatctgttcttccaatgcccatagcaattggtagcctagtaatggatgaacaccattccagatgaagggcttacaatgtccatgatactatttcattaacaatagttttgtagagcatgccgtctcgtttttatttatctcctgtaatttaacctataacttaattgccgtcatatataatatcatttgccatattattttacatgcatttggcatgaattcatccacgccatgtataatatgttccgttttgaacaatccccttcaccgtgtcatgctgtagtgtttatgtgcatttggtatgaattcttccacaccatgtattaacattcagttttgaacaatccccttcactgtgtcatactgtagagtttggcatagagcattagaggctcaatcatggtggaaatgcagcaggcgtggtgggggagcttggaagatgcaatgggggtatggtgggctagtggctggaacagaacggtacatacacatctcaacttcatcagcactttttgctaaataaaatatgtcgtgaggttatcagcttttcttaaacttgttttcccttgatccggggcctttttgcacggtaggaatagagccaggttctgctaactggcagtacctaatctaaatgcaaaggcaggcaaattctttgcgtattcccgggaaaagaacttgtattgccgcagcacagacaagaattaaagcaagaaatggtattcttctagctagaggccggaatacataaattcatcagggaaagaaacacgtacaagaattgctagcaatagtacattagcactcaagatactaattatcactagacataacagctaatttagagaagagagtataattaagagccaactaatttagtactaggaggtaattatgaacgagggctatgaggaagcaggaagctgaggtcctcgccttcgtcggcggtggttgcgacggtagcggtaggctctccttgtactatctcttggctaggggaataaggccccgactttggctctggctcccgctccggctccggctccggctccggcatctggagcttgtcggccaaggtcttggcgcccttgagcgagagaatgagccagacgaaggagaggaactcgccaccttctccgaggctcttggcatgtaggtatcccctacacatgctggcggagtagaagagcatgcccacccacacacggtacatcacttggcaccgtgttctgcggcccatcttatccatcaactcctctgcgagcctgcatgcgtcatggacgagagggtacttggggggagggggctcatccaccctgatttccctctcttgttctcttaccatttctatgtcgatcgcagcattgacctcagcattgacctcagcttttgccttgtcgatgatcttctttgccaggatgtctcgtccgagcttcttgaggctatgcggctgctgctgctgagactcaatatccttcaagatgagctcaacctcctccattgcctgcgtgaagaggtgctgcctgctgccggtcatgagcatgtcagggcggaggttgagaaggtgggccatgtagtccgatatcgcctccgtgcactcgagaaatttcctgtcaatctcgtcgatggtgtttccagccatcatgcggcgcatgcaaaggtcagtggcgatgtgccagaggatgacacccctatcaaaggacccacgcaggctgccctgtacctctaggccgcataccttgcgcaggttctcattgagcacccagttgcggcgccccggcgcgaagcttcggtagctggtgaagtcgagacccttggcattcgcctccactaggtcggagaagatcaacccggccagcatgtggtacaggttcttgcgttggcaaacgaagaatccctgtgtgtagccgacatgtgcggcacacttgagcaagaccccagcaggctgtgtcctttggagagctgaccggatgaggttattgtattgggggactgtctcgcatagcgctgcgacatccgccatggacatgagcttgaacagcagctgccggatgggctccgcaaggatgtccagcgcggcggtgaggcagaggagcacgtaggtgatcttcacgtcgatggtgttgtggtggcgcttgctgctggcggcgaagagcacgatggcggtgatgtgaaggaacggcgccaacagtatgtggtaggccaggtatgcaggggtcaacaccacgttggctctggtgtagatgagcgcaaacgctctgcgaagccaacgcttggagcccttctctgctctagggcttagggtccccagcaagtctccctccacctcctccttgctgtcatcttctcccatcaaggattggcattgacggcgacgacgttgttcctgcttgaggtcagagtcggcagctagcagcgacatgtcggagagtatcagtaggaccttgtctctatctgtcaagatgtgctgctgactcctcttgacaacgtcagtgcctacccctggaggaggggtctccttctcttttttcagctggcagcagcggtcgagtatgtctctcttgtccttttccagctcggtgaagcagtatctccacttgctgacctccttcctgccttgtaccatggacgacacagctgccagccggttgatgctggctcgtcggagagcccacggcttctcggtgaagctgaacaccccaatgacgaagagcaggacggctgacaccagcagcttcctgtcaccgccattggcgggccatgacttgtagaaggcgtatatggcgaccgtgacctgggacaccagagtcacagtgtgccgcctccacagctcgttgtcctcgatggtgtaggcagacatctcctgctgcccgccaaggtggatgaggaggaccggagcccataggacctccagggcgctgccattgacacaatgctgtttcgcggcggtggtcgtgttggcgtggcggttgaagagggtggcaagcgcgtagatggccagggcgtcgctgctgatgtaggccagccagatgaaggtcctgaaccagtgagggatggtgtacttgcgcatgggggcagccagcagaaggaaccactggatgcccaggctgcacagcaccaggatgcgcagctgccactcgtcccaccactgcacagcggctgacacattcgtcattctatcatgcatctaatatctgtttgttactattttttttgtttgtgcatcgtaggttcccgacaatggacggttagtttagcacacctatatatcagaatgacacttgttgaacacagtttttctgtagcccagctgaagacttgctttgctagtgaagctcactttaattattactgctacacatgtgcgtgtgggagagagctaaagtgagggataagcattacatgataaaagccgaaaaagagaatgaacatagagaaaaatataaatgtacattacaacttttatcgaaaataaaggaaaaatataagatgtacattacaactttagactttatttatttacagtcatgcgctgcccttcgcgcacagctttgtatgatctctgcaatattcctaaatcttcatatgttagctagtgtggagctattgatgatgtctaactctttgctttgtttacgaggtggtccttactatctttgcatttgcatatttgcgtgcatgttagcgaaataaaccatttgttcttcagccacccaaacatcatctgtcttatcaaaccttcaaaataagagggacttttgttcatcttgcaccgaaaccttttcccttgcttgttttcctcttccttcttgtcggtctgttttcctttttcttttctccttctttctcatttcctttttcttttcttgggccacacctcgttgaggataagattttcttgggaacagttctgttgagtgagagcagtgcaaacacaactttggttcatgttctgctagaaggctagtacagtgtaaacacaatcttggttcatgttcataattggagatattactgctgaaggaggtgcccgcaaggaattgcagtcctgcagataagagatgccatttgctagttgcctccttggtaaaagtcttcacttgagtttatttatttgctttcctcttttccttggctggatttcccacaagtctcgttttcttatcagcaaaaccttttgttgacaaaaggtggtgtgattgtttaagtggggtccgaatctttttcttcttaaataaaggagtggaaatggaatagtgaaaggaatagtgtctctgttaagctttccttcatttatgttcctttcttactcgatgctgttgcctaatatatattcccttatttttatattaaaatgtgcatccaggccacacggttcaaattcttttttttagaacttcaattctaaattggtagtattaattggtgtccactagtaattttaagacacacgcgctcagtgggtccatatatatgctccgggaattttaattagccgtgtgtgaagaacatgcatgtgcatatgatgtctgaatgttgttgtgaaccttgtgtaaggtgtgaggattagtcctcttgactttgtttgtttgggctgtgtacatttaagttggatgtagaggttaggtttttaatccattttctaaaaaaatgtgcatatgatgcatgcgntgtattttctgtaatatatttgtatattattgaatttggaaaaatgagatgacttgaacttcataacaatatatagatgagtgcgttgaaaatagacgcgcatgtaggtttcattagattctcacgtttgtaggcggatgaaaggtccactattcttctgttacttttgggtatgcggtggctaatcaccgagctactccctccgttctttttttactacttgccatataaaatactggcacagtgcatatatttaataattgaatttcctaatattatcttcgtaaaaattactgtattaaagatataactagataaacatatttttcattataactctgtcaatatcatttatcatattttaaatcttaatatgcatatattagtgggttaatgtatagaagtttgactacacattttctatttatgaaacgatgtagtgatgaatgcttttgtgataatgcaacgttcatgaaatatgtcagaaagaataaaatagcataagaaagtaaatagcaacaagactgaacgtgcatgagcatttgcctttttctttcagcatgtgaacttcaatttagtcaggattatcatggcaaaagaaatatcacttcaccctgccaagaaatagataaattatttgttcgccgcaaaattaatatgcgaaacagctaacggtcctagcgcataagttcggagcatatattcttcttctttccttatggcactcattagcaaggtagccaagaaagctctatataaaccatgtgcatcaccttacactgcctttaacctcctttctttccctaggacctacccctcccctaccctcttgagctttctcaaataaaaaaaaaggaacacctgaatttttttggtgattcaaagagaaaaagacaaagatttgatgggtaacatgcttttatcccctgttaatttcttgtgaccattatttttttctgccttggtttttggatttcatacagaaagtgtgttggtctgtgctaatcttttcctccctctgcgacagcatcttcgagctctaccatgatggcaaggcccggcgctgtgaagaatattgaaagctgggacgagtttacaaagcattttgtgaaatcagaggacaagctggtaaacatatatacatatataatccaatccaattcagatttacatgtgatgtgatcgatcgacgcattcatgcatgcatgaaattaatatattgaaatatgaatgatcaatcaggtggtgctggtattcatggcgccgtggtcggagccgtggaagctgatgaggccggcggtggagaagatggcgtcggggctgaagagcgaggaggccgaggtgtgcacgatcagcgtcgaccggttcaacacgctggggcggctgctgcgggtggaggcgctgccgacgttcgtgctggtgaagaggcaccgggcggtggctcgcgtcgtcggcgtcaaccgggacgatcttcacagcagcatcaacaagcacctcgcaccaccctcttcttctccacaacccattaatatttcttagtgctgttgatgattcttggttgattgcatgatataatcgagtaatgccatgcgtcttaattatgagttgtaattgtttatcacatactgtatttgagacatattcaaccttgtttcgagaaaaaaaaatggagatgaaaaaaaaatctattcatacttatagattttctttgaagaatttgtcttgatagggttgacacgcagttagcacgagagaacttccgtagcttgccttctgtacctgtatggctgtatcgatatgtatgcgtgtcttctacgcagctaagatatgaaatatatcatatgaggctgtggagaaattgactaatttatactcctacgagaaaaataattaatgctttcagaattccatttttcagtcttatgttaatgctatgcttgccaatttaagcactttgccatttttattcaagaaaaaatagtggatgctatgccatgtgtacccataaaaattaattaaaatgagaggaattaatgtaaaacaaaatattatatacacataggatagtatattcatctgattcctaatcctaattctcttcgattgattgcctccatctattcctaggagcctattatatggttctattctagggatctccaccactcagctccaaagagattgaaccatagatccgtggaatagaaaatttcagtataacactgttacattctagtgtttttaagtgagaaattaggaatttaggggggtcaccccccaacataatatagcttcgccaatggaggcaataaaaccatagatccatggaattagctagggaataggccaaggtaatacaagagaattagggcttgtttagttcccaagaagttttttccaaaaacaccacatcgaatctttgggcacatgcatggagcagtaaatattaattttttaaaaaactaattgcacagttagggaggggaatcgcgagacgaatcttttaagactaattagtccatgattagccataagtgctacagtaacccacatgtgctaatgac

SEQ ID NO: 56609 - DNA, 1194 bp, Oryza sativa
accagcctcacctcgcttcggtaatccctcgcctcactccatccatccccattccccaatctctccggctcctgcttgcagtagtccgctactcctacgaattcgccgccctcctctacttgttgatttggcctcttggtatggaattgagatcgcgaaatggtgcctccatccttgctggctgggcttgggtggtcgatttttttggggtgcttggtggttgatttggtggtaggatttcgtggtggggggcttaggtcattcacggtcaatttcgcatcggcgatgcgtttttcagtgatccagtagtttgtttcctctactggcgaatcgtgacaaatgtgtgacttgtttgggatatgctacggcaactcgaacctttagtcggtttgaacgctggtccgctaatccacttctcagtttcttttttctttttaatttttgggtctgtttttgtggatcagtttctactgattaggcagatctgaacttgctttgagaccaagctaaagtttttctctttggacggattggcgcagagaaattagttatcttgtttctttttctttgccaaatgttaattaaccgcagtgaaggattagcctagtaacagtatcccatgaatgattaagtgcatgacttaatgacaaaatattttggtgctgttattttgttcttgtaaagcatgatgtttagaatagccatccattcctgttctatatcctatgctgtcacgtagacatgatatgttctccttccctgctgaaaaataggcttgcaatcagttagtatttgcctgatgcttgtttgtttctttcagatggaggatggagtgtctacttatactgttgatgaggctcttatttccatggggtttgggaaatttcaagcatttgtgcttgcgtactccggaatggccaagatatctgaggcaatggaaatgatgcttttgtcatttgttggacagtcggttcaagctgaatgggagctttctgcgcaggcagaatctctcatcacaagtgttgtttttgtaggtatgcttgtaggagcatattcttggggcatagtctcagacaactatgggagaaggcaggtcctttactatttacattccactgtttgtcagatttatttgaaatcttcattacaaatctctctccctaacaatatacagctattcctattactgttaat

SEQ ID NO: 56610 - DNA, 901 bp, Oryza sativa
gattttaaatcactaaagataagctatcatactctgaaggataaatggtcgattagagaattaataagtcatgatgttaatgaggaagagcaacaaaatgccgaaaggcgtaataagcaagctttccccactaaagctctaaagaccaatgagaatatcactgatgagcccaatgagtcaagtgccaccatcgtgtccaagcttcgccataagtctaggcatgagcaagaggactgcgaaggctttagaaaatggcttccttagaagggtaatcttactcattacaatattattgcccatacttatgatacatttgtgtaacacctaatgtcatttaattcttgttgaatgacataggtgcattacacttattcaatatagaaaaataggaacaaagcccctttaatgggaatcaattttgattaggagacaactgatgatcttcccttagtctaggaagacctttgttgtttcatttcacatgttttttttatgtttatgaacttatttccatttatgactatggctacaatactgagtttgataataagggatatttattaaattcaataataaagttgtgagtcttgccttcgagcgagacaaattataatcgctccattatgatactatgctagatatttgcgatgttgtacgagacctcatcaaaattgtgacattattgcttagatcacattttgaatgagaagactatgtctcattacattagaaacacatttactaactctaaagtctctaaatatagcagaggaacattaaattataaagttccctttcaccaataaaaatctcccactaaagtactatctccttcgctaaataactattctaaaagcagtagaaaaatcaaagctaaattagaaaatcggcattatgttaa

SEQ ID NO: 56611 - DNA, 1144 bp, Oryza sativa
  unsure (1)..(1144): unsure at all n locations
taccttggtcatgtccaatatttgaccgttcatattatttgaaattattttatgatcagtattttcattgttattagctgataaaacatgaataataccttatgtgtgactaatttttttaaaaaaatattataaaatttttaaataagacggacggtcaaacgttggacacggatatccacgactgcacttattttaggagaggtccggtctcaataactaactatggtatgtactcaaatactcgatgggtgacaattcaatcatcccgcctcctgctcacctcctgggtagtccagccatctgtcaattctgctacaggcagcagtgccgctctgggccagtttcttgtagcgaaagccgggacccgatccggttgagggcactcttgtttgcttgctccctgctccggcctcggtgccaccaaaactgttgttccccgtctctgcaaggagactgcgcaactggtcgtcaaggacacgacggctgaagtactgatcctgatcgagtaggagctgcaagctgggtatcctctacatatcccgccctcgaatactcgatgggtgacaattcaatcgtcccgcctccggctcccctcccgggtagtccagccatctggcaattctgctatagggagcagcgctgctctgggccagtttcttgtagggaaagccgggacccgatccggttgagggcactcttgtttgcttgctccttactccggcctcagtgccaccaaaaccgttgttccctgtctctacaaggagactgcgcaactggtcgtcgaggacacgacagctgaagtactgatcctgatcgagtaggagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56612 - DNA, 1668 bp, Oryza sativa
acaagtccacaaaaaaataatgatcgttccattcagatatgattattcccgttatgactatatttacccccattaatgatcgttctgaatctcttgagaaatttaagatatttaggactaaacaagaagatcaacataatgccaaaattaaagttgtgagatcagatcgtggtggtgaatactatgggaaacatgctccatttggtcaaatcttggtccgtttgccttatatctctagcaacatggaatagttgcccaatatttatgcccgaagaacctcagcagaatggagtagcaggatgacacaaccgcacactcatggatatggtgcgcagtatgctaaatcattctactccgtcaagtaaattgtggattgaaggcttaaagacaactacccacattataaatagaattccaagtaagtcagtacctaagatctcttatgaattatggattggaaggaaaccgacattaaattatttacgcgtgtgggattgtcgtgcaaaagtcagaatatttaatccacaactaaagaaattagacccataagactatgagccatcatttcatcggatatccagaaatatctaagggataccaattttattgtctagaccatatcgctaagtttgtggagactagacacgttgtcttcttagaaaataatgaagtggagagctcacaacataaggagattaatcttgaggaaattaaaactaatgttccaattatgaaaatccaagagaataatattccatttatcaaacttgtgccatagaatgtagtgcgccaacaacgagtaattctggaccctctggccctacaactgatgttgaagaaagtgttgatgaaaataatgatgaaagtaatgagcatcaatagaattatgcgacatagaatgaagaagaaatatccaaaagaagatgctcaacgacatgtgaacaacgatgaaaatcagcaattaagaagatcacaacaggtaaggaaatttgccattcccgattatcatgaagtttatatgagtgaagatatagggaaggtagatggccctacctcatttaaagaagccataagcagtaaaaactcatccaagtggtttgaagaaatggaagatgaattaaagtgtgggatcagtagaagttcctaaggaggcaaaacaataggctgcaaatgggcctacaaaactaagctggactctaaagggaacatcgaacgattcaaagcaaggcttgttgataaatgtttttttttgcgtagataaggaattgattataatgatacattttctcctgtctctaagaaagactcatttagatatattttctcctatatctaagaaagactcatttataattgtcagggctttagtagctcaccataacttagaacttcatcagatggatgcatagactgcatttctaaatggtgatttaaatgagaatgtctacatggcaaaaccagaaggttttgttgtggaaggaaagaccatttagcatgcaaattaaataaatccatttatggacttaaggaggcatccagacaatggtaccttaaattcgatgaagtaattaaaaatttttggattaaaggaaaatgtgatggacaactacatttatatgaagaataaaagtggaaaattcatcatactagtactctatgttgatgaca

SEQ ID NO: 56613 - DNA, 1694 bp, Oryza sativa
aatttcatcccaaaattaagagtggtcgacagtatagccaaaccactggcaattacttcagaagcaaaataaactacagcttactagaccgaggttgcatcatttttccccaataagcatcaatgatcttctgtgataaaaatagaaaaacaaaagagcaattgtagcgataaaggctatgtttcctcatgatgatggtaactcatgctcacggcaccagaacatgaagttaacgactcaacagtgattacagagaagtctgtcatcaggtgatggcaatgaaactaaaatcgattgtttctgtttagggtgtgtttaatcagttcacgccaaaattgtaagtttgattgaaattggagcgatgtgatagaaaagttagaagtttgtgtgtaggaaagttttgatttgatggaaaagttggaagtttgaagaaaaagttgggaactaaaccaggccttaattctttgctgaagttcagctttagtttagggtcatgcatggcactaaacattagtcatcatcaaatatattcccatcgcagcgactttatatttaaattttgtcctaaaatattagggttaatttgatctatgccactgcaaatttgtctattaagaaaaatgccattacaattcgtctattcgtaaccgtgccactagaattttacaaaattagaaccgtgccactgccgtcacgttttccatccatcccctgccttttccgtcttcttccttctttctcccatttcttcccggttctttctcctatttcttctcggagtcatgccggcgagctcggaggagagggagcttgccagcgacccaaccatggcaggcggcagcggctccttctttctcccatttcttcccggagccaagtgggcgagatctcgtgcgggagcagcggcggcgatgccaacggcggtcgtccatccatccatggccgcagcgagcttcgacggtgtcggcggtggagccaacgtcgatggaaacaacggtagatctggcgctgcatggcgcgagcagacccaacagaggcgatgaagactcgaagacggcggcgaggtgctccagctacttgcggagctcatggcgggcgacgaggaggcggttggagtctcggagaggtccaaggatgagtagtgcggggagagcactgccgcgagggagagcggccggcatgaggtgctcaccgacccggaggccagagcgggagccgaggttgagcagcaacgcggaagaagagagtcaccgtcgtcgatcacgctcgacacccagcctaggcctcagctggttccgcccgagtcccgatgccaccattgtccgacgccgccaccgccggattcgccgaccacgccaaccgcactcgaggttgggttcgttcaccttgccggcgagctccctctccggcttgactccgggaagaagatgggagaaggaaggaagaagacggaaaaggaagagaatggatggaaaatgtgacgtcaatggcacggttttagttttacaaaatttcagtggcacggttaagaatagatgaattgcaatgtcatttttctgaatagctaaatttgcagtggcatggatcaaattaacccaaaatataattgcctatagaataccaagggatgtttatagtcattaaatattcaaagataccacttatctgacaactctcatccacctcccaccacc

SEQ ID NO: 56614 - DNA, 4759 bp, Oryza sativa
agctaaaataaacttgaaaatggattaatatgaattttttaaaaaactttcctatagaattattttttgcaaaatacgtaccgtatagtagtttgggaaacgtgtgcgtggaaaatgagagaggtgagttagtttttgatagctatattttggggtggagtagtagataaagaggttttgatttttttttcggtgactgccattttcggtctggagttagcctgggccgagttcgctgtgacaaaagtggactccaatccccaatgttgcatgaatgtgcatagaaagcaagcacgcgctcgagacgtactactggactatgatgcactggatcgaggacaagcatcgccaatgccggccagtgactcctctgtcatggactattgtagatggaagtatggaaccataatatataatcttagctagagcgatgatgctttagacacccgattggacttactagataatttggaaatgcaaatgaatgactatacccgaagaccaaggggaagtgaagtcattgcaattgtgggaaatcatcattcctctactggtgaaatggtcatcatggacatatttacaaaggttctccccaaaacattcgctaccacaatgcacaagcacaactgccccgcaatactcattatcactaaacacggtttttccgcaaggtcgcacaaaatggttgggaggaatccgtgtatttttcttttgttggcactttcttagctgaatgttaaacaacatcttaatacaaagacgtgcaaatcttttatgtacttcctaaaaagaatttcactacgaaaatgcgtgaacggattgttccagctgcatcccagatttggtgacagaacttctgtcgatgtatattgtaacttctcctaatcttaataaaatttggttggcattatttttgaccgacccagaaaaaaaatacttgtgaacttagtggtttctgtagcaatttgacaaaagaaaagcattatctcaatatcaaacactgaacattaataatatatttaattttgagattaccacacatcacacaagtcaagtacaacatattgcaaagctcacatgaccaaacaagtacacagtagaagatttagatttcaacaaatgaagccatcatttacttatccaagtatataattgacgacagattcttgttcgatgcatgatcggtcacaccaccatcttttatgcagccggtcctgaagcagaagggtccacatcattgtctctatgaaatttcatcacagcgcccaagattgggctcagcacagttctctttctcttcttcttctccttctgctgaatctgcaaaggtttacaaccagatatattctgatatacgccaaggaaccaggaatttagtacacataattttcataaaagccatccaaaccttgtttatcgcagctttcttctggctgttaaacatgtccttgttttgttctttgtactgcttcagctcttggctgtccatagcttccatcctgtccaactgaatcaagaacaattgattatatgatacaagtctacaaatgataagagtctagctagttaattgcatgctcatctgccagaaatttacagccactgtgtacagcctctagaaaaatgctaaatctattcctgcaaaagctaaaataaagcataaatataattattattaaaattgaagacaatatatatcacccattactatgattttatttacccaagagttaaattcatctgcttgtcttcttatgtcctgtgcatccttagcagcaatctctttgttttctgcctgtggcattgccttcttgccattgtctccttgggccattgaaatactggatgactgaattttagtactcagtactctgaagtgagacaacttgtagtttggcaaagaactcaaagggttatcaagcatatatataggcaagcttcaccactagatagtcacacgcaattttcaaataggtgtcaaataaacaagtcatggaacttgcttgacctttggcttgttgtaacgtgtgaatggttgccaccaagctgtttgcaaatgtaggcagaattacatgaggcgattcacaagtctctcctaatcaagaatcaaaagctaaaaacggttggtttataaaggcataatttatggaggttcacatctatcctttatatagaagtcttctagtagcagccttccaatgcagataaccttttgctgaatactataagaagaaacagtagttgattctttttctgccacattgcagtttctcttactggcagttacaatttattttcctcctattatatgcccatatttcctgctaaaacggctgacctgccttggaaatgctctggcatttcagttctttaccctgaaatgagcgttactgtttgtctccattttattgaggggaaaaactccaataattcaattttacaggtcttacattaaactgccatattattgaaaattgtacttttgataattgatttctttcaacaaagttattttccatgctgcatatataagtaatgttatataacaatgaaaccatctgtactacatgcatagaagactaggacgtgatcacaacatacacaagttgtagtttttcaaatatatgcatgctttataaatgtggaaggagacgcggcgaagaggaattcttcttgggattctgcttgggtagaagggcgtaggccaaaggacctcatgctgttggtctatgcaatatcaaaaaagaaagagaagtccttgcatcaggaaaaggaaaacgatgcttggattgatgacttagaccttgaagccaacccaccaattttagtggaacttattgttcagctagtcgccttatggaccgttgtgcgaaacatccatataaacgaggaggagcctgatcaaattgtttagaaattcacttccatatacttagcattgttggcttaccaggcatagtaccttggggtgccaaaaacggtcttcaattcgctcatctggagagtttgggcgccagagaaatgcaaatttcacgcatggctagtcatctaatatagggtctagacctctgaccgactggcaactagaggatggcaaaataatgggatatgccccctctgccgtagagaaggcaaaacggttctacatttcgttgtcagctacagatacatgaaaagaatttggagcctggtagatgcctgggtggcttaccaacagctagaccctaaacaatgggagacgacctagaccgtaaaagattggtgggaggctctagcaaatacgacaggagttcccaaaaaggggttgcacaccctcatcctcgtcatcctctgggagatctgaaggagaggaaccaacaaatcttctagcaaaacgaggccatgtcgtcattccttttcaccaaaaatcaaggatgagacacaagcttgggcgatggcaggagcaaagcgctcacatgactttttgccccactctgtatattgtatagagctttttccctttttcttacttcttggggttcttagggttgtatttttgtgccgctatatttaatgacaaggcacaatcatgtgctgtgagctgttttctttcaaacaaaaaatgtggaaggagggagcgtgagccttttttttttaatatgtccaaaaccttgctatccatatacaggaaatgaggagtatcagggtatcacctggatattctccacaagtagcacagcacacggacgcagccaaatggttctgtttccaagccccgacacccacccctgccaacggagaatgcgttccccgccgtcgacgctatcttccaccgatccaccgaccaacctctcctccccaacacttgaatccttctaggccaacccctccccacccgacgtgaccgcccctgagcgtgagcctttagtgcatcttagggctcaaggtaaggctatagaaggaagtgcaggccacgcaaattcgcagatcaggtttcaaccgggtgcaacttcaaattggtgctgctctcctccaccggcaataatggccccttcaatcctccaccagccaatgtcttttcaaactcaagtgcggtgaagactttcaaaccaaccgatggtacaggtgcaggaggcaaattgctagtccataaaagattgcttccagccgtaagcccgtaagtgatcttcctcttcccttgagcgccctagagtctctgcatctagtagagtactcacaagtggtgttacttccctctgagagatcaagtgaaacaactccttctggttcccaatggagacaagctgaaggcagcccatcccgatctcttcgccagttcttccgaatctcggggtcgagattccgtttaagggggtaggtttgtcacgtcccaaaacgaccctaaaatatatcctttaaattatgcctagaataattaaaatccgtgtgaaagcctccaaaaattaaaatgtgcaaagtaaaagtcaaataaggcttagaggatttttgtatatttcctaaaagcctaaaatgtgtaaataaattttagtggaattttcagagcacaaataataattattaagaaataaaccaagttaaaaaggttttataaaaagaaaaaaacctaaaaagtccccttccctctaatgggccggctcggcccatctccctccccctctcccttctctccccgcaccccactcggcctctccccgcgcgcgcgccgctgacgggcgggcccgtccgccaccctcgctgacgggtggggcccacctgtcat

SEQ ID NO: 56615 - DNA, 1814 bp, Oryza sativa
  unsure (1)..(1814): unsure at all n locations
gtttccttcctctcccggccgccctctcccccatccaacactatttaaaccctccntgcgcctccctcgcccttttccgccccttgccgcaccgtctcctcgccggaatcgagctcgcgccgtcgccctctctctcctccgtcgccgacgacctccggccggccttctccgctcgccgggactgtctcccgccctagcgtcacctcctccggcttcgccgcaccgccgtcgaccccgtccaccccctcgccgagctcgccgaccgccggaacgccgtcgaccccgtcgacctgagccgcgccgccgccttcctccgctccggccgccttcttcgtcgtcgctgttgacctagggtgagccgtggaccgccacctcttttcccccttcccttcccctctctcggccaccgctccgccgtgccgatggccgccgccggcgaccataggggcgcgggtgccgcctcccgccggctgcgccgtcgtggccgcctttgggcgcgccgagtggccgccgcgtggggcccggccgtcagccgcccgcgccctcgggtgtggctgacgcgtggggcccacggcgccggccggtgcaagcccgggtgcgcccggtccaccgtggaccatgaggctgccgcgtgggccccactcccgtggacccggtccggcgccccctcccctcggctgacgcaataaacacttttttttaaattaaaatttaaatgaagaaatgtcacgcccagaaattcccgaatagaatttcaagcagaatgtgcattaaaatccccgtccaggaccagccggggtacacaaacgacaatgttgacattcagatccacgtcttacaaacatcataaaagtcttacataaatgcagcggaaaaacgaaagacaacaggtgctaagccttgactagaactgcagtgggaacaccactccacaggcatcctcgacggcacggacgaagcctactcctcagagacacctccatctgacacatactcgaactctggggttgggaaaaatagagcaagactgagtactacctactgtactcagcaagtcataccggaataggggtgtgatgcagggaatcatcaaagaagagctgaagtggttcatttgcataaacagaagttgaaagatttaaacagttgtaataattaaacaatatcaactatccactgtccaacgctaacccacgttgcgacaggcccaaccatccacctaaactatccaaattcaaaagattacactagggtgagcctaatcacggtgaatctggttgaccgcccataaccgcgggcacggctattcgaatagtttttactctgatcagaggtgtacaactgtacccacaagacacagcccctcgacacgtttccgtgcgccgacatgccaccacgacacaccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgacctgctaaaccatgcacccacagcccaccatgtggtttattttaattaaccaacaccaaagcggtgtcactaatccaacaaagccattagaaccaatgggctgcaggaa

SEQ ID NO: 56616 - DNA, 12587 bp, Oryza sativa
ctcaccgataacggtcgacgacggtgggcgacggaggacgatggtgacggcgggacgagctccggaacctccagcgcacgacggggatggggctccggcggcgaatctctatggaggaggggtggacgaggtggacctcggccgcgcgaacccaacggcggtgacggcgcggtgcggcggcgggtgtagcggcggctagaggcgaccggagtagcggaaacggcggcggcggatgggcgcacggcgcgggagcgatggggagctcgggagagggaggcgaaatgggaaaaaagcgagagggagcgacgggggagcttaaatagggagagagagggccggacgtggccgggagaggcgggaatcgccggccgacgtgggggagtgggggaggcgagagaggcgggattcgaaaatcgaatcccggccatctcgggcgcgggcgcgagcgggagagagaggggagtgggcgcggggaacgcggcgcacgcgcgggcgtggtcgacgtggcccggaggaggcggaggcgtggacgcggcggcggtttcgggcgcggcggttgctggcgcggcgtcggccggaggtgggggaaggacccgacaggtgggccccacctgtcggcgaccccgggagaggagggcggcgggcggcctggctgggcctcggcctgcagccggcccagcagggagggggggaaaggaagggaaaaaatgggctgacggcccatttgaaaaaaaagaggaaaaagagaggaaaaagaaaaagaaaaaggaaaaaggattttccttggaattaaaatattgcttgctcaattttaattggttaaaattatttctagagctctgaaaattccactaaaaatcctgttaatgaatttcgacatgtagaactcaagaaaaattccacatgcccaatccgattattatttgcattactttcttagggttttctcttgatttgcacctgcattttcttggggttgtttacaaattaaatttggcttgggaggagaacttcggggtgtgacaaacctaccccccttaaacggaatctcggccccgagattcggaggagctggtgaagaggtgcggatgggcggctttcaactcatcttccctttcccaggttgcttcctcttctgaatgatgactccactgaactcggcaaaacctggtgatcttgtttctggttcttctttcgctggtatcaagtatacgaaccggcttctccacgtatgttaggtcctcctggatatcaatgtgttccgaatcagcctgttcttcaggtacccttatgcacttctttaattgggacacgtggaacacgtcatggatgccgatcatattggatggaagttctagctgataagcaacttccccccttcgttccaggattttgtatggccccacgaagcgtggtgccaacttgcctttcgtctgaaagcggtgtactccccggagcggagtgacacgaagatacacgtaatcccctgcctcaaaagtgagctcccttcgacggttatccgcgtagctcttctgtcgagactgggcaatcctcaacctttccctgatgattctgactttctcttccgcttccgctaatacctctgtcccgaacaattgacgctcgcctgtctgatcccagaagagaggtgtgcggcacttccggccgtataaagcttcaaacggtgccatctgtagactggcctggtagctgttgttgtacgagaattccgcatatggtaagcttttgtcccaagctccaccaaaatcaagagcgcaagctctcaacatatcttccaagatttgattgactcgctcggtctgaccatcagtttgcgggtgataggccgtgctgaaatttaaacgggtccccaattcttcctgcagcttctgccagaattttgaggtgaactgactcccttggtcagatacaatctttttgggtactccatgtaggcacatgattctcgaaaggtaaagctccgccaaccttttgcccgtatatgtggtatgtactggtatgaagtgagaaaccttagtgagtcgatccacgactacctagattgaatcgtgacccgatgatgtccggggcagtcctgttataaagtccattccaatctcttcccatttccattccgggatttgaagaggttggagtaaacctgctggtctttggtgctctgccttcactcgctggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcaactctgctatttcagaatcgtttacttgagctgctctgacttgatccacgagcgtaggccgtgcctccagagcggccacaaacccgtgttcaacaattcccacgttgagatgctcaaactcctgccgcaattcctcacacatgccctcgatgcacagggcagtgcagtaacttttccggcttaaagcgtctgccaccacattggctttacccgggtggtagtgaatacccatgtcatagtctttgattagttccaaccatcttcattgtcggaggtttaggtccggttgggtgaagatgtatttcagactcttatggtccgtatatacttcgcagcggttgccaatcagatagtgcctccagatcttcaaagcatgaaccactgctgccaattccaggtcatgagttggataattcccttcgtgtggacgtaactgtcgcgaggcatacgcaaccactctgccctcttgcattaggacacatccaagtccgtgacgggatgcatcgcaatagacttggaagtctttcatctggtcaggcagaatcaaaactggtgcggatactaatttctttttgagctcctcaaaactcttatcgcactcagctgtccatttgaacttctcatctttcttaagtaactgagtcatgggtcgagcgattctggagaagttttcgatgaattggtggtaataacctgcaagtccaagaaaacttcgaatctgcgacacggtcttcggcggggtctatttggtaaccgactccacgttcgatggatcaactgccacaccctgagctgtaatgacatggcccagaaatttgacttccgtcgaccagaagtcacacttgctgaacttggcgtatagctggtgctccttcaacttctcgagtactagacggagatgttgttcatgttcttcttcggactttgaatagataagaatgtcatcgatgaacaccacaacaaacttgtccaaaaattccatgaacactttgttcatcagattcatgaagaatgcgggtgcgttggtaagtccgaacgacataaccgtgcactcatatagcccgtaccgagtggtgaaggccgtcttcggaatatcctcttcccgaattctcaactggtggtagcctgatcgcaggtctatcttagaaaacactttagctcctttcagttgatcaaacaaatcatcgattcgcggcaaaggatatttgttcttgattgtgacctcgttgagtgcgcgataatcaacgcacatcctcttcgtcttatcctttttctccacaaaaatgaccggagcaccccaaggtgaagtacttggtcgaatgtaccctttctgtagctgctcatcaacctgcttcttgacctcggctaattcgttggccgccattctgtacggtctcttgtaaattggagcggttcccggtgccaagtcaatccggaattcaatctctctcttgggtggcatggtagtgaggtcttcggggaacacttccggatactcgcagactatgggtatatcttcccatttcctcaagttcttctccacggtgtccactgggatttccgtctcaatctgattcaaaaagacccctcgctttgatgagtctagtgatttgtacaccacggtttctcccttctcgttggtcaaggtgactgtgcgattcgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtggagctattccttggggtatgaacccgcattggtgtgctaagttcctctcttattaacccatgcatcccaacaaatttctttgaaatgaaagaatgcgttgcaccagaatcaaaaagtactgttgcagggattgagttaacagggaacgtacccagtacgacctctggtgctgcttgtgcctcctccgcagatgcgtggttgacacgagcccggataaaccttggcccggcacgcctaggcttcgagcatttgtcagcgaagtggccaagctcgccacagttgaagcaggaccctggttttgctccagtctccttcttggcttgcgcgggcgggcctgactgtgccggtgccattggtgggcgtggagctgcaccgcggttggactgacctctatggtgggtctgactgccaccggcgccatggggaaagttgctagggttgaacgggcggtactggcggacgatcatggtggtaggtccaccctgttgcccgggagcgaagcgcggcctttggtgacttccctgaggtgccctgaactgtgcggccttcctcttcctgtccatcttgttgcgttgatcctcctgacggattgccttgtcaaccagcctctcgaaatcggcgtaatctccagatatcaactggttggttagctcgtcatccagacctgccatgaacttttcctgcttctcggcgtcggtacggacatcctctggtgcatatcgcgcgaggcgattgaactcatggaggtactccatcacagtcctgttgccctgatggagtgcccgaaattccctcttcttttgtgccacgaccccatctggcacctgtgccttcctgaaactacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatagggttggtggtgctggagaaggtgggtggcctgacacgtagaaactctggcaacttggactgagggggagggggaccaaactgctggtgctgctgttcggcgtgctgcagcatcctctggtgcatctgctggtgctgctgctgcatctgctgcatcatggctgccatcatctgtgtctgatgtgccatcacttgggctagcgtcggattctcgggaagtggtggcggaccattgccggagttgctgttgggatgcacaccctcagtgcgctcttcgccgttgctgccctcgcctgttgcgcggctaccattcctggtgtagaccatctggagggaaaagcagacgggggaaaagaagaaaaacagatgctcaggaactaagctttattacataggaatttaaactgcaattgttctgatctgaattaaaacacttaaagagcaagcaaaaatccttattaagacagccatatcataggcacatgatatcgaccgtcgactaaccccaaacaagcaacctaaacacacaaactaacaagcagaagctagacagtctgtaaactaatggaaaacgagcctaatgctcggaacggctcctgcggtcggtggagtcgaaggcgtcctcctgctcgtcaccaggtccctctgagcgacttccggaccctggcagataagtctcgccgctgcccgactctgagccactggagctgctgctgctgagatcgtggctgccactgggagtagcagacaaccaacctccgttgcctctggctgggcccctggcggctgatgctggagcgaaggagagagcggacgcgggagctggagctggagctgcaggaactgcgggcggaactggaggtgctgcgggagctgctgatggaggtgggttcctgggcgcaagctggatgcgcacgggtgcagtcatcgtcttgcggggcgtggtgcggatccggactcctcctggcgcgggaagaccctttaactgagcgttctccctcttcaggcgcgctatctcgtccttcagagcgacgatcctcatgagcttcccatcattcaaggccttggtcgccttgtccaggtccgagtgcatcctatccaatcccctcatcacagcacacatgtgaccaaaggtggtgtcgttctcgccggctgtcggacggaaagtactgacatcatcactgctggctcgccgagggtgaaaccggtacaccgtgtcgtggaatatgtagttgtggcgctcccgtagtctagccatcatcaggtatgctgcctcctgacaggcgtgatctgctgggcctccagatgcctccaccaccatgttagctaggcaggtacccacgtagccgtggacctccaggcgaacacggtgaggaagctcctcgacacgtttccgtgcgccgacatgccaccacgacacaccggaaagaggccgtgacaggacccttcgcataaccccctctagccaagcacaccacacctcaggtttcacccccgtccccagcgggcaacgggcagtcccctctcgtgcctaggtgaatccgaaagcgacagaggccgtcgctgggcccgccccgctccatcacgcccacccttgcctggatgcgtcgactagaggaaagctacactacaagcctagccgttgcccacgctggcttgtgataagtacgataagttcttccagggcatcccgcgaactggtccttaactgccataggtgcgacctgctaaaccatgcacccacagcccaccatgtggtttattttaattaaccaacaccaaagcggtgtcactaatccaacaaagccattagaaccaacagtctaaacattaatgtgattttccccattgtgaactagttgaactaagcatggctaagcaattcctagtccaaagtctattcatgttataacccaagctaacaaaggagcatggtatcaaaatagcatggctgtaacaataggtaaacatcccatagtaacattataaaacaatgcaatatttgaaagaaaacaatagagcatttgcaatataggatcaacatgttcaagtgacaagcatgacttgccttgctctgctgctggagaaacctcagcgactatttcgaagtacaccggagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactatacaagaaaaaccttaaatcatttattgcacaatatattccagggctgacgtcatcaaggcggggcgcggcgccgacatgcgggccccaccggtcagcggctcgggagagggaggaaggtgcgccggcaagcgggccccaccggtcagcggctcggggagggcggtccacggcggatcgggtccacggaccggggaggagcggcgcgccacgcggcggccgaaccgatggccctccccgagacgtggccgggagaggcgggcaacgccggccgacgtgggggagtgggggaggcgagagaggcgggattcgaaaatcgaatcccggccatctcgggcgcgggcgcgagctggagagagaggggagtgggcgcggggaacgcggcgcacgcgcgggcgtggtcgacgtggcccggaggaggcggaggcgtggacgcggcggcggtttcgggcgcgtcggttgctggcgcagcgtcggccggaggtgggggaaggacccgacaggtgggccccacctgtcggcgaccccgggagaggagggcggcgggcggcctggctgggcttcggcctgcagccggcccagcagggagggggggaaaggaagggaaaaaatgggccgacggcccatttgaaaaaaaagaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgcccaatccgattattatttgcattactttcttagggttttctcttgatttgcacctgcattttcttggggttgtttacaaattaaatttggcttgggaggagaacttcggggtgtgacaagaaattcgcaaatattcacttaaaagagcatataaacttcaaatggccataacttggccatttgaactcggaattggaccattcaagtctctaatttttccttaagaagtcaagaacctatttttgtgctttgttcctgcttgttatatggagtttattagagtaaaagcttttttccttttcattggtcgtgtagacgctgcagcttcggaagatccgctctacgtggaggttgaagctgacgtttgggaaagcgagcaaggcaagtcatatcatccttgaacatattgagtcccagtttataaaattattttgatttaaattattgcattatcgctttatttaaattcctgcgttatcactgttttatttagccatgcctatttacctttgttatgaccttattattattgctattgttattattaccttgttcaccctaggaaaataaaaccccaactagtgggtactctatttatggttccactagtatgaacttaggtagatgcttcgctggttaattaggcaacattaggtggttttacaactctagactttgggaatattcatatcacctggacactatggaatggttggattattgtggaatcggattcacacctccccctctattcaaaatcctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacgaagtcggggttgatggacatctctagggcaaatgaaggctacatgagctgcggcccggtagtcgagatgtcatggcacagggctggtgtcctgctgctaggggctcagacctgcctacctgtcccggaggttccggccgtaggtggggttgggtcggtattcttgtctatggctaggatgggttggaaactatgtcacgtcttccgtccgtataccgtggtgatatgtggcacgtggttacacgtgacgaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtccaaatcatcgtaggccttgggttaaggcaggttcgtgtgggttcacggccttgattaataatattgtatagctctaggatcgtatttacaaaatagctttgagcaactaagtgtcttttggtgctgtttactgcaaaccctaaccccttacattataactcccttgtactcccttgcatttattctgcactggtgggtgtgtcttgttgagtacgttggttgtactcaatcttgctcaatttttcccaaacccagaagaggagatcctggatgatgaaggctttggtgtctagctcgtgcctgccgtcaagcgcctgtgacacgtggcgccgacacggtgccaacgcgacagagccactggcggtcacggtgggcaccacgcggacaacccagatcggccgagcggcgcggccacgtgggtgggcacaggacagccagccggcagggagtggcagcgatgcctggggccaagaggccaccaacggcgagtggcgacggcgggaaaagcggcggagggtagtgggaaaggagagggggagctcaccgagcagcaccgacgagtggcaactgccggaagggcttgttggcggaacccggagagagctcggtggcagcgctcgtctggacggaggcggaacggtgctccgacagcggtccacgggagggaggcggtggacggagacggcaatgtcctacggaaagagcggacggggtgaggagagcgcgaggggacagggaacggcgaggaattgaggccggtgatggagggtgagaagggagtgctcatcggtgcacgggaaaacggggttcgggtggcgatttgcagaggagaagtggtggccgtgcttgccttcgagacagtgaagccggtggaggttgtcgtgtggcgcgccgacggctaggacggcggcgaggtgcggctggaggtggtacaggcagcggtggctcggccttggaggtgggaatggtgctgcagggtggaagggaaggacggagtaggggccggggtgcggcgtggagcgacagagccgatggtagcagcggcgcagcgcgggtgtagctagagcagtggtggcgggcggctggagggcggcgatggcgggagcggcgacagtggctggtggaagagagccgacgagtagcggagctcgggctcgcggcgtggggcggctagagagcgtgacagctggtggaaaatgggggaaacggaagagggtcgcatggggagggtttttgtgggcgcgagaaggcggaaccgcgatcgggagtagcggagttgtcggccggagtagggtggggacgtggaggtattgatagctagtttttgcgaggaggattgggggagaagtgcgggaacgtggggcgacgcggtctcacgggcgagagcgaacgcgtggggctgaggaggtgggcggggtggcgcggaatcggcgacgacgtgggcagctcgggtggccatggcggtggttggaggcgggctagaggttggggatgacctcgacaggtaggccccacctgtcggcggctcgggagagaggaggccggattagggagacgaaatagactttgtgtgggagaaggaaaatgggccaacagcccaagagaggagtggggaggccggattgagagtaggagggggcgcgcgggccgcgagagggtagaaagcttatgccggaaacggcccaaggacaaggaaggaaatttaattggtttcctttttattttaattgattaaatgaactttgtgcttgtaaaattattccttgagctttgaaaattcgtgggaaatttcagagagttcattagggcacaatggatattacaaaataccctcggccatgatttttaagggaaaattttaactctcccattatttcacttgattaaattgctttaaattttaatataatttctagaaatgatatattaattaatttttaatcgcgaacgaaaatcggggcgttacagcagccaaggctggactgcccttctggtagatcttaccacctcaaggctttggatgcccggcaggatgcacatcatgtgcattaccggttctgggcgcggctttgcatcgagggcatcccaatgcatgcgcgcactgaggtcacgacagtcaagttgatcgggcccagatgtgccatctacttcattgaagagtactcgcgccgccacaactacaaccgcaccttcgacctctggatttggacaaacgaccccgacgccatcccaaaaatggcttggctggggttggtaaatccggacgatgagccggtccccattgatacccctgtgcctgacattgaccccatgcacaacccccatctttcggggcccaaagatgggtggtcatccccggtcattatccacttggataccatagaagatcatcaacctcggccaatgttgtataagcagtatgagtggtcctatggggcctatgatgatgtttctcattcccgctcgcgccctctgcctattccatgcaggcaggagaccagtgcggtgcagggactagatgaggacccagatggcaacggcggtcgcccacacccgcgttaccggagccgctctaggtccctctagggccgtatcacggggagatcccgcagcagcgagcgcaggggtgacgggcaagtctactacaacgaagacacgtgggggcgctagcgcaacagagatgcctacaccaccagaagccgcaaccatcgttctagggacagtgcgaaggtcacggctccaatttcactatacccctcttgtcggttacgaaagaaacctcaacttgctg

SEQ ID NO: 56617 - DNA, 760 bp, Oryza sativa
cccaagcttcggcctgtgaaaagcgttgtcgtagttctggaagattctcccaggtgacggcgacaggatcttggcgggaccaacatacctgaacttgttccaccatcttagctcctttgcgaacaagcctgtgatgcaacacctgacaaggcgaaatatcgacaacttcatcattcggcaaaacaggtcaatgaggctgcacccgttccactggagccaaagccttcttgagttgggagacgtgaaccaccggatgaattaaactggaatctagcaatgcaagacggtaagccatagtccccaccttggccaatacctgaaagggcccataaaaacgaaaagaaagcttgcgattagtgcgagtgaccaccgactgttgcacaaaaggctgaagcttcatatagacccagtcgccaacagagaaggagtgctccgatctctttaaatcagcctgatgtttcattctcatttgagctcgtagcagatgttctcgaataagagtttgcatcttatccctttcatgcagccaatcaaccaactctggtgctgtacaagcagctgaagctgtcaaaccaaaatagcgaggtttgtgcccatacaatacctcaaatggtgtggttcccaaagaagaatgaaaggaagtattgtaccaatactcagccaaggcaagccatttgctccattgagagggacaggagtgcacaaaacaacgcaaaaaggtttcaagacactgattgactcgttccgtttgtccatcgga

SEQ ID NO: 56618 - DNA, 14905 bp, Oryza sativa
acacagcctaagtaattttacagtccatcaaaaagtatcggaaggtaccacactttctagggtcaaatctagtacctctaagtactaccttgagatataaaaaaatagtataaaatttaggtacctcgagttactttttcaagtacatgaaatttctcttatctttattttctgacttgtcgctaatagttagttgttttttaattaaatagcatgtgttggcttgctttattgaagactcccgaggtttggtttatgccatctcacttgtgatatttgtgcaatgtgcttaaggccctgcttggtttatggtactaatggattagtccctccattttagtccctaaggatccaaacatggatgactaaatatgtatattgggactaaaatccactagtccctcgtggaggtacttatagggactaaagtaacagcctctctcttctctcttcctcggtccacgtgcttttagtcccttttagtctctggatccaaacagtaggtactaaagtttttagtctagggattaattttagtctagtgattagatgatccaaatagggcctaagtacgtggatgtatatatctgaagtgtatgtgatcaattgtgacttatgtggaatgtatgcaggtgcatatgtgatcaccattttcttaagggcgtgtggtttgaaattccatatatatattaatgtggtttccttccctatttcgttgtatttttccttcaagttttgatttttctaatacaaatccttctgtgggcgaagcagtgagcggcaggagatgtgggatgcaacaagtggctgggccgttttatcacgttctgacggatagaagtgcagagcaagagaaagttcagaaccaacacacatctgtcgccgcagcaatcaaatatggtatacattgccatgtgaaaagcatgtcgatcggcaaaagaacagatgtggactcttatctgtcgaatctttatattaagtgtggacaggagaataatgaggacaccaaagaattgatgtggtccgagaggcatgcatatatatagaagaagaaaaaactaacgactggagatcgaatatttcttgtgcaaaaacattgaagcggcctcctgcacacttgtggtccaaataaactagctagttacatttaaatgggaaaaatatctgttttgtttggtacagagtaaaatgtaattttttttgccgcctattcctagaataatctaatcctaatttgaattatttgtaaaatatattttgacggagatcttttgttttctttttgaaagaaaacgtggctctatgttttaatctagactgttatattatgaatatgatcggagtacatcccatctcaacattgtaaataatgtttattttctcccactgttatgataatttcaagctcttgattgttcgcacagtaacttaatcaattatataagacaaggacatatagcaacacaattacagctaaaaatgggcggagcttagatgttaacaccaacctgtctacccggattgaagtcccatatttagtggtaggcgatattgatatcaacagtgagctgtctgcggtgactttatcaatctcaggatatgtaggatgtacgtgcgtatatattcataggagtgagtgtgtacgtgtgtatatgagcgtttgtgtatagtatgttttagaaaaatgggccaacggccggttttccaggtagtgatatttaacgtttcaatgcaaaatcatgtaaaacataggtttgcaaaagaaaaccgaggataattaaatagtacagaatagtttgcaaaagaaaatcatggcattaattaaataatagagaatagccaattttacatccatcaacctttcataaagtctaaaatcctctcttactatatagatataacccactgactctaaaagcataacatgcaaagatgtcacattatcatccactaaaaagatgttatatcatcatccactaacaatcattaaatttaaacatcatgtaaacatgctataatatctataattttataatttattaaattttagagcttttagaatgcaagcatgttaaatcatcatcccacatgatccatataatattttaatatatatcttcgttatttttacatgatatactgtgtacctctatagttcatcctcacttagttaatgatatttttctcttctctaattaagccatatcacatcaattatttttagtacttaaatgattaatctatggtcccaattatctctctacttttcttctcccattaatttatattacctcaattatttttagcctttagatgattaatctaggtccaaactatctcaatacttttctactttcataaagtcatatcaccttaattagttttacatttgaatcatcattctatatactagttaaatttaaattatcaccgcgccaccgccgctccaccactatgagccgacgccgcctggccgcggcgccacgcaggatggccgcgcgccgccgctattaacgaccaaaattggtaaatcatagattggatccaaagtaagaactgaaacggatttgaagaagatctgtagccttagaaacagaacccgcatcggctaagagttgtatcagctaccgtctgcatcggctattacccgatcggacggggaggagccgatacagccgatcccggcaaagcagtcatgggatcgttaccgaggatggttcaaactctacgcaagtattgcaaagcatggattgaatccagaaagggcaattgtatctattcattaggggcaattgtatctattcattaggatattttagtagtttccttacagatatttttggtaagagtccgcctaagggacttgttcatattttgagttataatagagatagagtcgtgtccggcaaggacatatcatgtattttgggtataaatatgacccgatacattgtaaacaaacaacatcagttcaataatattctcagcgcatcgccacctttttctactttcattgtttcgacgagttcttgctttcgagttgggctgcatcggtttcgatcttcggcgaaaaggtaaaatttgttatggcggtttacgttcttgggattagtgcttacatcttcatgacactctaatcttgtttatgtgaatctccgagttatcatatatgctatataatctagatcgatatcactatctaacttcatcggccggcccgtatcatcgaagatagacgattgggctagatattgatgttgaggtagattatatggtgtatctcccatcctgaaaaggctatcatcgtcctgtttagattttatatttctcttcatgcttaatgctgcatcagttaggtttgatctattaagtaatgatctgaatcataatatctagcttgtcttatgatcgctaatagagatagcatcggattttctgccgatcttacctggtttagttatcttgttcattatatgttacttggtatactaaatctgccttttatattaagatctcgctcatttgaaatatattaagctatattaccggtctgattaggttatcctggtattagatcgattccttgttctttatatttcgtctatattgatatcttagtataaggtggtatcggagtactagccgatacatgtcagatttgccttatcggctatgctatgaatatatataatcttcaccttgaagtacttttacacataagtggtttatactatctcggtatactatccgatctatcccaatcacttggtttaaacatattaatatctacagccgatcaggtggatctagcttttctcatcttatatattccattgccaatctaacacgtgttgcatcagcttaatattggacgatacgtcatcggcaatccagccgatcggctgtcatttatggatttaactttgtttcctctttgtttcttgttgcttgcaggatcataccaactagcacgctcagaacccgaaagcaattctttggacctgccctagagtattaacaaatgatgaacatgcagaaccaacttttacattcatttgtctagacacgctgggtacagtgattcagaggtacaagatagtgctgccaaacaatggagagctagggacaagctcaactaaagatgtcgaacccaaggataataagcaggaaggaagtcctgaagagttcaaaaacttgcaagatcagattggttatgttgttcgtcacgcattatcaactagtcaggagtgcttgtcaatactttaactaatatgattaaatatgtggttgatggcacgatagttgagcatcaggctaagggaccagtttttcttccagaaggtgtttttccacaatacaagactctcagttctgataaacatcggcctatctcaggtttggccccagaacagccgatagtgtcagtcttagctcctgggaaacatggtgcgtcgacatcggcgccggggcaaccagggtttaatcctcacgttctggtcaaacaacaaccgcaacatatagggcaaaacatcccccgaattactccagatcaagtcgcctctatgtttaggccaaggcagccggttattgagccgattccacagataaccgtggcactgcaatcacctattccgtaactacatcaacctgttggctctcaatttgttcctgatcaacatatccatatggtgcatcagtctccttagcatcacatggggggcaatgttaacttctagtatcagcctcactcaccttaggtgcagtatcggctagggggatcacctctaccccaatatttgcctcactataactagttagaccaagtgcaacagcaatttcagggggtacctcaacagaagcctttggctgatatgatagccgacatgatgagggatcagtttgggctctattaactctattttgttaatagagttatgagcctatggagtcgtgttagaatcggaaatgtttaagtaatggttagccgatatgagtagtgtgggagtcggagtctgtaataatttccttaattagatatagagttttagatcaattcgatcgtgatagagtcagacttagtattgcttataggtataaatatgtgcacctggggtctttgtaaacaataacagttcaatattcaacttttagggcatcgccaccctagttttgctcttgacaagttcttgtttatgagataggctacatcggtatcaatctccaacaagaaagtaagttttgtcaaaatccttcgcttgtattgggaattagtacttccttggttatgttcgatatactagttcttcttttgcttgcattgcttatcaaatatattggctcttgctctgattcgttctgctttctaagtttatggtttctatatcagtcaccctgaaaaatgttcatagactcgtttaaatccgttaagcacaatgttaaccccgaactattctgcttagctctaatcttctaggttttcgtgtgtttattacatttactcaagttgatagattcttatcatagtttcataagagttttagccgatgaagtatctgcttaacatattataattggttgcatcgattaaatttgcaatatttattataatcagctagttactgtgataatgtctcgattaggtccgatctatctagattgtgataaataatcatagtttttgatgatttatattctatcttgttttgattgatatcagttaactttcttctatatagagtgttgataagttttatttcaaacatatcagctcatattcaaagatatatttatttactcaagattctatcttattattttcactcttatcccgtctcggttaagtctgatctatcaagattgattataataatattagaagattttataaatatattgtatctaagtttcagccaatagagttttattattctgacttttgaattccattagttatagccgatcgatccgaaattccatcagtatcggcatgggcaaaccatactatatcgaccccatgaacgattggcccattgatctaatcttctttattttatccttgttagttgtattggcattgtgtgaaccttatttgataggacctgcactagagcaagcaaaatttttaggccttcgtgtgtacgacgattttcacaccaacagctttctcctgtctgtgggggtagacgcctgtgggaggcggaaccagatctgcaaggtggtggcaatgtagacgagctctatgcggataaaaggctaggggcaatcggtagcatggtgccggcggacctcatcgtgtccatccccctttgttggacggaaggacgtcttgtcggccagacggggttggtgaagccgatggccctcgttagctccacggcatccgctgttcccctccgcttgatcacggtgcggttgccattctagcaatagcattgatcggtgtgaccagatacggcgattacggtttcatcagaccaacgtcggtgatgccatgatgcgccaaatcactttcaggtctaggagaggattctcctggcgaaaatctagttttttgcatgttcagaatagatgccttgaccttcttgaccttcgtagtcattcaacctacaaactctgtataaattggctgtagcattcactgctggagaaaacccacaatagtcccggtttgcaatgctctttagtctcaggtttcaaaccaggacaacgaatccaggactacattttttttcttttttttcattgttttttgctgtttgcatattgatttcgaaccaaactcaacaataagatcatccacattcacagaaacatcacaaaatcatccacaaattcccagattggatggacatactcaaattgacatcataaatttacagatgcaaagacttcacaaatcaataaatttacagataatcaacaaagacatcacccgcgccaggtaccttccctctcccgctccgccaccagcgccagagccgacaacgcggccgcgcgggccactggtagcacggctacgtggggctgccgccgccgctgcgcccggccgccaccgccttcgctccttcctcattgctagtgctgcaaagaaaaggagcggataagagagaggaaagagagagaggagagaggatgaaaggtaggagaggaagttaaagatgaggaggaggaaaagggtggagtttgcgatcaaggaggagaggataagtgcaagggattatatacgacgcgttgatacggaactaaaaatagtagggtgccagacgctttttgaaccgggactaaaaatcagttacaccaaccaggactaaagatcataaagtggtgttgggttttttaaccggggaaaaaaagatttttagttccggttccttttttttttctgaactagggcctgaaagcccccctttccattaatggaacggcacatagagtcttaaacaagctaccaaaagagaaaaaagaaaagcagagaggttcagtagaaactaagctgaaacctgaaaacagcaggtcagcaagcaaactgaaactagcaaacgttaccaggatcccaacagcagggactagacaaaagctaagtgagtgagaactcaggggggttacatcggtagacaaagacaagatttcagagacagaatcattccaatcttcttgcacagggcctccattcatatctttagttgaagatgtcatttgccacctgctttaccagcctggcccccagctccaatcttcttcagtttgcttccagtttctgcaaaatagcccaagatttaattagattaccgactaaatagaccacctcaatgggatcttttgggagaatgttatcaaagcaggctttatttcttgttttccaaatagctcagatgacagcagcagcccccaccatcatcatattcctcatgtttttatcaaaactggttaaccaggtaccaaatagctgagttttattcagaattggtttaatgtttaaagcacatatcacaatgttccatattattcttgcagtagggcaatcgaagaaaaagtgttgaatggattcttccctagagcaaaattggcacaacttatctccttttctccaacctctcttgtacaggttatctttggtaagaattttgtttttaagaaacaaccagagaaagactctagtcttcagaggtatcttaaccttacaaatctttttataagggaagacaaactgcttcattttgagtgttaagtaaaaagatctcactgaataagagctatcttttgttaggttccggttcccattggaatcgggacaaatgtgatttttcaattacccacaagagatcagttctccagtattgatttttaagcaaagatcataaataaagaattaaatttcaaatatagtgttcatttaacttttttcataaatattcaggatataatttatttaggaggaatataacgtcgttctcgcgtaacggggcgctgcagggtgtggcgcggcaaagtcgcgagaccgcgcggccaaccagcgataccgcagcaatacgccaatcattactaatgatcctgattagcaattaagtagtgattagttaatctaattagtgattaattaatttgctaattgataattaatcactaatactgctctttcggtctcgcatgttggttgtgcgagaccgttcggtctagcatcttccacaccatccgtttcgtcacccatacgtcgttttcgtgtatagattgtacgagatcgacggaatagttttgctaaaaagttgcgtcctgaatatgtgaaaaaaaattgaatgaacagtatatttttaaattgaattccataaattccattattcgaagaaatagaacatttacgccagatatggtttcattttcacaccaaaccacccctaacctacaaacgaaccaccataacactgacggacgcagacatcacaacaaactctaattaaacttgatgcctatatatatagggatatggatgctgcaagtggaaaataacctcattggagaggctaaaacggaagagcacactagtggtttcacttgtgtcacttgcactgactaattgtacgagctcgccacgtactgtctcaccagctagcatggcgacatcgccgttgccacgttgggcggcgacgccgagcccgtcgcgcccgctgtggcgttcatccggcggcggtggcgccatcgtcagtaaactcctgcgttccccattcaccaccgtgctcgaggctgtccgcgggcgtgctgcccccgacgacacgccgcctcctgtacaagctccaccggcgccggagcacaactgcgccggcgcgttcgacggtatcgccgtcgtcgctggagatgggagggaggagcggctcgacgggggcgtgttcctgacgtgggaggacgtgtgggtgacggcggtggacagcggggggaaggccgccaccatcctcaacggcgtcagcggcagcgcgcgccccggcgaggtgttggccatcatgggcccctccggctgcggcaagactacgctgctcgacacccttgccggtaacacttgtcgatctcagtttctctctatccatatgcatctctctatcgacctgaggtttacacaatttcactcgtcttgtgtgtgtgtctacatatttgacaatccttatagcaataaactgtcgaataatatatattctccaaccacactattagtaccatacatcagtaaaactacgtacctccccgcaaaaaaaaaaaaaaactacgtacctggggtgctctttcatttgttaaagttctacagatcacaacgtaatctacaatacactagtcagaatttcatcctatatattcataaaagtttttaaagaaataactatattaaagtgcttccaatgacaaatgtattgatatatatcattttcacagatcaatttaattgtagtatttttcttctattattaatttaacgtttggaggtttaactatatgcataggacgttatctttttgagaatagatttttgctaatgtgaggtcgtttatacctttaaacaccggaatatacaatacttttcaacatttctgtggatagtgggacattgtcactgacatttgagcctcactacccttgggctcatatgtcagtgaccaagtatagagagggaaaaaaaaacgagcacaacgtaaccaaggaagaaatatgttgtagaaaaaatagcaaaatcaatttgagaaggtgacaaatgtgtatatccctgtccactgacctttctgtaaaattcagtcagaacatgacgcgatttgggtccaaccgtaacgagtcttccacgtttgaaatattttttttttgaaaggaatcagcacgagactgtgctatttcattagatataggcgtaaaaaaatacaacccctagaggcaaaaaaaaaaaagagctgtacaaattacataagcgctatgattaagctggtaagaattctccaagtcgccttgtgcctgccattatccaggttcttgcctcttcctttatttttgccataaggttgggggccgccgttttcttgtgctcgaagatcctttggtttctttctttccagatttcccaggctatgagtaggattaaggatcgcagccctttcttgggcactttccttttattggctaacatttcccactattcgtgtacgctttggcatggctcccaattgctcggatccaattgctgataagccacccagttggccgtcagtctccagatccttctggtgtatctacaggaagctaaaaggtggcatgccgtctcgttcgtcatacggcataggaggcacactccgctatttggccatcctcttgtagctagtcgatcggaagtccagactctattttgaatcacaagctacgcataaagtttgcattttgcaggggcccaagatttccaaattaggggattgaagttggtgccgactgttcctagacactgagccttgtatgccgaagaggccgagtattctccatgattcgagagcttccagacgatgtgatccgactcattttggtttagcatgatgtcctgggttgcgctccatagggacacaagctggctgatcagttccactgtaaaagtagtgttcccatttagctccaatttagctccaggtcatcgatccaggtgtcattttcaatgccttcacgtagcgatttgcttcttttcttggaaattgcatagacgagcggcatgctgtcctttggtctttgcccatccagctaggcggactcccaaaagcggatcgtgtttccatcccctattgttattttggtagctgcggcgaagagaagtttgtccgtttcatcacacggtgtctctagtcccacccacggcttggtggggtgtttccattcatgccagagccatctcagtcgcaaggccctcgtaaacatctccatgttcagaacccctagtcctcctagtgtggttgggaggcacgtccttttccagttcaccttgcatttccctcctgtaattttccacgtttgaaatatatgcacggtgctcctgtttgtagtttggttgcggtcacccgcgatttgtgaagaagaagacgaagaataaaaagaaaaagaagccgtccattacttaatttgttgcatattaaagaattctccgaatttggcaccatcgtcctcaaataaaaaaaaagaacacattaattggatttttataagaatggaactctaccagaggaaactaaaaagaatataaaaaatttaaagaatcctgcaaatcttttttatcacggtaaccatgcataattactgtcgataattcccctgatgaaaattaacggcgttcaggaattgacacttttattttcgaaacgacctgcacgatataatgcgaattttcacattgatatagaagaaaaaaaaaaactccctccgttccaaaatattaaaactgttagccctaaagatttgtactaaaatataacaacttctctatcaatattctcttcccaaccaatcataatccttcaccattcactttttctacctaactctactactcaaccaatcacaaccctccaccattcatttctacctacgaatacttataatctagaatggagggagcacaaaattataacactgaagggtgtaactaggaaaaaccaaaaacaaacacaccaccactgcttgctagcggctcctaacacaacctcgaagatggcacagtaccaaaccgactaccgctaagcgtgaccaatcgttacgggacaagaaaggggatcacaatgcaccaccgagaaccaactccaaacaaaagattaatgatgtagtggggttgagcagggagagggtgagacaagaagatccgctcatcccccacgccaagcttgtgacaacaaccaatagaccacccaagaccaagctgaggggaggccgtaaaggtggggaaatgtagacctccaagacgcctttggcaccaacgtcgcccctccaaaaggactgagcatggttataagaaccgggaccggactggcagttcgaccagaaaaaaccagaactaaggctgcgtcggctccgcaaacggaccggcgaaaacccatcaaaccgggtggttttttgccgaactagaggtggttcgactgctgagggctgctgcaatgagggattgaacccaagacctccttgttcccatggaaagactcatccaccacggcatgtcgcctattgtggtagtattgtagcacacatttatttaaaccattttaaactggtggtttgaccggtccaaccaacaaaccagttaactgagtgccctaatggttcattaccggcccggtcttaataaatatggtcaggaggggagaggaaggcagcccgacaactccacaaagagggatcacgaaacccaaacacgtcatcctcagataactccaagctaggctttcacctgctacatcctctcccgcacctgtcatcgccacccagagctccaccaaccaacgacctccgctagcctacaactctatcgtatcggcaccacagtgatggtcagcccagaccagccagcaccacctcccaccgcctagcatgacgcgatctcccacgaggccgcgcagatagagcaccctcttccccaatcaccaccgtcatcgtcttgccaaaagagctcccttcgatcggaaggggctagccatagcaggcgaggagcttcatggagagaaaataaaggtctgattggctagaaggacagacctgccaccagctgcagcgcttgctatcgcccgcatcgcctcggtcgcacctgactcaaccggtggtctcggtcgcgcagccaactctaccgttcaacccacttgtgcccactgctcccaccaaggatatgccaaatccagtcattgggaaactggatccagccaagacggtgtcggatcagcagcaaccaaatgcaccgcaaccgccttctcagcctgctgcacggcatgcctatggtggctaggttttcgcccccgacccacccacgaggggacggcgtgagggaagaaattgtgtaaaatttaattttttttttctggaattggtactgttggagcgagatagaaagatatttgcacattcctgttgcgaatctttgggccggtaggaaattaaagagaatggcttttcttcgaagaacacgtcgatatcgtgtacacagatacacagcacgtaacttacgtgttgaacgtattgattaccaagttgatgtggtggaagtggaaaatgattgcacgatcgatgctgatcgctgctcggccatactgaatcgtacccgttaactatttcacattgaggcagttggagggtgaattaattttctgatgctgactgaagttaagtcagccaacccgctgttattagcaaacttatccagcccgccattaattttcttttttttttagaattacacagtacaacgcagacactcataactcacgcgcactcacccctatgaacacacgcacgtaaaccctatctctatgagcatcttcgaagactgggctagcaaattcttgagagattgacgaagtcaccacaggcgcctcgctgtcgacgggtacgtcgcctaccactgaaagcacagcgccgataaatcctggataattcgctcccatggggagtcgaacccaggacctcaggtgctactgaggtggttgcagacttaatcttctttatgtatatactcgttccatttcggggttataagatgttgtgactttggttaaagtcaaactgtcttatgtttgaccaagttttttaaaaaatagtaacattttcaatctaagaaaaatttattatgaaaatatagtcaattattgatttgatgaaactaatttagtattatattactatatttatctaacagtttaactttgaccaaaatcaaaacgtattgtaacctgaaacggagagattatatgtataacacccatatgggcaccatggtctccgggcaccaaggtatgaaataaaaaaattcactcaaaattttaaaattttgaattttaaataaataaataaatatatgtatgcatttatctatgtatatatttatcgataaatatgcatttatttatatgtatttatttatcgatcgatggtggtacatgtttggagaatacccatctcaaacttcttctgcgtgaaaattattaatacagaaaatatgaactataaagggagggagaaaaagaaagaaagtgataagaatggcagttttaacgatttgaaacacatgattttcttttatcagagtataatcatctgatatcttcttctgaagatttaattacaataaataaatagaatagtatgatcggatcatatattagataaatagtttaaaataaaatataattaaagtgaagagaagaga

SEQ ID NO: 56619 - DNA, 1885 bp, Oryza sativa
tggtgaggccgggagcttatcttgaatttaggaatcaaaaattcttttaaccgatcacaaaacaaccttatctcttatcttcttatttggttcggattgtgtgctcatccgaaaaatcaaccaatagtggcgtctacgagtaacaaaaattcatttggtggcataaaaggaaaatatattttcttttatacatagaaactcaatatcttttaaatggcatataaggtattccctctaaaatagggacaccttatccgttagtacaagcaactaagattggcttgtggttgcttttaattttgctttatagatcttgatattgtacttataccatgtttatcagggtcctgctaatgcgcggatgatcgctgggagtgagcgatcacccacactcccctccgcctatgccgattcctccctcttctcccctttctcctccccatcttatcttcctactacagtacaccacaaaatttttttaaaaaaacaaaagttagaaaaaattatggatagaaatgctatatataaaaaaattgaatttaaattcaaattcaaatttgaattcaaattcaaattcaaatttgaatcgggtatgtaaacttttgacttataaactttggatctataaactttaggtgtataaactttagatccatagaaatactatatatagaaaatatttgaattcaaattcaaatttgaatcagatataattcaaattcaaatttgaaacgggtctataaactttaggtctataaattttagatgtatagaaatactatatataaaaagtttttgaattcaaattcaaatttgaatcggatatataaacttttgacttataaacttttgctctctaaactttagatgtataaaccctaggtgtataaactttaggtgcataaatttactaaaataggaaagtaatgcggtgccaaaaaagaaaaccaggtagagcgagggaggggggaatggggcgatcgctagccaatagctagggcgattgatcgcccattagagtttccgtgcttatcatgacttcctaatgtatcttttttatgtgtgaaaactgaaaaaaaaaagaaattcctctctcctcttactttattttatttgtgatttggctctccatttatgtatggaagcaaattagaaattcctctatcctctatatatagctattttgatcccccaattatattgtttatctatctcgtatcatcaactttatattacgaggcatgcattaagctccaacaatggtgatgtccataatgttagcatgccaccaatggcatgcaataagttcccaacaacactgatgtctatagtgttaaatagcatgccacctattgtaaaagataatgtggcatcagattaaatgaatgaaacgatgaaactagatcttgaattgagacccagtttctatataatattaagggtattgatcaaatatttgatgttaaattagcacagtaaattggtgatatgtgtgcaatagaatagtgctatatatagtttctagatgatgtggggcatatagacactatatattaacagtgtcttacagcactgggacggtcgtccttatgggagtcttagtgcttcttcgtctcagttatagagttccttctttttttctcacggttatattaaattgtgtctttcgagctgagtttctgttgtaatacgccgtatttcagttcataacatcttatcgatctgtactctattgatatacacaggaagattggattcaaacttgaagatgaaagggcaaattctggttaacggtcgatgtcagcaacttgcacttggaacctcggtgagttcaagtgagaaaactattggagcatctaattaatacagcccattttgattagta

SEQ ID NO: 56620 - DNA, 5491 bp, Oryza sativa
cggaggggcgggcggcggacggtgacgcccgggggcgcacagtggacgacggcgcgtgggagcaggcggtgggcgcctgatggcgatgcacgggggcaggcgatggacggtggccctgtcgcactcattggggtggggcgaggctgcggcggcggcgacaactgcggtggaagcggcgctcaaggtcctgcaggcgtacgagctgcggtacaacgccacggtggccggggtcatcaactacgcgtcgacggcggggcagcaactgctgtggacagcggcgcgtggggaagggggcgtccaccgcactgccgatgtgtcggagctccacatctcgccgcggacgccgtcgccgccgctgccgctgccaccggagccggccgagctcgtcgacccgccgccgccgcccaccaccggcccccgcacggcgccatgcgcgccgaccgccctgagcccgacgacccgagagagagggggagagagagacatgagatagatagagtatatatatgataggtgggccccacaataaaacgctgactggattgccacgtgtacgccacgtagaccaaaaccactgcggattgggtcgtggggggtaattcgtccggtttgcatagttaggggtgaagaatgtccggttttgtggttcaggggggtaattcggacgaccgcgatagttcgggggggagagataattcgtactttttccccttctaatccccccatagtcgagaagaagcgaacatgttcactacgataaaaataaattaacatatgattctagccaaatcttttagccgtgtatagatgatgattgcaattttgtctacaataaaaatgttgtgaaatttcacatggtaaaaaattacactattaataacagggatatatatttagctagtgtaatagtataatcaatccaatatgctaccgaacttctttagacttagggggatttacaatcatgacactgcaaacattaactgcaaacattaacgtagctcaaatattaaggatagagccagcgagagagaacgagaaaaactggtgtctgatctaaaaacatgaatgtattgtgaatgcatgaatcaatcaggcgtacgtgacacaagagaacgtgctaatggcgacactaacagtgcgcgaggccatctactactcggcacagatccagctgccagacaccatgactatggcagagaagttgcggcgcgccgatgaaacggtgagggagatgggactcaccggcacgctggacactcggatcggcgggcggtcaagcaagggcatcagcggtgggcaacaaaagcggttgagcatctgccttgacatccttacacgtccccggctgctgttcctcgacgaacccaccagcggcctcgacagcgccgcctccttccatgtcatgagtcgcatcataggcctcgctgccagggagggcatgacagtcgtcgctgtcgtgcaccagccatgcagcgaggtgttcgagctcttccatgtcctttgcctgctcgccgctgggaacaccatcttctttggcccagcttcaatggctgccgaggttagtcgatctagtgtagaatcattctgtgtatatagtcgtttaattagttaaatgttatcgctgttttcagcttgcaatagttggtttaatttgcagttctttgcttcaaatggctacccttgccctccaatgaggaatccatcagatcattttttgaggactgtgaacaaagattttgacaaggttagatatatagttggtccaagactccaattcaagcactattaatgaaatatcatgttcttttggataatgagtaattatttacaaatctgtcctctgcaaacagtatctgcacaatgtcacagcagcccagcaacaaaagagaaaagaacaaaaataaaataaaaaagatgctatgaaagtacgggaatatatcctatgcgcacaaaattttcatgcatactccgtgtacatcatctagcaaatatcacagaaaattccataaaagcatggacacatacttccaataatattacacttatgtgtaaaatcttatcttcaaatttgcatatatgtataatattgttgggatacatgtctaatttttctataattttttcacatttgctcgttgatgcgtacaccatcaaatgtccggcaacaaaactgggtgacaccaatttgcttgcttttgacctgttacctttcaatttgctaacacacaggagagtgaagacagactccggtgcatgccagctgttgcagatgaagcaatagacattttggtgaattcatacaaatcctccaacacttcggaagtcgcaaaacaggacatgcgtcacataaacgagatggtttctgctctaaacttgtgtacatattatatttatatgtacaacatacttattcacaattatacatgtttgggatatatgtcacaagttatgttcatattcttttaggatcgggtgacgattggaagaaaccgagctggttttattaccaagacacttgtccttaccagacgttcatttgttaacatgtatagagatattggatactattggttgcggatggccatttatatttccataagtgcttgccttggcaccatattttacaatatgggctatggatccgattcaattcgagtaagtgaagataaaatgttggctgttttcacacaaatggctgatagagtatgcatgtaccaaacatatttattaattaattttaattgattcttcatttcaggctaggtcatcaatgttaatgtttattagcaccatgctaaccttaatggcaattggagggttcccatccttcgtggaggatatgaaggtatttatgaattgatatgtcattagcagaaagagcaaacatgtttactctatataatttgttaaaatcgactgaacacacatatagaccaacgggcataaatagtaaaattaagtcagtgaacttggatacgatgtctggaattgattattcaaattcatactactgtaccaaaagattcaacaaagttatcaacacgaataaaaattttccatcaaggacatgggatagtgctatttaattaagagagagtaatggaaataaattcattttcaatttaggatattaagaaatcatgtgaagcatcgcatagaaaagccttaaataatctctcttatgcatcctaataaaattcacaaatacttgcaatgtcttttgactctggataaaaatatttcaaacccacagctttcatttagtgaattgagttatactcaattaccattactaatatttaaatagccatgtaacactccgtccgcacttacaacatattgtaaacaatcaatatcagcttacaatatagtaaatcagattctagaattagtaaatcatgaaaataatattattgagatccaatggagcacagcttaatattcattaatttcgaatttcaagacaatcagattgtgaaaaataaactaactgagactacataccaactacaactcagtatttattaatttgttattaatatttgtcaattcgtaaattttagattgttaaataaaaactactacaacgcataactccaactgagtacacctacctatattataaactccgaacttaacaaatcgaaacactatttgttggacattctctggccataggtttgatagatgcacacatgattaatgtgggaatttttaccttttctagcttgtaggattaatgcagggcttcttgtgaagcctctacttattatatatataaaaaaacccccaacttatttactaaaaattccagagtgaaaatttaataattttattaaaataatttaaatacttcgcatctgtacaataggttacatttcatgtagataaaaaaaatcgaaatatgcaaggttgatttatcaaatgaatttgcatttgtgcatcacatttttcttaatatgtggtcttatatatctacctttctcttcctgttgctcagatctttagcagggaaaggctaaatggacattatggtgtaaccacatttgtcatctccaatacattgtcatccacaccatatcttcttcttattgccataatacctggtgcaattgcgtattatcttagtggcttacaaaggcaaattgaacattttgtctattttacgttagtactttgttcatgcacaatgctagtggaaggcctgatgatgatcgtagcaaccatcgtaccagatttcctaatggggatcataacaggtgctggtatacaaggtattatgatgctcacaagtggattcttccaacttcctaatagccttccaaacatagtatggaagtacccaatgtactacatctcctttcacaagtatgcactgcaggggttttacaagaatgagttcttaggtttagtactcaaccttgaaggacccataacagttagtggcgagaaagttattgctgagttatttcaagtggaaacaggtcattcaaaatgggtagatcttgcagtactttgtggtatgattatgacctatagactattgtttgtagtgattatcaaggttcttgatatagtcaagcccatacttaaggggatgacatttaggtgcaacactaaatgcattcatggcatagagaacctttgcgccccctcgtgattcttgttggaaaatagtatatctaatattgtaatattgcttggtgcacttatatacagcgagaaaaaaatgtagtattgtatttatattactcaatataagtatgtgactatattgtgaacagattcactactggagaaacgctttttagtcccggctaggaaccccctatagtaccggttttctaaccgggactacgaatccgggactaaaagatgtccagttttagtcccggttgaaataaagagactaaatctttagtcccaattggtgctaccaaccagtactaaagttaattttttcttttttttcttttctggcgccaaatatctccaaatcattagaaaataataaatcacaaatcatagattgggttcgcacatcacagattgttcacacatctcaacatcccaaatcatccacatcaacaactcaatatctcaacatcccaaatcatccacaacaacaaatcacagatcattcacacatcattctcaaatcacagatcaaatcaacaaacaatcattcacataacgagaaggaaaaaagaaaaaaaaatccatgaagcctgccaccacacggccttccgcgccgggccgccgtcgctctgccaccgcctgaccgccgcctccccagcccagcatgggcccgaccgctgccgcccctccccggcacaggcccggccgccaccgcccccacccagcacgggcccggccgccgccgtctgcttctcccgcagatctgaggaagagaagagaggaaaacttaagaagtgtggaagtggaaggggagaggaagagatgagagtgaaagaggaagatgaggaag

SEQ ID NO: 56621 - DNA, 2463 bp, Oryza sativa
cctctgattattagtcccggttgtttataccaactgggattaaaaatagtgggggacctgccacgtcgtgacaatgaataaaccggtacaaaagatgatctttcgtcccgttaccaaccgggattaaagatcattgcacttttaaaccgggactaaaaatgcttttagtcctggtttttaagcaatcgggactaatgttgtttttgggcaaccgaccaaagatggtttttctagtagtgattccttgcacataatgatgctatatcaaaaatatttttgattctacatgatatatgtggagaaaaatatatttattatcttgccaccattttgttgcaacgtgtgcaccgagcctctggtaatctagatctggttctaatagtcgaagcagcaccttgatcatgaatcacaaataaagtaacttctgattttggcggtgataggatctaattcagctagcaagccaattaagattgattgcttagatcaccttctgaaaactaaaaaatagaaccttgacagccgaaattccattttttagtccctacaacaacaaagacacggcaacgacggtgacaatggtactaacctcaccagaacttaaaactctaaacatactaatgctaagaccagcaacatgacacaacggtacaacgcaaaaatcaacaaagcaaaaattaaaaagaacaacgcaacaacgcaaagatggttaggtaatggatgaaaccttttttttgaatggctattttctggttataggaagataaaaacacaccgagcaactaaaactctgataccacttgatattaccctgagctcgaatgtatgtgctcaaagctctgattgactagatctttcggcgagttaagataactacaatttgggagagaagttgtcgactgtcacgcccagaaattcccgaatagaattccaagcagaatgtgcattaaacccctgtctaggaccggctagggtacacaaatgacaaagttgacatgcagattcacgtcttacaaacatataaaagtcttacataaatgcagcacaaaataaaagcgagcttattctagagcttgacatgaacagcgggcgacaccattccacaagcatccttgacggcacggatgaagcctactccttcgagtaacataacctccatctgaagcatactccaactctggggtgggagacagaccaagactgagtactacccactatactcagcaagtcataccggaagagaggtatgatgtagtgtatatataccaagggagctgagggtttatttgcataattctagcatttaaaagtaggtgttgaaagcagtaaaatcgttttaatgaattaagcaatattaatcatcactgcgcaacactacaccacgttgcaacaggcccaaccaaccacttgaactacacaagttccattaggtcaaattattatagatgagactaatcacggtgaatttgattggccacccataacacccgatgagactactgaaacatgaaacaaagctatttttaatggtttctttgcattttcctagatttactgagacttcaatgggcttaaacggagctcggatgaattttctatgaattttagaatattctctctattttattactattaacagatactccttaatgatttattgcgcaataaagaaccctgctgatgtcatcaggagggaagcggagccggccggcgggccccacctgtcggtgcacaagggcgccggtccgcagtggaccgagtccaaggactggggtgcggcgcaccacatggcacacacatgtggcattgacgtggcagccacgtgggcggcagccgaacggccccaatctaccgagcggtagatcggacggctgcagcggcacgggcacagctcgatcctgggccggccagccgtggcgggcagcggcgcacgatgcggtagtggtggcgctaggagggagagggggaagaaccgagggttctcaccgaggggttcggccgacgcggagggagacgacagtagacggcgacggcaagatgagtgggtggacgacgtccggagcggtctaagggagctaatgagaggacttagaggaagagaagaggtgcgaggcgagcggaaatgccgtccgaaggcagcggaaatggaggggctcactggtgtgctgtgaaaggttgttcccggtggcggttgacgacggacaatttgcagacgaggtggccctcgcgctttcgaacccgcggcagcgatgacatggctcggctcggcgcggcggctagtggcagccggagcggtggcgacggcggcggagatgggggcgacggcattagagtggtgggtgcatgggagcgggggtgacatttataggggcgaggaggtcgggcgtggccaggaacggccccgattttgccggcgtagtgggggaggtggagagagagagagagaggtgggattcgaaaatt

SEQ ID NO: 56622 - DNA, 6886 bp, Oryza sativa
aaaaggaaaaaggatttctagggatttctttaataacatagactgattttaattggtttaaattatctccagggctctgaaaaattccgctaaaaatcctattaatgtattttgacatggagaatccaacaaaaatcccaccatgtcgattcccattattaatcgcatttattaattaatgattagctctaggcttgatgaaattcaaagctaaaggaaggaggacttcaggatgtgacaaacctagcccccttaaacggaatctcgaccccgagattcggaaaagctggcaaagaggtgcggatgggcggcgtttaactcgtcttctctttcctaggtgacctcttcctcataatggtggctccactggaccctgcaaacctggtgtccttgtttctggttcttctcacgctggtttcaaggatgcggacttgtttctccacatatgtcaaatcctcttgaatctcgatgtgcttagaactagcctattccttaggtacgctcaaacatttcttcagttgagatacatgaagcacatcgtggatactagccttgctagatgggagctcaagctagtaagcgacttcacctctgcgttccaaaatcctgtatggtcccacaaagcgtggtgccaacttgcctttgggttggaagtggtgcactccccggagtggcgtaactcgaaggtacacatagtcccgggcttcaaagataagctatcttcggctgttgttcgcgtagctcttctgccgagaccgtgaaattcttatcctttccatgaaggttctgacttttttcctctacatcactcaataattcggtcccaaacaattggcgttctcctgtttggtcccaaaatagacggccatttgtaagctggcctgataactattgttgtaggagaactcgctataaggtaggcttttattccaaactccgccaaaatcaagagtgcaagctctcaacatatcctccagtatctgattgaccctctcggtctaaccatcagtctgattgaccctccacaagggtcctgctcaacggctcaccgcgcacacccatcaagcacgacaggggtcttcatcaaggggacccgctatcccctctcctctttatcctggccattgacccattagttgccgtgttggaaaaggccaccgacctcggctatctcacccaactaaatgggagaacaccacgcctacggatgtcactttatgcagaggacgctgcaatgttcgtccggccgacagtcagagacatgagccacttagctcaaatcctacactccttcagggacgtaaccggccttcagacaaatatgaaaaagagccagatcacgcccatccgttgtgttggcatcgacatacaagagatcttacgagtcttccctgcaaacatcactggcttcgcaatgaaatacctgtgtctcccgcttgtggtctccaagctcaagaaagtccacatccagcctctgttggataagtgcaaggccagattggcgccatggcaaggttggatgatgacagcggcaaggagaacaactttaaccaagtccgtcctaagatcgcaaacaatctactatctaatagcttaaaatcccgaacagtatgctccattcaattgataagatgaggaggaaattcctatgagtgggaggagaggatatctcagttgggaaatgcaaagttagttgggacaaagttagtcggtgtgctagacctggactggttcacccgagcgctaaggttaaggtggttgtagtatgagtggacggaaccgaacaagccttggaatggcactgcactctcctgcgactagatagacaaagacctcttcgcaacggcgacgacaatccttttacgggatgggtagacggccagcttttgggattcgcattggcttgagaataagaagcccaaggatatcactccagctatcttcgcagcctccaaacgcaaaacaaggacagtgcatgatgcccttgacctcaacacatggatccgggatattgatctgctgcgtataactgaggcggatcatctgtgccagtacatctgcctatggacattgatacaacgtgccgcccccctaattgatcagaaggattcaatcgtctggaagctgacagcaaattgaacctactcttctaactcagcgtatagactgcaattccatggagcagcaggaacgatctatatccagaccatttggaaatgttgggccttgcctaaatgcaaattcttcttctggctagtcatccaaaacatagtatggatggcagataggttgcaaaagagagggtgggctaatcaacatttttgccccctctgtcgcaccgtgccagaatcggctctacaccttctagcaaattgcagattatccagaaggatttgggctgaactacaaaggtggacagggttagaccttcggttgcaagattgggatgggtgcgcaacggtagaagaatggtggtattaaatctcacgcacggtgaactgcccaacaaaggcccttaagttgatgatcatcttgatttcctgggagctgtgatgcgaacaaaatgccaggatcttcaggcatgcggcctcaactcccgccaccatcatcgccaagattaaagaggaggcacggacctagatcacaacgggagcagcaaaaatcattgagttaatctctgcaggagagtagtgcctttctgttttatttttttgggtccgattttcagtctcggaccctgttaatacttagttggttttttctccttctctatcaatataaaagtggcaaagcttttgcccttccttcactaaaaaaataaagaacttcatagtggaaccaaaggattagtttggtagttggcatgttgtgtgtatttgagcacaccaaccattaaccccccccccccggttggcttagctcttgctattcgatcctacaagtggtatcagagccttgttttgttctttggattttaaccgatctagagttttagccatggcaaacaagtttactactaagcctcatgtttttgatggttcggattttgcttattggtgtgataagatgcaatcttacattatggctgaggattatgatgtttggcaaaaagtttcacagccacatgttattcctgaacagattgacactattgctttgaaaactgagtttaataataattgcagagctcgcaatattcttttgagtggaatttctcgttcggattttgatcgagtttcgcaacataaaactgccaatgaaatttggaatgctttgaaaaacattcatcaaagaactactaacattaaagaactttgtcgagatcttttgaaaaaggaatacataaaatttgagatgaaacctggagaagctttggatgattatcttggtagatttaataagattttgagtgatcttcgatctgttgattctgcttatgatgttaattacacataatctgaggtttctcgtcactttttgaatggtcttgatatgtctatttgggagatgaaagttacatcacttcaggaatctgttgacatgtctactttgactttggattcactttacacaaagatcaaaacacatcagatgaatattctttctcgtaaagttgattctaagtctagtgctttggtttcttccgcgacttctttggatgttggtgcttcttcatcaaattctactgttcttgctttgattcattccatgtccgatgagcaactcaaacagttcgaggaggacttggctttggccgctaacaagatttctcgagctatgaataatgttaggtacaggaaaaaaggtggtccaactcatcgctttgaatgtggtgctcttgatcacattcgttctgcattgtccgaagcttgggagaggcaagaaggaagacaatggtggagagaagaccaaggacaacaaccccaagagcacgttcaaggggaagaagactaaggagaatctcaagaagatgtttgatcaagttttgttgatgcgaaaaacacacactggcctggaagatctgcttaacttcagtgcaggtccaaaatcttgcctttaggttcgtgagcatgccagttgatttgatcctgcaatcaacaagaaacaaaacaaaagaaaccacggttaaatccataaacgatagccgatcggccagcagccgatgacatatcatttattcttgagccgatgtcatatgtgaatcgatcggcagttacaaataagcaaggtaagactaaatctactcgatcgagtacatatattaacgctatacaatctttctgtcgatgtatatttaaatcaagtgattgggatagatcagtcgccatgccgagacagtacaaaccacttaggtcgaaatatacattaacatgaagattataaacgcttatatcatagccgatcagatagatctagcatgtatcggctaatactccgataccactctacattaagatattaaaacagatatactatatcaaacaaaagcctaatataatttattgtgataagatcttaacgcaaagggcagacttagcatatcaattaaacatataaaacataaagctaaatcaggtaagatcagctgaaaccccgatactatctctcttgataatcataaaacaagctagatatcacaattataaataacacataatagatcgaactcaaccgatacagcattaagcataaaggcaagtatgaaatctagacaagatgatgagaatctacaggagatgatagatacatgatacaatctagattaataacaaaatataactctactgattgtttcctaacaaccagaaccagccgataacaagttatataatgcaactagcatagattgaaacatgtatatataactcgacggattacttagacagggttcaagtatcataaagatggaagtattaaccccgataacgcaagccgccataacaagttttacctctagttgaagatcgaatcgatgcagctcaactcgaaagcaagaactcgtcgaaaaaaacgaaagtaaaagggtggcgatgcgccgagattgtattgaacgaatgttaattgattacatgggctcgggtcatatttatacctgagatacaagatatgtccttaccggacacgacgcttatctctaacaaactctaagataccataagtctttgcggcagactcttgcccaaacatatctctaaggaaattacataaaatatcctaattaatatatacaattgcctatccgagagccctatctccatcgcggcaatcttcgtgaagcatcttgattgattctagaaacatctttgaaaccgccattatcagaatcggctgcatcaccttcatcggctgtatcaatcatcctctgtccgatccatctcagccgatgcagactccagctgatgccttcgcaaccgatgcatactctgtttttcgaatcaatctctttatcgaatccaccttgatcccaatgtcgaacccggattatgacttaccatatttggttgtcaacaagtctatgctgcttttgagccactaaccaatgtagatggtgagagtgaagatgaagataagggaaagaacatctccggtgtttgcttcatggcacgtggtgaatcgaattcagagtgtgaagacaatgatgtgagttcttttgaggaagctattcttattttaagtacaaaaaataagaaatgtgagaagatgtatagaaaacaggaatatattattaaatctcttaattctcaaattattagattaaaatctcttattcgtaatgatgaagactgcaaaaattgtgaagttttaatacatgaaattgaaaaaaaaaattagaggtgtcaatgttgcacatcatttgaaaaaagaccttctctttctcttggatttctcttgcacacacacactttggatgagttgtttttgactaaaaagttgttataaaaatatcaaattgtttttcatgctagtttggtatttaacatgatttgtgccaaaaagttaaaacaacaacatggtgttttggattgctcaacatgtacaccaaacaagatgaagctaaaagatgcattaggtcatgttgagtacatggaggaaattgtgaaaatcaatgaagtgctttcttcccccaaatgtcgtaaaagcaaaggtgtcatggtagattgtgaaaattgagttaatttgcaaaaagagatttcttatttgaaaagttatttggaaagattttctgatggtaagaaacaacttaacatgattttggatcaatctaaagtgactagttacaatatgggtgttggttttgatgttcatgactatttcaccaaaaatcaacctaatgttttgagtgtgactgaacatggtgaaattttgacaaaactaagttctaagaaaataatttttaagtctactggaattatgccctctctttctacaacactaaaagaaacaaaaacaaatctttcaaaaccatcttcttctaaagaaaagtatacttgttctttttgtggtaaagatgaacatcttgttggttttgtttcagattagctcataaacagaaaaaggagagagaaattgcagttgcaaaattaaagtggcaaaaatctggttttccctcatggaaaccggtcagaccgcagtgggtcccgcggttagaccggtgaccggtcaaactggctactgagcggtggtcagaccggcggtacagaggcggtcagaccagcagtaccccatcggtcagaccagcttcggagagatttttctaaaaattctcaaactatttttgcatgtggatgtatgcctatttgatctactggttgtgtgtctcagtattggattcctaaatttcttttatctaaccctagtactgaggctttgacgtcttcttgtgtgt

SEQ ID NO: 56623 - DNA, 5382 bp, Oryza sativa
tggtatctttttttttccatccttgtatttccataatgttattctccaactttattactctcgatcatttattttgtaattgctcctgatgttcacaaggacttggacttgaagatatgatggtgccatttttttacttcaccttttttttttgcaaaaaaaaaatgttttccttgatcaagaacagctacttgtatattaggggccaaagttgttgaagttttaacatgtgtaatctaaagcaacatccatatatactgaaactgccgaagtagttttctgaatgcatcttcatgtcagcattaaatgtactgctgctctaacaataagtttgttctcagcctgaagatctttgtgtaaagaaaatagctcaaatgaaagtagaaggtaaagaggctttcaagagaaaggattatttacttgcggcacaactctatacaagtgtaaggcattgcagaacatctttatgtcttgaaatggattgttaatttgtgtggagatgacttgtatcaattttatagctctgttgactatttacaaaaagttattgtatataaagataatttgttgatttctttgtaccaagtaaattgtctttaaatcacacctattaattgaaggttctttctggccaatgtcatgtgccttgcatctggtaggatttgttccgctgtctgttggatgaaacttgggtggatttgaggcatgggggtattctgatggtattttttttttgtctgagaaacaagaacagatgtagattatctctaaaaaaatgaatatactttttttaatttgttggtcatattgaaaagatatatttcatgaatgaactaaatgtgcttttgtcaggacaaatatctgggtaggaaaaaaaagggtgagcctgaattggaaagtggagtcatttaagagagaaatatacccacatgctggtcagcttgtatagtgctggtagtcatgggctgtatcatcatcccctgactcattgcaaacattatagctctcttatgactgtagctttactgagtaaagttttggtgtccgggggaacctgagcctgcgttagaaaatacatcacgatgcggtgtttcaaaaaatacgataacattatgcatgcaacagaaagaagttatgcaaacctgcaaacacttgagatgaagaagataaacaagtcatctatctgacactgttcataattactggcagtactactgttttttagtattaatattggcgatgattttaaaaatgatttttggaaggctttcatagcttcatttgtgtgatgtttttttggttattgctgaaagctgtatacctggtgtaatgtaggcactgggacttggacctagtcctgatgattctgcaactctgctggcaaataggagtctctgctggttgcgcttggaaaatggaaaacaagctcttgctgatgctaatatgtgcagaatgttccggcctcattggataaaagcctgctatcggcaaggagcagctttcatgcttcttaaggtttttttagggaataattaagttattaaagaacatattactcacaaatttttttgatcataaaattgattagttgttgctctgtgcatataggaatatggtaatgcttgtgatgccttttcagatggcttgaagctggacccagcaaatgttgatattgagaatgctctaaggtacctggtctttattttcgttgtggcaagtctcgttacccttcactgtgatgggttgagtaaaggaatatttgctgcttctatgaatagtaaatgttacatccttttggaatgctagtatttcgtctgcttgttgcttgccttgttattatgaagtgatagttccttaatactccatgaaacattgcccgcacaaagctggaaaagctgtctataaattatgctgtctaatgcttaccctgaaaacattttctttattgtagggcagcgcttcaggccgtgaagaatgaccggtgcgttaagaataatcagtgacttggcttatattgtcagtagaagttgagcttctgctctgttgctagttccagtacatctttttgccacgaaaactcttgtgcttttgtgaactaaagttggcacggaaactggagtgttatttacccattttaatattttttacgcctatccacttgtagcttagtttgtaagtgtggcagcttagttggggtggtagtcattgttcttcctgcctgcttaaatagctctgcgtgacatgcccacatcatctgatggatttgtggccgtccttgctgtaaattggacatgcaaatcctgtttataaggggctctaactcactgattctaactcctaaccctgacttcagtgggaactagctcctgtgcgatatggagtttgcctgatagtgtttggctagtaagatcagctctagaaatcctacaagagaggatattaggaggatggatagaactactactggagttaatttttaaaatcatgaacttttaggctatgtatgatcactatgtggaatttggtggtgtgctatccggtgtttggagaagccattagtgtcgcccttagttatttgtcggcgtcggtgttgtgatagtaggttgccggtagttatttgtcggcgttggtgttgtggtagtaggttgccggtgatgggatcagcagtgacaggaacacggtggtgttgcattggcgatggaaattcgccctttgttccctttaagcacgccttaggattggtagtcttggggttttgggaatggtttagcgtacgtgagttgtcgctcctgcatgggttaagcctaaccagtccaatcttagtaaaatagtaaaccaaagcaatgtgttatagcagtcaacataatgcttctatgacaacaatacctatagtcatcataataccttggtaggaattaacttacttttattgggtgttaattaattcttatgcccctatatctaggattttgttaaaggcattacttttcatatgcaccggctagcaacataatcttacttcaaattaagttataagtctatgtagtgtggatccatgagcatgaacttcacattaatatgctcattagtttgatcgtgggacctatctttcacaacatgatgttaatgtgttcggcagaaacacatgacattgttacttgaatagcaaactgcgaattataatgttgcgcattctcattatcgtagtacattaagtggtttagaaagcaatctatcactcttagttgcagaaaagtattattaagtcatactcttgctcattaacatgttacaaacttagtttgaattgtcgactagttaatgttacaaacttagcttgcattgtcgactatgtagtataataatatttggttccattaaccatggattttgctccttatacaggaataagagcataacttaacgtggatattattcacgtacccttgaaaattaatatctgaataacttcactcaaaagtcatcataatttcttattgtgaacatatcttcgaatcacttagaaacaatatgcaagacacttacaaacaatatgcaagacatcctcatattttagtagatacttttactctgaacttaaatctaccgaagttcccgatacataacacaaaacctatatgcatccaggcttagcgcttattttgcttccgacaacaaaaacatagggcttattttgcttccgacgacaaaaacatagggaatcaacttaactttatctgattaactaattccccctaattagagcagacgtgaaaaatcaacctcacattatatcccaaaatttctgccactgtatgaaaataaataagtctagtacttctttggacttaaacttaaaagtaaatcccttcactgatgcatctcttacttatgtgcttgctaatgggacattagacatatagagtatgaaagtgcatctaggccccaaatgattttggtgattaataacaatgtgattagaggggactaacaaattatttgaatatgtgcgaaggaatgttagccctcggtaaagcatggttcaatacaaaacccggcgaaagtgagaaaacgatgtgatgcagcatatgatcaaatggtataatgtaaattttattttgtttgtgtcattagagaaggcgtactatataggggaatgatgcattgataacgaggaatgcgttgggtgctcaaaaatcaatttttcaaagtgtctcctcaaaatatcagttctggagtttttcggacttgtccgaaatgtgttttcggaatttcggaaagttgtctgagttgagaaaatagtagtacagttccactttcggaatttccaaaaatggctgtgaagtcgaactcggttttggaaattttcggacgtccgaaaatcatttttgaaatttaccaaaatggctgagcgaccaaaatggttcaggatgttttcggacttattcaaaaactactttttagaatttacgaaaatgtctgcaagcaattttggtttaggtcattttcgaatatgtccaaaaaattttcagaatttccaaaaattgtcactcttgagtcactgatctacttgtggctggccaggagaagtttgtgaatgtcggatctcacctccgaaaggaaagagccgaaaggaaagagatagcactactggaagtaattctttgcgtagcctctagaggaaagggttaacgaagacccggcttttctgagctcctcaagagagactagaatcccctcaaggatttgaacttcgggaacacctaatcttacaagaacatcggtgaaatctctctccccctcctctagctttacttgtttgtgccgctataagtctagttactgtttgtgctagttattcattctcgtgggtagttagatctagcatttctttacccgtgcgcacactttgtgattttcggaatttctgaaaattcttgcttctacgtttacttaagttttgaaattagtctattcacccctctctaggcctaagtgaccctttcagagtactagtaaggttaatgtccacccaaaggcaattatccatctcattcaacctaaacttgaatttaccgatgaccttatgggatttaaggtaccattattattgacaatagttttgacatctaatcgatatgcatagatgaatttcataagaccacaatatttttgtgccttgccttccacaaccaatttcttggtcatgctatgtacacaaattaactaatgcaagtcaacataataattggaatttaaatatccatccatcgaaacaattagtgttatgccaacttaatgagtccttcttaaaggcaagactattttacttagtttccttctccttgtgaaaaactctcttctacaagcttagacaatgct

SEQ ID NO: 56624 - DNA, 752 bp, Oryza sativa
tgctacttttttattaaaaaaactatccgtgtcgtaaaattaatgtttcttgagaaagtagtcaaattggatttgactaaggtgaagggcatgtatgctaattgcattgcttcaaactatcactagaacatgcatgtactagaaagattggtgatgagctagctgtagaaagctatgacggcaatgggtaatccaaatagaaatttctagctatgccctccatttcatattataagtcgctttgacaattttcctaaccaaacttcaagtttgaactagtttatggacaaaattagcaacatctacaataccaaattagtttcattaaaactaacatttaatatatttttgataatatgtttattttgtatttgatatgttgttatattttcctataaagttggtaacttttttaagtttggctaggaaaaagtcaaagcgacttataatatgaaaaggagtgaatgtcgatcctatgagggaaaggagtgaatgttgatcctaggagtgaaaaggaatgaatgtcgatcctacgagtttgactaggaaaaaagtcaacttttttcgccggaccgaacgaatgagtccatctatttgggctgtttgctgctttgagtgaatgtcgatcctggtgttggagccaacaaatagatccaaattgtccgtagcctgatcaaacaagctaaatctacttccacaagtacagttttgtgccctcccatgtataattgtggtctttcatcataccaaca

SEQ ID NO: 56625 - DNA, 10365 bp, Oryza sativa
ataaagtaaaataacaccattatcaaaaagaaagtgcattaattgtacacataattacataaggcttttactccattgcatcacttaggtaaaatgaaataaaaatgccaagacattaatgtgcataaacataatgttccactctacaataccgttgggccaaaatagagtgaaacgacatgattgaggtaaaatacgcacataaataaaattctaccccataatgccataaggcaagatgggataaaatcatattaggacatgaaatgacaattgacgcgcacaattacataagatttttaatttatctcaccatagggcaagaaatgagaggctacatgtaaaaaatgtcaccaagattaatacaaacacaaaattctacttaatgatactattgagcgaaaatgaagcaaaattaacattagtatcttaataatggaaaatcctatatcgtaatttccgttgggttgtgtcacgcccggaatttctatccaaaattctaaacgcttacatgtgtgtgaaccctcgtccaggaatcagccgaggcacacaataacaaattgataatagagtacaattattactctaattaataagcgaataaaatatcattacagaggtaagcagcggaaaaaataagataaacggcgcagatgactccactccacaggcagcttgaccagggctacacctaatcctccacaccatcagcatcactgtagaactcctcctttgatgaatgattgcaaggtgagtatatgacatactcagcaagccacgaagcaaatatgcaagtgcacaggataacaaaggatggcatagtagggtttcatttgcataaacagcatttaataaacatttcagaatttaataaaatagttaagtaataattaaacaatattaatccaacgctatacaacataccctgttgcataggcccaaccattctgaacaaccatcctggctgcacagttctatctccaaaccaggaattaaccattccaaaccaggagctaatcaaattattaccagttatagcatcttttattatgatgagaaatgtgagactaatcacgaaagacattgttagacccgcccataaccgcgggcacggctattcgaatagttttactctggccagaggtgtaccactgtacccacaagacacagccccacaacatgtcaccatgtgcctcaataccaccacggtaccttggaaaggagctgtgacagtacccctcgcacaacacaatccaccacagtgcaccgttcctagatcataatcacccctttataaacaaggcatggactccccagcgacccccgtgggcttatctccgccacttctcagtctggtgctccgcaatgaaccatgttatacaaaaggtaaagccattgcccacgctggcttgtggttggcacggttaatgtttcacaaccgaaactcgtgaaccggtccttaattgtcatgagcacgaccatcaaaaccatgtgctcacaacccaccattatcaagttttagttggcaatttaattaattaaccaatcacgattgaccatcgtgaactatcattaagccatcattaaataatagtgaatcataagttatcccaatagtgtgctaatgtttctaagcatggctaagcaattatgtctaacatctagctgaaccaatatataaagctaaactagtcaaattatcacccaaggtatcaaagaatagagtaagcaatgcaaagtggtcataacaaaggaacaggtccacaccactcggtgacattcgaaaataaatgcacagttgaaataaatagagaatttaaatataggatcaacatgctcaaaggattgtttgggatctgtgtgacttgccttgctggccttggaacacttcaaattcttctcctgcgaaaacggactctccggaaacgtcggaatctaaacagaaaggagcaaaatcaccaaacagcacataaacaagcatgaacagtatatgtggatatttttaacatgtagatctcaattttagaaaaatttagagacttgaaccaactaaatccgagctaagatgaattagttatgaattttcaaagattaaatcagattaaatcatttatttagattttaattgaattatgacgcaataatgaattatttttgaaaaggaaaaaggggtttattgcgtcagcggctagggttcgcggtgaaccgggtgcacggcggcggctcacggaaacgaacggccgagatcgattcatccaaaatggacggccaagatccatcggtccatgaccgggccacggggaacgacgacgatgacgtcagcggtgacgtcatcaccggcgacgactcgggcacgcatgcccgccggcgaacgacggcgcggcggcgcgaacggagagcaccaaaatgatgcgggcgacgtggcgaactcaccgatgacctaaacggcgacggacggtgaccgaatgacgtcggcgacgaggaagaagcggcggcgctcttcggcttgacgacggcgacggtgttccggcggtcgacagcgacggcggagggacggacgaggactgcgacgacttggcgaccacgatggtgacctccccgagcgacggcgacgaccgaagcgacggcggcgcacggctggagcgacggcgacgacggcgacgctaggctgcacggggctagggctctacgggcgacgagaggcgaaggcgagggtggcggtgggtagcggagacaccgggggtccttttataggggctaggaggcggcgtcggaggcccacggcaaccggtgacggcgaaggaaggtctagggttcggggagagagacgaatccgattcgaaatcgaatccacggatttccaaacgaaattagccaacgattccataagagaaaagatagaggggatcccggggatcatttcccctctattaatttcattgaaaacggaaaggggcgggcggatttggaaggagatggcggcggcgcgacgctagggctcgagcggcgggcggccggaggtagacgacgacctgacaggcgggccccacctgtcagcgtccgagggcgcgcgcacgcggctgctgcgggcggactgggccagcttgggccgtggagagagagaaggttttgggccgactttcggcccaaagccaaaagaggattttaaaaacctttttcaatttaaattattcattaaatgcaattccatttattaaaaatacttccctagctcaaataaatcccagaaaaatctagaaattatagaattaagcaaagtatttaatgaaattttatctgaccccattttatattggaatttattaattaaaactagatcttctcttctaggcttttaaaataaattctaataattccaatttagacaacaatttatatatttggaatttttagggtgtaacaggttgaaacaataaaggcaataaattaaatattctagccaaatttctagttggttccatttagctagacatgatcttatttgcataaggatacttataatgcaattttatggcatcaaattatggcttaagctgattaaaaatgcattcatgtaattagaataacattgattcgggctaaaatataagaataaactaatttggcccaagtgctggccatagcccaaaattgcatccggccgacccattatcgtgcgcggaggcccgtacagcccatgagggagatcaagatcgcacatgtgtggcctagcttgcccacaggcccatgagcaggctcggttggatctaatcgatggacatgatcacccagggctggttgatgcggtgtaggtgcagcgtcgaccgtccaattccgatcagacgactcagctcaaacgtacccggaacaaaagcaccaccggtttccaaaaccctaaccctaaccattaccctctctctccctgatttcaccgacgcaaggagcgcacgcagcggcagggatgccggcggagtggtgacgttgagacgcccgtgcgcagagaggttgatgctgagcacgtctctggcggggtccagtgggttgccgtggccgtaataagtgcccatgcgagctaaggctggtgacatagtgtgaaggcaggtcatggactcatggtgtgtggcggactaataccgcgcgtaatcccttcttccagcttcagttctcctctccagcgcggtgcaagaccacgccgagacaagcctcgacctcaagcggaggactgatgcgggcatgaggccggtccgaggcgacggcttaggggatgcatagcggcagtgaagtcgtgtgccattcacatgaagacgatggagaactcggaacgatcgcgcacgacggactcatgccgcatatggcgaactctggcaacctgagcccaaaccgtgagtcttcttactcccaaatccttggggtttctgattgagttgggatttaccggttgggttgcacttaatttgggaattcgtcatgatttagggaattgaatgatctgagtcccctccttggctccttctaattgctacccaagttgaacttgattagtaatagcaatctaattaatacactaaaacttagctctaattgtgatcaacagaacatgaataataaatttgacttaatttcaacatgaacaaaaaaacatacactgaacataaaccttaaaactttaagaagctgacacttagggaaaacttgatgcaacctttggcttcaatcactggagtgatggaacatgcatagtcctaagaaggctcttataccagaatattggagttaattcttaaaatcatgaacttaggctatgcttgatcacctcattaagcttacgagaaatttggtgtactgaccggtattgggagaagccattcggcgttgtgatagtaggacaccggtgataggatcaccgtgcggcagtagtgacaggaccgctgcggtgtggcaatggcgatggaacactacaagaatcctattaatccgtgatgaaaaatttctgtcacatatcactaaaaaaccgtcaccaaacaacatctgtgatggtttcagaaatcatcacggattgagcatcatggattgatctgcgtgacggtttgtcgaaaaccatcacagattaacagaatcggtgatggttttaaaccgtcatgatggagaccatggtctagttagtccaaccaagcccatttcctgtgatgaaaaataaccgtcatggatagctgccacgtaggatatttttctgtcacagattagctgccacataggatatttttccgtcaaggatttgaatcaccacgtatgtgccatgtgttcgccaaggtggacgctgatgtgtcatcgatgccatgtaggacttagcccacgtgttttgtggcccaattctttttccaaggagctttcggcccatttatgacctgatgatttttttttgttttgggccggtttttttttggagtgttttttcggccttttagtcatcattcagcccagttcaaattgggctacagctagattttagcccaactaaaattcagttgctgctaaatttagcaaaatacaaatatttcgtccataattttagcaaaattaattaccgatcaattaacattctctcatcatcagtaacaaaatagttattgatcagcacataaatattctaaaaacacattacaaccttcacatctcatacaacataattttttagcatatctcatacaacataattaaaacctgttcaaaagcacatgacaatacccaacagccaccaaagcattttggccactccatcaaagtcgcatatgtttgagcccagcaacctgatagtacaataccatgtgttagattatttttttatgctctagagaaacaagaagaaacaatctaccgatacgatattagtttttgaatgatagggctactttgcaacaccaatcttatgtcccataatacattgcactaacaaaactcaatgtccccatctacctcatttcattggccaagcaagcaagcaactgatgctatagattgaaggagaaaataaatgtggtccttttgcaggacagagcaagaaatccacagtttctgaagcaaagaaacgcaacaaaacagaactatcaaagatttgtgttatgtacaattaatctttaaacatcttacttcaggaatagctctacatatcacgtactgacaaaaacctctgtacaagaaactaaaaatcaaggcagtgcacaactagttcagagttgttctgagttcagaatgctatttgaatgaacaacttggcattcacggccaagcagataattcccatccaccaaactatagatagattcacaaacaactaaagtggttagagatatacacagacaaattctactgactagacctgctcatcatggaagcaaaaccaaaaatggcatttacagccataaaacgacactgctagtttggctccttttgcagcttaagaaagttatcaagtatatacatcaaacaaatctacttggtttatttgcagattaagaaaatgagcaaggatatacatcaccaaatacttgtacttactagccaaaattattatcttttgcaaatttacagccataaacaaggggttgatagcaagttcctaactcatttcagatataatgaagtgcatcgaccatgttgtcaaattgaaaacttcagtgcattcatagaactgatttcaatctgaaagtaaaaaaaaaaaaacaaattcagtagtagatacacgtctgggatggaactgtaaagacgggaagaccgctgcaactatgacgaggaagtggatgacgacggccaggacggatgggaggcaggcaggacgtgcttctatttgcactaattcaatctatttgaaataagagaaagaagggggaggaggatgggggtaccgtgggatggatctgccgccatcgctcgcctcctcgccgcctagcgccggtgcaccacaccaccgccgctcacctcctcctcaccgccgcacaccgtcgagccctcctcactgctgctgctgccggaggatatctctcgcggtcgctgccgaagcggttggcggccatgaggatgcgcccccgatggcgccgagcaccccgaacacgaggagagcggccgcgaaggcgatctccatgatggacgtgccccgggcccgcccacggcgccgccgacaaggtcgtcctcatcggagatggagaaggagtggtccacgtacgccacgcatggctaccctcgcctcctcctctacatctgcctgtcagtgccggatccgatctatgaactactcttccccacctcctccttcctcgctcgcagcctcgacggcgccacctccaccatcgataccgctggcggcgggagaaggaggcatacctccgcgtcgaacagggcgtactcgccgccaaaccatctccgccggaggttgaggaggaagaggttgcggattcagatggggacttggcggcggctagggttggggattgcttcgtttgattttggatcggctagggttggggaacatgggtatgaagcaacaacggatgcgattttacaagaatagccttggtgcatgtactagcttctgacactatttggacatttcacgtcaattttggcttgaccgcgcgcagtggcaccgcgatgcaaacctggccggaaaattttggcccttgcagtatgtttatttttggcaaaaaaaaactaaagatcttatggtaatttttaattttaatttatgagaactttaaatttaattttagactgatttttgtatttcaaatgaaaaaatcataaataacaaaattgtagaactcatcgaaatctacaactattgtattggtcctttctacaaataagttcatttgaacaatttcaattttgaattttcagaatttgacaacttcgaataaaaattggggttaataaatgattttaaatagaaaagtcaccaaaaccaaagatgtagaactcatcaagatgtaaagtttttattttggtcatttcttcatctgactctatttgaacaatttgaaatttgaagttcaaagtttgagaacttcaaatagaattttttattagtgaacggcttcagctgaaaaactcatcaacaataaagttgtataattcatctagatctacaaattttattttggtcatttattcatccgacaaagtaattttaacattgttcataaattttacatatctccaatatggtttcataaattataagagagatgtgtatattttgtaaacaatgttactatcactttgtcggatgaaggaatgaccaaaataaaagttatagatattaatgagttatacaacttttttgttgatgacttttttagttgaaatcatttactatttaaaaatattggttgaagttatcataatttgaaatttaatttgaaattcaaatttaaattattgaaacaaagtcatatagcaaaatgaccaaaacaaaagttttcgattttgacaagttatacaattttgttgttgacaattttttcatttgaaatcatttattcccgaaaaattatttgagttgagaggagggatgtaaaatggacttctcggcaagggaggagcaaaaagggctggcggcccgaagagggaggaggagggagagggaggctgcgggctgagggagggagagagtaatacttgggccgaaaaaggcccaagtatagagagatgaattttaatttgtttttttatttattttaataggttaaatgaactttgtgatattaaaattagttattgcgctctgaaaatttatggaaaatttcagaaaataatttagaccacgtagaatattaaaaaaaaattccagcaatgatttttaaagaaaaattttagtttcctcgttaattcatttgattaaattgctttaatctttaatatatttttctagtaatgctatatataaatatatgacgttttcttcaactataatacattatagaatcctattagaacacaccaggcaactagcgcagtggtaggatgggttatcttcaactagaggtcatgggttctattctcgttgggcgcacgttatgagttattttttccttctttgaaacgccaactctgagttgctgggccaactcgagtgacattgggacaaataaaaatatttaagtgcacattgggacatctagaacaagtggttcaaagggtaagacacattcctaccttctagctaagttgtgggttcaaatcccacatgctgcagatttttacccatgcgcaccatatttttttagtttgccatattatgcatcatatacatgtaacaaattaataaaattattttgttcaaatttaacaaaccgtattttgcgtttgattcttcttgcaatcacattttttatttttctttgcgctaaatatgttttattttttattgctttgggctaactagagtatgacgaatttaaaatcatacattgtgacagtcttgataaaactgtcacgagttagcaggccgtgaatatccactgggctcatccgtgacgaaaaacaaaaaatcgtcacgattacgtttgtcagtgacgatctataaatccgtcaccgaaaatccgtcatggattaacaagtttcttgtagaaattcgcccttcgatccccttcaacacgccttaggatcggtagtctcaaggttttgggaatggcttagcgtacgtgtctcgtcactcgtgcacagggttaagattccctttatatgtatcttgtggggatcgggggtgattctttcttgaggaaaacggtgtatccgatcatagcgttaaggagagaaacatgcatgaggatgcgtgggactcgctcttcaacgttagagatcgcgtgggcgttggtgggctgagcccatcgctctcctttctggctcggtggtcagagatcaaccaacaagtactaccgttaggatttttgttttttacttgatgaaagattgggaggatggacaatactaaccttaggatttttgctgtttacttgatttaaaattaatacatgatgattataggcaaattttgctacatgacaccgtgacttcgtggttttagctgtagggcactgcacgaagtgatttttgggggaaaacacttccaaaagttagatatttggtggtagtcactgcacacattaaagtataatttccggttagagaggagagagaaatcgtgtgaaatgtcaaaaatgcccttgggcccacatgtcaactctcctacctctctatcccctccttctcttctctctctatcccacatgtctgtgacgttggtaggcaggcgaggttcggcggcggcggtgggccggcgagggtggagtggccgagggcgagggcaaa

SEQ ID NO: 56626 - DNA, 1382 bp, Oryza sativa
tggattttatgacatcggatattcagccgatgtatgttttaacttacggatcagtgcttattctatcatatcattgttagccgattggtttctactggatattattatcgttttattacattaccattatccgattgtctttatattgttatctacattggacatatagttgattgctcaaaaccctattgacatcggggagtatcgacatcggctggaattactccatcggcttgtctaccgatcggctcaatgatctgttatttgtatatcttgtcagttgtaggatcaaactgactggcatgctcgcatctcaacaacttttggacctgcactagagctaaacagatctcccaggccgttgtgttcgtcgacttagttcgcgccaacacagacctagcaccatcagccgagcgcggacttttcatcaacaactccattcacagctcactggaggaacaggttgccatgttccttctagttgttgaccacaatgttagatttaaggctttacaacccatttttagaaggtcaactgagacagttagtaagtacttcggagaggtattgtatgctgttggtgagctgagaaatgatttggtcaaaccaccttcaagtgatattcctcgaacaattcttggcaatagaagattcaacccatattataaggtaaaacaaatattatccacaagttacgtttttttcccacaacctatcctaacatttttcatgccaattgggattgtattggtgcaataaatggaacccatcttctatgtcagcagcgtttaggggtagaaagtgtgttactacccataatgtaatggctgcggtggattttgatcttaaatttacatatgtacttgttggctgggaagggtctgcacatgatgccctcatacttgcatatgccttagagagatgatggccttagtgtcaataatttagagtgtcaataatttagatcttcaggattttttttttgtcatctggtaatgattgagcacattttatcacatgttaggcctcactactgggaacccatttttactactggttcggcaaccccttttagtctcggttgtacaaccaggacgcacaatccggaactaaagatggtaattttaggcccggttatttcagtcaggattaaaaatcgatctataccaaccgatactaaagatggtagcgactagtggctagtgctaccatttttagtactggttggatctatttgcttttttttaatgttttttttgttgcttgctgcttttttatacatatgcatatatggtgcttgctgcccatatggtgcttgccttcaggcttagccaatggctctgtttacaaacgtggcccttctgctcacatggcaattagca

SEQ ID NO: 56627 - DNA, 2332 bp, Oryza sativa
atctggagggtgggagcagtcggcgacgatagcgacggtgtggcgacggcggcggcggcagttggcgacggcggtctcggccggatctggacgccggcggtagttggcgatgacggcgccggtgtggtgatgacggtggcggcggcagtgggccggtgacagttggcgacggtggtggcggtcgcggctgtggtggctgccgtgtcatctggcgatggcggcggaagacatggcgtcgggctgctagctgctcggtggtggagggtgacagcacagcggcgatttgcggaggcggtggttggcgtcggtggcagcggcgacggcggctgtgactctggaggcggtggcgacgtcggcggtggggaaggagtcaggggcgaggtggctgggtgttcggcaaccaaggctgtggtggtggtgaccgtgtatacggtcaccggaggcatggcggtctcggttgactagccaagggcgtgggagacggctgcagctggccggcgcggcatcgttcggtggaggggtcggaaaccggcttggcacaaagaagcgcagccgatggcagcagaggccggctcggcgcgagatgcgcgagcggcggaaatggaggccggcttggcgcgagaggcgcggccgatggagggaggctggattgacacgagaggcgcggccggtggagaaggccggcttggcgcagagaggcggggccggcggtggaggaggcgacctaggtgtgaggaggagctgccggtgggtgtggcgcggtctttggcgcaagaaggctggccggcgggggacgccggtgaaggggtcccacatgtcagcaaagcttgtggagtggtggagcatcggtgcgccagccgtgcctttgttggtctagtggcggtcggccacgcttagcggcggccgatccggtactagccttctcctgggcttgtgtattggcgatatcgtcgtgtgggtggtggtattttttttcttttcctggttacgattctccagggttgtaatcttttattttttttcctgctctgttaatagaacttcgtaccgtctcgtgcgagtcgttcaaaaaaaaaagtccctggcagtttgatgtctggtccagagatgttcatccattgcagcttcgtgcactgcacgaaacatgaaattgatcgatgcatgtatataagagtgggaaaaaaggttgtttggaatcttccattccttatttctcgcttcgcttctctactcctacgtgaatctaaaaaccaatttattttggaattggacggactagatgtgtgtgtaaaaaatcgttaacttaccatttcttaggtgttcatttttgtctaaaattacaaatgcaaatacgtttggtccctgtttgacttatatttgacccgttgactactcggcctatgtattttcttttctcattttaattgtaataacaaagagcaaaacattttttcttactatttaaattcgtccaaaaaagcctatttccagaaaaagctttccatcaatagtagaagccccctaaaacttgaaggagaaggtggaaaataaaagatgaaactaacatgttgtgggagcaagagacgatcgcagccgtccatccgggaaccgcgccgatctccagccgtcgatcgggctccacgaccgtttccccccacgccgcccgggcccaccacccccgtcctccttccgttccccgtttcctccctttctctcccggtctcccctcacctctttattacgctctctcctcctccccgacgacgaggcaacccagcgcgaggcgagccgcggcgactagggtttcgtcgcgccttcctcctccttctcctcctcccccaccgccgccggcgacgacaaggtatgcccgcaagcgcgcctctctctctctgtcccacttaggatcccccgcgggtgtctcctgctacgtggcggtgttggatggccgggtggtgtccccgatgctctggatttcgtgcgaatcctagctagtaatattagaggtttttttttttgttattgttggtgatgatgctcatatgctgtagaggggggttggggtgtgctccatgcttcgcggattgctggctctggatgcttcctttttttttcgtgtgtaatgcatcgtttgcttagttgatcgagttgtggtgtgccctgtcgccagacattgccctaatttctcagcccggctgtatgataaatctgaaatgaaggtgtctaatatgtaggggtgtcaccaggaagtgaactcctcgttttgttcaagttgcattatatattttggaaccttatggtagctctatttttgtgctggagtgggctgcaggaa

SEQ ID NO: 56628 - DNA, 806 bp, Oryza sativa
ttgttccctaattgttgaccctttttttttcatctgaattatagattgcactgttctggaactaaaattgatgtggactgtggggtcatctttactaagtgctaatcatactaaaatgttttataatcccaattccaagatttagttttctggatggcaacttttttttgatcaagcagtatgagatcagtttttggttgttgcaatactttgtctaggacctgatacacttgagacatagtactgtggcaaacttttatatggtggtctgtgactttgtgtgctgtaacttatacagaaaaccaactattatgtgacagaagaaaaggacaaggagatatctcagctagttatttctcattagttgataatatttttgtactgcctttttggttgactgatcctcatagtaggtatgttgtatggaacaagttaatttctcagcagaatttggtagacatgaaatgatgaatgctcacaatttgtacacatttttaccaagatttctttgcacatttgaaaggtctactggagcgcaaacaatggagcggtcttctcagttgaatccaaatgccactccctttgtgcctcccccaaggtcttcgtttgaagaaagcttgagcggaaggaaggcctctgagaagcaagtaggtgattcagaaaaggatgagactgctgacaagtcttctgaatatgagctcccagattccctttctttggacgactatggtgaaagcctaggaaagctcaacatttctgcagaatcttcatcaaaaggagctgctagtaccgcgcttgatccatcg

SEQ ID NO: 56629 - DNA, 6818 bp, Oryza sativa
  unsure (1)..(6818): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcatccacacgagcagcgacagggagaggagtaaggggctcacctgatgtctgcactgggaggaaggaaggcggcgccggggaagtcagtggcggccgcggatgcgtctacaagtggctgctccggcagatccgatgtgaggcggcggcggtgtctacagcgagagccgagaggaggcggcgacgcgggcggatgcggtggaaggcagcggcgcaggaggatgcggtgggaggcgccgtcgccggtggatgcggtgggaggcgccggctcgcgacgggacaaggagagcggcgcgggaggcaccgacgcgcgacggggagagacggcgcctgcgcctctcgggtggagcgtggtggatttccaccggtctgggtggtggatcaatatccctagggtttggggggtaatgggccgggattcccaccttcccggaccgaaccgaatgcgatttttgtcagcacagggattttttccccgcgtggtgggcttccccgaaggggccggggatctcggccttttacactcgaaccgaacgaggcctaagagaaagggctaggatacgcactcctgaggaggcggaggttgccatcgtaggcggcctggaggagcaccttctccttctcttgcttccccatcatccccttctcctcctccatggagagagagaggatcgatcgggctcgctcgggggtggagaaggcgagagagcggtagcggcaggcagtgtgctactcgctactagtagaagcctaggccctaggcattagcccttgactggaggtgacgtaggggcggaagagaagaagacgaacgatgcggagtgagttttgtagagactgcggagttggtggggaaggcagcgatagttaggtcgtggatactggatagatgatggttaaccaaggttaacactcaatttctccctttttaacgatggttaagttggaggttggtgttgggaaccatcccatacatggaaaacggagcggtttattaacgtatgatcaattaagtattagctatttttttaaaaaaaaatacacagtttagcagtttgaaaagcgtgcacgtgaaaaacgagaggggagtgttgggaacttgctcttgcaaaacacaccaatttgcacaataatctaaactcaaacagtttttttaaataagatatatattatattttttaatattggcagtttacacgcgcagtttctcacgattttaaggctgtgttcagcactctgtttttccaactcatctctcttttattccgcgcgcatgctttttaaactattaaaaggaatattttgttgcaaaaagtttctatacgaaagttgctttaaaaatcatattgatccattttttttaaaaaatagctaatacttaattaatcacgcgctaatagaccactccgtttcccgtgcaccagtagatttgttcctaacgaactcagcctaaggcgctttaaaatgcatataagaaaaacatatgaatagaaaaaaaaagtaaagtccactggcggttactaaacttacgtggttatgtcatctacctctctatacccttgaaatgtatttacggatccccaaatttatgttgattattatataggtccaaacggaaaccaatccactctaaatgctgacgtgacaatgtcacaattggggccgacctgcaagtgggaatgacatatcagtcatataaaaaagataaaattaaaaaaaaggagataatatgtttttaattttattttttccctatgactgatacgtgggtcccactacacatatgcaccacggtggcatgccttgtcaatgtatgaatcgggttagagtctgtttggagctgtaggacaaccaaaaaaaagtttgggatctaaaaatatattttaagagtttaatgacacagatgatacaactgcacaaagtttaagaagcacttgcgtactcactctagaaaaaaaacatagaaattaacgtagtactagatgtgtgaaaatagatatggaaagagaagccatttaattacactatataaacaatataactaaggcgtaacgccgtgcttatttttctatatatctgtccaagaggtttgaccataggaatacaatcctataaaaaaaacagatcttccccctgtgaattgaaaaggacctataggaaattgaatccttccttcttctttttttaaattacacggtacaacgcatacactcacaacgcgcacacacactcacccctatgaacgcacgcacgcaaaccctacccttatgagcagcttcgaagattgggccagcaaatcaatctggagattgacgacgtgtcacgccctgaagttcccctaccttgctttaaattcataaaataaatcgtccaaagaaatgatttaatttaacctagagatgaatccctaaattaataaatgtaaataataattggaatcggcatgtggaatttttcttggattctacatgtcaaaatatgctaacaggatttttagtggaattttcagagctcaataaataattttaaccaattaaaaactttaaaccacaataaataatcccaggaaaatcctttttctttttcctcctttttcttttccttctttttctcttttgggccgccagcccaactcgcctcccgtgcctccctccttaccgggccggcccaatacttctcccctcccccgaagtgctaccttcctccccctctccccctgggcgccgacaggtggggcccacctgtcgggttcacccctaacctccagccgccgtgccctatgcaaaccgccgcccacgccgccgcttcccctgctcctcccgtgccccactccgcctgtgctccgcgtccctatcgcccgcccactctcccaccactcccgcacgcgcacacacccgcttggagatgggattcatttcgaatcctcccccctctctctctccacctcccacgctgccggccaaatcggccaccttctcggcctcgtccgcctcccccttcgcctataaaacattcccccgagccccctctctctttttccccactcgccgtgctctctcgtgcctcctacctccatcgcgccgctcgccactagcaccgccgcttgcctacgcctccggccatgcgccgccgccgctgcgccacgccgtcgccgctgctagcttcgccgtcatgggagctatcccggccgccgctcggttgcccctaccgccgtcgcaccgctctccccacgccaagccacgcgccgccgcccattgttgcctccatccgtcgctagccgccgctagggccatcgtcgagccactccgtcatcgtcgtcggcctcgcgacgtcgagagccgcctcgtccaccccgcgcaccccgccatccgccgcttgccgccgccgtccgccgtcgtcttcacccacgccggccgaatccccggtgaggcctccctccccctctttttctcccttcctctccctcctagcgccgggctgcgccgtgcgtcgccgcccttcgcgccggtcgccgctgcctttcgcaccgcccgccgccgcctctcgccgccgattgtcgtcgcagacgacgcgctcgcgcagccgccctcaccataaccggccggccgccttgaagccgagccgagccaggccgccttcctcctcccctttgagccaccgtctgctgggacccacccgctaggccacctcctcctcctcttgtgccgctgacatgcggggcccgcttgtcggcgccgccccccttgctgatgtcatccggggttatttattgcgcaataaatctattaaggtcttttctttattagtaaaaacacagataatcttctaaaattcatatctaatccatccaagctccgtttaagtccattcaagtctcagtaaatttataaaaatgcatagaatccattaaaaatggttttgtttcctgtttcagtagtcttatagcatgttttccttgtgtgctttgtttgtcgcgtagatttcggccgcttcgtcgatccgcggtttctcgaagacgttgctgtggtctcatcagtgtgagagcaaggcaagtcatgcattacgattgatcatattatacccaatttacaaatgtcctgtatttctattaaatgttgcatcgttttacaatatcatgtgggatgggcccaactactcagccatatattgtttaccttatgttattgataacttgggtatccaaatgattagatgttggcttaggaaatgcttagccatgcttagttcaactagtacacaaaaggggaatcacattaatgcatagactttgattattggcatagctttggattagtgccactgcaatggtgttagttaattaaaatacactacatggtgggctgtgggtgcatggttctgctagtcgtgcccatggcaattaaggatcggttcgcgggatgccctagaagaacttatcgtacttaccacaagccagcgtgggcaacggctgggcttgtagtgtagtgtagctttcctctagccgacgtacccaggcgagggtgggcgtgatggagttgggtcggccgaggtgtccggttgatcggcttctggattcaccgcggcatgaaaggggggctgcccgttgcctgctgatgacgggggcgaaccctaaggtgtggtgcgatcggttagagggggttatgcgaaggatcctgtcacggcctctttccggtatgtcgtggtggcatgtcggcgcacggtaacgtgtcgtggggctgtgtcttgtgggtacagttgtacacctctgatcagagtaaaactattcgaatagtcgtgcccgcggttatgggcgatcgaccagattcatcgtgattagtctcacccctagtttagcttaatgaactggtatagttcaggtggttggttgggcctgttgcaacctggtgtagcattggacagtgattggttaatattgattaattgctacaactgttttactgctttcaactactgcttttaaatgctagctttatgcaaatgaacctctagcctcctttggttataccctgcatcatacattctcttccggtatgacttgctgagtacagtgggtagtactcagtcttgctctcttttcccccaccccagagttgaagttcttctcagttggagatgtctcgaagaagttggttttgtcactgccgtcaaggatgcctgtggaatagagtcacctcattgcaggagtcaagtcttcaggcttagctcgcttttgtcttttccgctgcatttgtaatcttttatatttttgtaagacgtggatctgtatgtcaacaattgccgtttgtgtaccctggctggtcctggacagggatttaatgcacattcagcttagaaattctggttcgtgaatttctaggcgtgacacgacgtcaccagtcgaacccaggacctatgatggtactgaggctcttgtaactagtaaactataggccctttcgcaattgaatccttcctttgccagtcctctatttcaaaatggacctaagagcaacaccaagagattggctaaatctcatccctaaaattttggtttttttcaaattctaaacataatttgatgcgtgaaaaaaaaaaatatccctccaagaggttgccaaaaattgactccctaaaatagaaaacgttggcctcatgtgaaactaaccataaaaatcaatttattcctcttcctcctgcatgattgtcgggtacaagacttgagcggcaagagcacgcaattggaagcggatcaggaaggcccgcttgtacgttcctcacaaagcgaaaactaaagggatgggaactccaaacttttggcagtaaaatgagaaaatgctaggtgataccccgcgctttgctgcgggatttatggatgagtatatgttaaatattgttgaaatgatgaaagttgaaatgttgagaaaataatgtgagaaagatgatttgacacattcttgttgatgatgtatcatgtttacatgggatttaaaataggctagaatataatttttttaaaaaaaggctagaatagtaattgctagtgagtgaagatgtggcatgcttgcatgggattttaaatgggctagaatagtaattgctagtgggtgatgatgtggcatgcttgcatgttgagctttagcttctaataattgttagtgggtaccaactatatagaaagtatagattggagttggttttttgctagtaatcccaataagaacggggtaggggcactactagacatgctctaaggagagttatctaaccgacctcttctcctcacgtcattggcagcacacaatcatcttctactcaaaccaaaagagtagaagtacatggacagtccttcaacttatatgggtgtgtcgtatagatccctaatctctcaaaatgtacacctaggtccagaaaacttatcaaattgtgtcattccggtattaaattgccacggtccctctgggatcctacgtggcattccatatagacattgacatca

SEQ ID NO: 56630 - DNA, 9300 bp, Oryza sativa
tacgttagtcccccgtaggatctcagagggactgtggcaatttgggatcgaaataacatacttcgacaaattctagaacttcaatctgcattttgatagtttagggacctactccctccatcatattataagtcgtttgatttttttcttaatcagacttctttaggtttgaccaaaatataataacattttcaatacaaacaacattatatcaaaatatatttaatgttaaatttaatggaactagtttggtgtcctagctagatgttgataatttgtttttctgataatagattgaagcggttctagagtactggttgttacagtgcactctcatcgccccacactctgttgcgggatatatattagatattggaaaaacaaagaaatgatttggattgaaatattatgaaaatgatttgagaatgatgatttagcatgtatgtgttcagttttagaatgaaataaattgtagacaattactatatatttgcatgttgaactttatgtgattaatgggttgatgtgacatgcttgtagattttaggagtgctaataaatattagagagaatctcttatatgccactctaaattaaccggctcccttatatgccacttcaaattggcttctcccttttataccaccggttcaagtttctcctcctttttatgccattgccgtcagttgaccgttaacttcattgtaaaaagattaatatagctactggatacaacatatgaaaattgattttttctacatcacatgcaattttagccattaccatcacaaataaattttcaatataagcatgaaacatgcagttttccaacaatatttttaatataaagagcatttttcgctggttctgataaaattttgttcactcaaaaaggatttaaaataaattagttatgattttttgaagtttacacgttttttagttgagagggcatattggtcatttatgaaaaaaaaactaacctttaactaacagtcaactaacactatagtagtgggagtggcataaaagggtggaaaaacttaaactagtggcatataaggaagaagccaattttgagtggcatataagggaactggtcaaattctagtggcatataagggattctctctaaatattatgtttgcatgttgagttttaggtgtttaatgaacattagctctataaaaaaaagaggttccctcccaatttttttttctgagcacatgcagcccttcctatgagcacgcaatgttcagaattccatttctaaacatgaacaaaaggaacacgtcaatccttgacatataaaatagcaaatggattttttcatgaaaaaaacattttgcagccttgtttatagcaagaacgagcataattagcagcatagtggcataaactcacctatttaaagctaatagcacttgtttaggtcccttagcttgctatgtttagattatactaagactagtaatcgtgcacgtgcaatgcacgttttcgacatataaaaacactaaaatattattgcattttcctgtaatgtcacccaaaacacacaaacatatttttaagaaccggtgattgaaaaggggcacacttggtgcggcgagggaatttgtgattgggaactcatgatcccaacatattcaccctggtaaaatttcactaaatattcttttgagctattttaaaaacaaaattattgtttgttctttgtatgtctctaccctgcgacaatcagtcgttaagatcatttgaaaattggatgggctgaatagtcgagctgtttgagcatgacacaagcatacaactccaaggtagtataacagggaattgatctaatcatactgaaaggctccgtgctcgttagaaatatgaagtccaacagataaaaatgtaatatatgaccaatcacagatatatattttttaatttttttgaaccttttcatttttagttttaaaaataaaccttcccaaaacttatttttgaatatgaatattttttccatgagcaagtgcggatggtgtgactattgtttagccaagcgaggcgaggcggagtgggcaagaaggttcaggtttagaaataagtatcgagatggtttatttttaaatttaaaatccgccgctcactaccgggctgccacctctcatggccatccctctgagcccggccacctcccccttcttcccctcccacctccaccccaccccaccccgggaccctaattcgccggcgccggagaagaagaggaggttaccggagttggagaagaagcacatggagcacgaatcgcgaagcacatccggtgatttaaaatttgcaagatttgggtatgcattttctgtcgatagatgcttagcaattccgtataaattatatcaacagaacgtgttgtcgaagcctaacagggccatggaacaaacttgctccaaactaaaacacggtacaactcactgatgttttaaaacataccagcttccttccaaatggagattccatccttgatgtcagcaaatagttgggctgctgtgcttctcttctgatcaaagattcttgcagtacgttcccttccaaatgagccaatagaccaacataaacaaagtatcaaacggcttcctatagcaaattaagagggaattgaatactttgcttcagataagaccaatgatgtcattctaccactcaggattccgagtgaattttaccgatctacaaaacaaatttttagaataatttatgaattatatcaaacatcatttcagttttgtggtaagaaaattatgcataatctagaatctttgttatacctcaccattaaaaattcattctttctgatctatagggaagaacattttcaattgctgtagttgaatcttgaatcatgtacaaaggtaaatcagattgacatctgcatatgtaattcatttaaatcagagtgcaaatgaaataaaaccgcaggaaacttgggatagatttgttgccacagtgtctgcacatacaacattaaaaccattcgattctgcatcagtaaaaatatgcaacacatgcaatcaaatttgggaagcaaagagttgcacaggtggatttgcagataatggatggacaaaatgtttacctgctactcagtcataagcttgtggaatcagcgagttgcatggcaccttgagaccaggtctgtgttagcagaccgattactcctgtagttcaggttgaacagagaacaccaccaaaggcagccgcatcgacagtgttacctgctgcacatcttggaaaaccaaatttacggtcatcaaatggcacatgaaaatatgatggcaagagctccctcacatggctatattcggtgtatcatggcagtgaacttgattcttgaaaagtcattgtttttaatggtatgaaattaggagataactcagaaagaattttaatgttaccaaattaagatatgattcatacaagagaagtgtttctatgctcctcaataaaaaaaacctgcacaaaaattaaagcacatcaatggtctggattaaaaagcgattaacagggtaaacctcatcagcgaggggcaatttcgtcccggacgcaaaagttcatatccatacccaccccatacccagccatctctcatcgatcgattcgcaacggcaattccctcgcgacgcacctggaatgatattcagataatatctgcatcatctatgtcaagcggccaaaaggattagcttttgtaaaggacgaaaatcactgaatcaaaaaacaggagaatcgttgggatttctatctaggtttcactaggtacaagaagcgggtattctaccatgcaggagtttgagtcatcatggatggccgccgccgtagaggatgcggccattctccatctggtctgccgcttccacaccacactgcccttcgagaactggtcctatatctcgtcatactgtataatctgtctcaacgccgagcgcaacgacaacaagtcgacaatagccctcacagctcgtcgccctcccattcctcgcacatgcccggccgatctggtgatcttcaccatctagccctgttgccgtgtcgacctcccagatcgatggatcgatcggcctgggctgcatgtgggctttcacttcctggtcgaaattgccccttgctaatgacggtttaccctagtaatcaccttttaatccgaaccattgatgtgctttaatttccgtgcaggttttttttcaaggagcatagaagcacttctcaaaaggatgacactgcaaaaaaaaacataaatcacgccagcttacctagtagtgtagcctggcaacttttagttgcatacaaacacaactgaaaacctacccaagtcacatcatcttgattttagctgctacaagtaatatcacgtaagaataataaaacaggagaaattagaaaacattaaatttggcttgatgaagctatactccgcaacagaaaatcacacaggaatcgacatgaggaaccgacacaagatctgagtatatttcatacagaaaattgaagggggattggcaagcaattcaacaccctgaaacaactcgtctccataccgatggatgttgttttggacttctggtataaaatctataacatccaaaacaaaattagttagtactcctcagtgttaaccaaggggagagaggaacaagcgacaatagagagagcaccgggttgtgtggtagagtagaaggaggtgagcggcaagagatgatggggatggaggggatcggcgaagggattggcacagcagcagatgaggaggacgtcggcgccggtggcggcggaaagtcagctccggccgtggcggatggggccgaggtcggaactggctgcggcggggaagaagcagcggctccggcggcggggatgcgacggcagtccacgcggggaagaagcaccggctccggcggcagggaagaatcagcagctctagcggcggcagtccacgcggggaggatctctagcgaggatgcggcggcacggcggcagaacatgcggggaggaggaggagcgagcgaggaggagaagcgaagtcttcgcgtgtggagcgatgtcttcgtggctggaggaggaggagcgaagtattcggcgcggatggacggtgcagattaatccggatgatttcacctgtaggattggaggggggacaactcctcctttttatattagtatagaagtatagatatagaaatataggtgcaacgatgattcgaaaaagcaaaatatgccgatacgaagttaaattagctaccaacactaaatatgtaactaatatgctaaataaatgccatgtacatagttgaaaaatatttaatatgcaaaatcacttggttttttttaatttcttttttcctcttgtttttttccctatgatacatggaaggactacatatgtacaaacatgatatcatgtttaaggtcttgtttgaataatttaaaagttcaagtatagaacaaaacttaccgtggctatatattctatttcttcctactgcattcatcccaaaatattgctatttaatatgtgattaaacactttatagcatggagtaataattttggacagctaagagcgagtttaatagtatagccaactattggctccaatttatctatagccaatctaatagcttattcatacaatagttatgtcaatgggtgatacccgtagaccagatgagtagagtactagggtacgttggtacgaggatctacacgatacgacatcaagcaagaaaaaatacaaggattatattggttcaagccccttatcagctaatagctagtccagtttatatgggattaatatggaaaaccacataatacaataggagtaggcaaattcggctgtaccgacgagatcgtagtcgatggattcgacgagattttctggtgacttggcttcacgtgctccggctttgtaggctatggtcgatgtgttggtggtgaaattcgatacccgaaacccctcccgaggtgtcccttttacaccgtgaatcatttccatgtagaacttgaaaatatcggaccccgtacgatatagaagacaccttacctcctccgagtgggactttgttagtctcccgactcgtaaggatactttccataatatttgttgaattaccttagcgtatatggaagcaacctgtgtacgcaaaggtatatcatattcgtatattctataagtcataggatagaagatataccttctccgtaaccataacgagttacctataaacatatattacaccattaatatttggtctcatctctcatacacacaatatattggagtccgtgctgcagttttccttctctctcttctcttctctatttcacatgtgcttacagctaagagcaggtacaatagcaggctataagccagctgcaaatatattttaaggagataaatgaggtgagagaagagcaacgggctatagatttgtagcaagctgtagcacggactttaagacactgtgtgtatgataggtgggaccagatattaatagtgtagtatgtaactattgtatgaatgagctactagattggctatagatgaactggagctagtagttggctatactattaaacttaaacttgctctagtattttgggcgaaggaaggaaaagaaagcaccgtatgacgtggaaggatgggcccggggtcagcggcgtcatctccgtcgcaacagaatcaacgcgatcgcccccgctcaggccgctcgtcttctctacttgcaggctgcaggctgctactactacttcacttcggtatggagtctggagtctggacgtttcgccttctccgcgccgcccgctcgatcgatcgccatggaggagaaggggatggggaagcagcggtgggagaagatgctcctccaggccgccttcgacggcaaccttcgcctcctcaggagtcagtacccacccaaccctctctctccctcctagggtttcccccattaattcctattttcttcccccttcttatcgctgggcgtagagatggcgcgcgggctggtcacgacggggcgcggccgcggcgaggcggacgtcctggcggccgtggcggacggcggcagcgggagccgcgcgctgcacctggcggccaccgaggggaggatggacgtcctcacgtacctcgtcgaggacctccgcctcgacgtcaaccaaaccaacgacagaggttctgatctctgatccccttccattcgctctaatgtacgaatcgttcacttatcctggatgctcctacccggggaaacggaagagatcgatatgcgtgtccatatagtttaatattcctcacctgcgacagttggtttcatgctggttacgtactatatgagcttgtggtgttatttgcacgcttgtgcaacttttgatgctgtgcaatgcaatgtatgcattttaaatttatacttcaggttctagcttgaattgctgcggaatatcaaatgattattactatatcaactataccagtgcctcccccattgtgtttatatctagagctggacccaaatttatatatatcctaatggaatttgaatttgattccaaacaataataccaatgcattctatcgggttgtgctttttcaaaaaggggtcatgttcattttctatgtgcatcaaatccatattttaatatgagatcacacaccaatccactgtgcttttatactattaaagacgagacgatatttaatttagcagaatgattttatcaagaaagaaaggtcccaccaaacaattaccaaaggaactgactcttgggcagcggcgatggtttctattattatattctgactaagaattgaactggaatttccaatctgattcttgctgtcctcgaaactcccatgtcataggaattgaattccaattccatgattctagagcaaattcatgggtgccaaacggggtgcaatatcattaattatggccaatgtcattggcatataaatgttttttttcccgtattttattgcacaaaatttctgcattactagttggacactttagttcttttcaaatcagtggtattacattaggatcactgaagataaatccacatttttgttgttttaacagcaataactgcagatatattttaccttgtggagcaggagcctttgtagtttgcattgttgaaggcaagaatggtatatgaccatatgagttccctaagctcttaatattcactaccttttcttatcaggtgaaactccactattcctttctgcgttttttgggagaactgcatctacaagatatctgcttgatcatggtgctgatccaatgattgttggtaaatcaggatcacctcttcatgcggctgccgggaaaggtatctctctcacactacgcatgttttgaaaaatatgtttgatatatatgtgtaaatactttgtcactttagattaaccatcggttaatttgttctattatctactctattagttttcctgagcagggccagggattgcaatttatttctgaaatttcgtccccccccagccgcaagcacatatcttgcctgaaattttcggcattttgcaatttttttgtgaatttggtcaatttattcaaattcattcaaattttgtcaaattttctaataattccggccaaaaaaattcggtacttattctagtaaatcacaaaaatttgtcaacactaggaaattttctaataatttcgtgaatttcagaccgacacccccccccccccccggtgcgcttgcgcgtgctcggcaaaaaacatttcgaaactgaaaatcctcagcaaggctccagaatttgcaccgtttcagtcaaaatttgagcaagtatttgaacataataaatgctgcaggctgtcaattctagcgttaaagacataattagttgagcagcagccaaatgaaactggagaatgctatctttctttttttgtcctgagaactcaatggaaggtcgagatgacccaacttagtttatatgtacttctaaagaggtagcactacggagacaaaagcccaagaccggacgagattacaacttaaaagagatggggaagtgaaataagtacaataaagttatgttacaatctggtgtcataacttaatgaagttatgcagatctccaatggcacatactgatgtgccaataactcaatcctttgccaatgatttaaaaatcaactcacacattatacaatccagaaaacatcttttatggtaaagggtaggggactgtcgagcaccaaacaccaaccccttttttca

SEQ ID NO: 56631 - DNA, 782 bp, Oryza sativa
tggacattttctctggatagcatctgaaacacaaactgaactgatcaaataataattcatttatacaggctggggctgatgtgaactttagagactccaatggtgctacttatgttatgatggcagcaaattatggtttttctggcatcatgaaatgcctattagatgctggtgctaatcctaatattccggaccaagtgagttatactatttccttcatttttcagttgccatgagctattaatgcgagattggacatttcttagcaaaatccaaatactgacgggaatcaactgaaaatcttatcggcactcactgggtcctcagtagtctccagtctgttcctccatcccaccaaaccaaggttattagactaggcgtccagtattccactccaccagaccagccccaatccctcatgtttcgcatccccgtgcctcaggacattgaggttatgaagaggtgaggttcaaggcctgaggagaagcaacttgagtttgctgcatccctggccaaaatgcctcaaggatcccatttaaattcccaaggcttatggttctcgtagtaggggtctgttgatatgaattgatgtgtgccttgtgtggtgcatgtggttctatacagtaatttgtcctaaaaaagaaagactaccagattgaaacaccccgagaatttcggtgcataaattcctgaaaaagactaacaaaattattttggtaaattcggtgtggcttctatttttctaactgatttttttgttggcaatgttggtgttgtcgatt

SEQ ID NO: 56632 - DNA, 715 bp, Oryza sativa
ctaagatagttgtttcttcacatgctcctattgattctatgatgacggatgcaccgggacagctattacatatggacactgttggtccagctagagtgcaatccgttggaggaaagttgtatgtgttggttattgttgacgatttttctcgatattcttgggttttcttcatggcaactaaggatgagacttttcaatattttcatgatttgtatcttcgattggatcttgaatttcctggttctttgaaaagaattcgaagtgataatggtggtgggtttaagaatgcttcatttgaacaattttgcaacgaaaaaggtcttgaacatgatttttcttctcctcgtgttccgcaacaaaacggtgttgttgaaagaaagaatcgatctttggttgagatggctagaacgatcttggatgagtatcatactcctagaaaattttgggctgaggcggttaacacttcttgaggtcaaaacttggaaaaacttatgaacttcgatttggacgtcaacctaaagtttcacatttgcgtatttttggttgcaagtgctttgtcttgaaatctagaaatttggataagtttgaggcacgctctaccgatggaatgtttcttggttacgctgcacattcacgtggctatcgtgtacttgttttggaaactaacaaaatagttgagacttgcttttgatgaggctagtccaggtactatacc

SEQ ID NO: 56633 - DNA, 1574 bp, Oryza sativa
ataatgaggtatttgaatcatatacttgagtttggaatttgatattctacttcatcttctatatgcttgagtggatattccgacgctgattttgctggttgtagaattgataggaaaagtagtagtggaacatgttattttcttgttacatcattgattgcatggtcttctagaaaacaatctactgttgctcaatcaatgctgagtctgaatatgttgctgctgctagttgttgttctcgatcagattctttgacttatatcaactttgaaagattatggtcttacttttgagaaagtacctcttttttgtgataatactagtgctactaacattgctaagaatcatgtacaacactcatgcacaaagcacattgatattcactttcactttttgagggatcatgttgagaaaggagatgttgaattgacgtttttggacacaaagttgcaacttgctgatattttcactaaaccattggattcttctcgctttgcttttcttcgtggagaattgggaataattcattcttttggcatggtttgagggggagttttgtacatcatggttttatcaatcaaaatttgacaataagaaatattgagaacaaagagctttgctttatacatatggtattttcttgtgcatgctagcaatactatgaaggtttatttgtgtctagcatagcttgtatgtattttagtctttttataaggcctagatattgtttttaagggagatgatgcatgacacttaaattctataacttgaattaagaaaatatgcaatattgatgctagcatatggtttgatttataaatgcttatatatgtgctttattgaattgttattcctcaaatagctttgtaatgtctcattgtgcaagcgaataaaattatctatgagagaaaaaatgaatacgaatccttagaaacagtcttgacgacaaggacgtattcgatgtgagcaaaaataatgggtgccgaatccttggaaacagtcttgatgacaaggacgtacccggaataattgagagaaaaatatgagcaaaaatgctaaaataaaagttataaattctcttggttgttttgtgctagagctaatttaagaaagagtgataattgcaataggtatatatgtgtagtgtttatttttcaacctatgtgcttctaaagatgttgcattataaatcgtatgaaatcatgaattttgattgttgatttgaacttagttgtaaaatctttggttcatgattatactttaatgcatgcttgctatattatggatgggttcatcttctttttattgcaacacatgacttgatatgctatatgtatgctaagctcttgaacataaatgaacataattcttatgcttcatgaaatcattgtcaaaagggggagaagagaagagattgtgcatgtttttcaagtcaagggataatttctttgttttcaaaagtgagagaagttttcttttgaattttgagcatggagtacacagtgtgttttttgctttttaccacttttgtttttatttttccaaacaacaaaacatatttgatgggtttgcca

SEQ ID NO: 56634 - DNA, 5561 bp, Oryza sativa
agcgtcgaagattgaggagaaaaccatatgggcgaaagccacaaggcgaaagccgtggcttggaatgtgccaacttcaccaagcgaagaccttgtccagagggccgcgcgagcgaagatgatgaggcgaaagcctcggcacaaaggcacgggtttcgccaaagtaccgaacctcaccgtcaggaggcccagcgggctacttacgccttcgggggatttcggcaaatagatgggccaagccatttaagcccaataggggcccatacatgtaaaggacacagtgtgccctcaataatgtccctatcataaaggtaaccatgtaaattcacttgtaaagtctaaatcctaatagggggaacctgtaatagggctataaatagccccctagggccagataatagggtgatccaaaaatttttcactaagcaatactattgtctttcttttccaactatcaatggatgtttcatgtttatggcttctagatggatactatgcgtatactatttttcactaagcagtactattgttgagagaaccacgcctttcgacgtgaagcggttgtctatttgacaacagatatccatagatgattcatgtttatggcttctagatggatactatgcgtatgtaatactgttgtttgctaacaatgagtcaagttggagatagcttgatctcggaatatggtttctttgtttgattcatgtgtaggtgtcttgatgcctcgggagagtactgccggtgatggatcgagagtcgacttggagataaggcgatatccggacggtcatatatcatacgagatacttaggctaaagatcaatgcacgtggttggtgaagattccatatggcatacgatggagatattgtgtgcgtatgggatgcgaagtcgaatttggaaggagtccaaatttggtatgattggagtttgtaaagttggtttcttgtacagaaaggtttcctaggaggattaggacttcttgtatgagtttggttcatggttttaggctgcctacctcatttataaatagagagggagggtgtggcctcccggtatcgcttttgagagcattgagttgagggttgagtttgggtttcgagtttagtcgagattttcgtgaggagtgctgttgttgcactttgtaaacacagagataagtaataaagttgtcatctacatcaagagttcttcgatttgtgtttgcttgggtttggcggtctaaccgacgagacactggcggtcagaccgatggcatcgcggtggtcagaccggcggagtagcagcggtcagactggcggcggcttcaggcgacgacagctgatctcggcggtcagaccaaagatacaatatcggtcagaccgatggctttcaggcggtcagaccggtgcaactacttcggtcagaccgcgatccgtcgaaattgagggtaacttttatttccggtaaaagttttggtttttgggtacaccaaccattcacccccctctggttggctaagttcttgctattcgatcctacaattttaagcaattacacttatagaaacttagtctaagatggccggaccgatgaatacaatgcgcgcaacacagttttcactgaccagtaggcattttctctatagtgtatgtttccagactcagtattattaatgaatcattcagacttattatattaagtgatttggtacaattcagatatgttctcagactagctgggaaatgttatcagtaatcagttggatatgtattatttatcgattatcgctgctgcatataacaaaatatttccaacaaattacataactttcacgcaattgagaactatgaacaattcactatcgtgtttcatctacaaaaaagttacaatttagctgagccttcctatttttctatgagtacacacttggacatttgcacatctgaaataggtgggaagctagtgaaatatcatcttcactttataatttgccttcctagcagttctgttcgcttgaatgggaagatcacttggtgggggaagcatgaatgtactccagttccgtaaaataaccagtctgcaggaacatgtcaaaatcattgatattttaaattaggggatgacttattgctctaatgatatccactgaacaaataagctggaaaacatgcatgataatttcatgcagatcatcttttttacgtagagggacgctagctattcaggatctaaaagttctatgttacttggcagctcaagttacattaataaaaacaaaacaagacttaaagaaacctaataagtatatgtgtgtgaaaaatatgagagctttcagcggtgtgttttgaaaaatattaatatatcatactgacatcaattttgccacaattgcacttctagtagcaacatgggtggtaatcatattattgtatcacctccaattactgaaaggtgctattttggagatacgtctagtttaaatttcaaaatttaagcatcaggaacttttaaaagtattgagatcagatgtatgaaaattatattggttgatttgtcttttgaaactaaatcataatattatagtttatttgttttacaaataagagtttgtggtgaaaactatacttcaggcagtaccattgtacaaaatggctcgttttcatgcacagagggatttatatttttttcttttcttagttttttgttttttagaattgtaagtactagtttatactacatgttttaggttttagcacctctgcagggccactgttctttactaagatataaattggccctgccctgcttttggttgatacggtataaggatcagagtaagtctatgtactgtactgattgcaatgtaatataagtggataaagattaaaagaaaaactcaaaacccaatttcctgttgctttggatgcatgcataccacacagggtaaaagttaactcactttgcagaatcacatgaaataaatactttttcgtaaaggatcagattacctttttcagaaagaaataagtctcaactttcctatccatgtttacagcatccaagtcctatgtcagatatacaacctcaagtgtaatgtatgtgctctaatatattatgcagctttgaaggccttcttcgaaataaaggttctaaacggaaagaagaaccaccattttttaacttcttagcgtcatacatttcattccatgcttgaactatctcgtcaatcttgaagctcaatcctgcagaacaaagaaaatgtatcagctatccatgtaccaaccttatagctagttacagaatgttaatctgaaactcacatgtttgttttactaattgtatgatataacctgactacaaattgtccaagaagtcccagtttctcaaccataaatagtttatcaggttatgctagtgaaccctgatatctaacaatgcaatgttgtaccgcgtggtttgcacacatagttcaccttatgttattgaaattgattgttcttggctagaggtaaactacaattgttcttggctagaggtaaactacaacctggatagataaatcttatgcatttgtgtctcagtaatggattcttgatagattacattagccttgtaaccctgctcggtaagtcttccacctgtgaagaatccaattgcagggaaatcaggtggaaacaactttgcttcttctttttttcgcagggctggcgaaagccagccgaagtttattaagaagagggggaaacaaagtatacaaaggttacagagaactttgcttcttcactcattcacatttttacttactcataaactgctgcagtcgtagaagcccagtgtttgtaacaacttgtaattttaataagaaacaagtcgaacaatacaaacaggtcagttgtttttcatctaccatgacaattatgcatgcaccaatttttcttactcactagctattccaaaacaaaaccgtttagtatcgacccaaagtaacattttaccaaaagttaggtcagaaaacttgcaaaacaaaagtagcaatgttaactgaacatttcacgaactaattattgcaatgtacaggaaaatttgcttacatagacaagatgtttgggagtagatgatttagcaggatttcaataaataaatattgagtaacgcgtaccttcctgcgttttctcatttgcacagtggttctttatcatcacactgatgtcaggcagagatgctcccccagtcttaaatttttcgattgcttcagtaagactttcctcccagctggataatcctaacttgaattccactaccgaacgctcatagagaatggtaccccatgaaatgttcagctgtgatctcatatttgaagcttgctcaaacgcttcatctgctgagaactcctttaaatgtccattcaaacccaatttatccagtaaaactttctcctttttggatttagatagtccttttacacgcagatattctattccttcccacatttcgatccccttttccatattgtcctcagcatggttgaatagttcaaggacttcggttcccattcctatcttgcatgcatctgcgtaacgccatgaaagctttgcttgctcaaactgttgctgtccgagtgcaatgagaccttcataaaagtctggttttacgtccactgcctcctcaaactttttcccagctttgacatactcagcgcatgcccattcatatgcatttttgacctgcagaagtattgattcctgtgaagcatcatcagataaaagtaatcgcttctttgcacgagacatgtggacgttgccccaattgaacaatgctaaagctgccatttcctgaaattttgcctccgcggattgaaatatctcctgggcttcttcacttgtgatggtttcttccatggcttcatagtacagcctcataccgaggtcacgtagatccacatatgcatcagaatcaaaaccaacatgatacttgaatagacgggcaaattgtaccatccagtcatctgtataagaattcttttcaccgccatgcctagaacttccacattcagacatggaattgtgatttctttctaacttactgtaggaggtagtgggcatgacaagatccctagtgatctcacgatcaggacttacctcctttatatacaatcggacaggctttagtggatctagttcctcaacccatcgcagttcttcagttgaggtaattgtcaccaagtcaccctctttgtccataaatttaagaaggattgacttcaagtgaggagtgtacttatagcgagctatgtccatcagctgcatcagagttatatgttctggaattacaacgatccgtatgtcatctccacaaacaaacttcacgctcttcattgccctcttgttaacatctttgtgattcttatgcttgtctctaccatggattgttggcttgagcgtggatcgcttttcctgcttatcctcaccacgaccaatatgcctgtctagaaaatgcttttctcggctgccgttggcatacctttcaaacttgtccgtgtgcttttcttgcatgccgagactattggtttgtatctgat

SEQ ID NO: 56635 - DNA, 2307 bp, Oryza sativa
aaaatagccttaggctcctcagccacaggcgaaacaatctgtttctcagcaaaacgtctttctcctccatcagctccttgatactctctgatagctccaatgcagttacattgcttggttctaagctcagcaccttctgtacatccttgcaagcgagatccagcttatccagtgcttcgaaacaccgtgctcttttcagtaatgctttcgtatactttggtgatgcctccaatgccagattacactcctcaattgcatgatcaaggtcctcaggattcatgtgcatgtagcaagcagcagcgttgcagtggagaaaggcgatatcattgtgttcctttggaaggagctttatcgcctcgccaaatttgatggctgcctcctcatagtcccttctctggaatagcctcgtcccctcatccttcaattcaatagcttgtcctatgatcaggactgcatcatcattactgacctctgggaggggattagtctcttcaatgttgttgggttggctgttcctcgagctgctttcaccatcatttgctcctaattcacttgtttcattccctcttggtgtagtagtactctccatgctacaagcctttcaatctcccacacaaaagaattgactcagatgatgatccgataatttcttttggagcaccacctctcctcctcttgctgaaaatcaagaaaccgcggaatctcccgctcttctttccgattaaatttgcaattggaacaagaagaaaaatcaattgatatggatgggaaagagagattgggcagcacgattcgctcctccctctttcccatgcaaatggaaaccttaccctatcctggcaatcccatcgagaatgcacgaaatatagttatacaagaaatcaagctggtaattggtgtcctaaaatttgatcagaatggaaatggaaggaaagaaggaaaggagcaaatgggaaagcaaagcacaaggaagcatactacaacgaaggagagcggacgtaggatgggatgctagcgaagggaagccacacactttttgggtgccacctagcagtggccatccatgtttgctttttttggtatgtctctaactgccattaagttcagctggttttaaatccttgtgtttggaacttggcgcaacttttgcttctctggttagcacattggagaaagaaggggctgtctgcgcatgcaaactatgtttcctaattttaggaccggttcaaaatagattatctaaaattagtttcctttaatatacacttgttagttgtcacaaataaagtagaaatttatcacaaaattcctcgttgtggccaatctaagttagaatgccatgatgtggttggtccaaccatgctaaaaaacgagctgctcaaaacccaaaacacaagctgacctctaaccaaatcctctagtggtcaggtcacgacatagcgtcggacacttcaccctcaaacactgtttttccgccattgcctatatttagcgtaatctagccaattatctctaatgtattgggccatcaatatattccaattcagccccatttgggccaaatattcatgtgtggtgggattagtgccaatatgacaatttagataggtttgggccatcttataaacccctgcattccaaccataattctccgagttaactcttttacactaagcaagaacgaaatgatgatgacaaattaacccttttacataaggctcatacataagtagtgtgggatgcccgaccacacaggcgccccaaaaatttggggcctaaaattttaggggtcaatccaatttcatgtgttctcgtatgtttcaagatattcttatcctatttatgtaagcttcacatcccctcccgtaatctctacaaccgattttagggtcaaaaatctggcctcctattgagccacgtggcacaataaaaatttagtaagacatctccagaaaactaccacgtgtccatgaagaggagctaagagtctgcttcgttggaagttgtctcctgtacacatacatgatacacctatcagaaatctctagaaaactcgaagactctccgacggagagattacctggtcgttggagaagatgaagaggtaacactcccgtgcacatcatggtaaataagtgtgtacagttcatggcacaaattctatagatttgcaacttttcatatggtaccacgaaaaaatgacgagtattgtggctcctttaaacaacatttagaacacctttaaataatgtgatttgctacactaaattttaacttaaaaattgattgaaatttttattcaaatgt

SEQ ID NO: 56636 - DNA, 6242 bp, Oryza sativa
  unsure (1)..(6242): unsure at all n locations
gatccgcgagcattgacttagtgctaatatgctcaatcttaatggtttgatcctggattctatctttcacaacatgatacttaatgtcgatgtgtttggcagcaccactcgacttgttgttacttgaatagaatactgcagctttattatcgcagtataatgtaattggtctagaaatgctgtcgaccactcttaaacccgggataaaattcttaagccatatggcctgccccgttgcttcataacatgccacaaattcagcatgcattatcgacgatgcagtcaaagtttgtttagaccttttccatgaaattgctccctttgcaagagtgaagagatatcctgatgtagatttcttagtgtctacacatcccgcaaagtctgcgtctgaataacctaggacttcaagttcttcagatttattatatgtgagcatgtaatccttagtgccttgcaaataacgcaagacctttttaacaaacttccagtggtctaaaccaggattggactaaaatctgccaagcatcccgataacaaatgctaagtctggacgcgtatagacttgagcatacattaggcttccgacagctgaagcgtatggtaccattttcatttgatctgattctaatttatttttcgagctttgaaatatccgaatttatcgcccttaactattggagcaggtgttgcagagcacttactcatattatatctttctagtactctgttaatgtatgatttctgagataatcccagtactcctttagacctatctcggtgtatttcaatgcctaaaacataagatgcctcaccgagatccttcatatcaaaattagatgacaaaaattctttagtctgatgcaacatagtaatgtcactgcttgctaacagtatgtcatccacatagagtactagtattataaattttacacccttagtcttaatgtaaattcaattatccacctcattctccttaaatccaaatctcttaattatttcatcgaatttaaggtaccattgccttgacgcttgtttaagtccatagatagatttcttaagtttgcaagccaaatggtccttgccttccataacaaaaccctcgggttgtgccatgtatacatcctcatgcaagtcaccattaagaaatgcagtctttacatccatctgatggagctctaaatcataatgagcaacaagcgccatgacaattctaaatgagtctttcttagagacgggagaaaaaatttcattgtaatctatttcctctctttgtgaaaaaccctttgctacaagccttgccttgaaccttttgattttccctttggagtcaagcttagttttgtagacccacttacagcctgctgttttggctcctttaggaatttctactaagtcccagactccattatgactcatagattttaattcatctttcatggcttcaagccatttggataaatgttcactcattattgcttctttaaatgaggtgggatcatctacattcccaatatcttcacctaaataaacctcataataatttagaatggcagatctcctctcccgttgtaatattgtaagtggttcactttcgatcactagcggttgagaaggttcttcgagaatttcttcattttgtgccccagaagtctgttgagtgtcattatttaattcattattattttcaacatagtcggtatcaccagaattttcatctggtgctactacggtctgagtcacaggtacaacacgaggtaccaaatntattggaatattattctcttggatttccggtgtaacgttagcccgaatttcctcaagattaatttccctttcctgtgagctccccagacttcattattttctaagaatacgacatgtctagtttccacaaatttagagacacggtctgggcaataaaatcggtaccctttagatgtctcagggtatccgataaaatggcagcatacagtcttgggatctaatttctttagttgtggattaaatattcttgcctcagcatgatagccccacacatgcaaataattgaatgtcggttttcttccagtccataattcataaggtgttttgggtaccgacttacttggaactcgactgagtatgtgtgcagctgttttaagtgcctctatccataaattcacacacaaagtagaatgactaagcatactccataccatgtccataagtgtacggttgcgacgctcagccactccattttgttgtggttctccaggcatggaatattgggcaattattccatgtatctgaagttattgggcaaatggaccaggactttgcccataaggagtatgtctcccataatattctcctcctcaatctgatctcactaccttaatttttgcatcatgctgattttcaacctcagctttgaatattttaaacttatcgagtgatttagatctatctttaatggggaaaacatatccataacgggagaaatcatctgtgaaggtaattaatgaatcatatccatcaacatatgttactaggaacagtccacatatatccgtgtggattatttctaatggacacgtgctcctagtagttcctttcttaattttcttagtgaattttcccttaatacaatctaagcaatgatccgcattcgaaaaatctaagggttgaagtatctcttccttaatgagacgctccattctccacttagaaatgtggcctaaacgacagtgccacaatttcgaagacgtctcattatcattacaggcattcaatatattcataatatgatcatccaaagagagcaaatagagcttgtcttgcacgctaacaagaccaatatcaatattattatacttaataaagcatttgtccttagaaaaattacaatcataaccactgtttgttaaaaccattacagaaataagcttcctcttaacagagggagcataaagaacatcatgaagtaaaagattattaccacttggaagtcgatgatgaagctccccaatggccatcactttaatttcagctccatcagccactcttaggatccactccccctttcttagcgtcctcacggaacggaatccctgtaatgagttcgcaacgtgcacagtggcacctgagtcaatccaccatgatttatgagaaaattcaacgtaaagtaattcatcaacattagagacaatatcaacattagtacctttcttagcaagccaagcccgaaagccttcacagtctgtctgtgcatgaccttctgccttgcaaaacttgcaaaggaacttaccagcagagttctgacctgctagaacctgagctttgcccttatgggcaccattagaagcctgagtggaaggagtgttgggcttcttcttcttgttttgggagttgctggactcccctcgatagaactttttcttaccgcccttagcaccatgaaggaggttcagctgatccttatgcttctgtttgtcagccttctgacgatcctcctcctcaacagaatgagaaatgatttcttcaatggaccacttatccctctgattattctagttaatgatgaaagactcaaaatcagaaggaagtgaactcaagataaaatggactagaagatcatcattaattcccatgtccatactcttaagctctccattcatagcacccatctgcataatgtgctttctcacaccatctttataattatagcacatggacattagacgcttaattatagagctagcgtaagacttagaagaactcctgaagttcctatcaatattttctaagtaagtcttaacatcatcagagtccacaataccaccaataatgacatttgatatggcactcttgatgtacatgagagaaatcctattggacttctcccattcattagttttctcatgatataagttcagtttctcctcataatcgtgctcaacactaaaaggctcctcaggacggtcctctctgatggcataatcataatcgagtatgcctaagttgagtaacacgtcagccttccacttagcataatttgacccatcaagaggcttaatgagtcggatctgaccaaaagctgaaaaatcatgaagaaaaaaatatacataagtacatatatgcaattaatttgtgttggctcaattagttacataattaaacagaaataaattcccctaattacatcaccgttgggcagaaataattttgggaaacataattatgaataaatttatgtgaatttataatcaacgttggtcagaaaataaattcacatcatgaaaaacaaatatctagccaaatttctcgttggttccatttagctagaattaaattaataagcctccataaaatttttcataatttttcagcaattttaagcgatataaatggtactaatgcaatttctaaaaataaataagtgaaaaaggctaaaatctaatagcgcagcccattaataagtcggcctgcttaaagaacatgtgcggcccataatgcacgtgtagtgtggcgcggtccattgcggcggcccaaggggcttggcggcctgctaacggtgccagcccgatgcaggaacgatccgatctgtccgatctaatggacagcttagatttaactcgaatcggtgagaaaaaaaaaacataaaacatgccggttctaaccctaaccctactttacttcatttccccgatccccttctttctcgtcaatatgcggcggcggcggcggcgattttgcggcggcggcgcgcgcgcgaggcggcgccgcaacggcgcgtgatgcggcggtgcgcacaagggggcggcgcaggcgataggtggcggagcggcgcggtgacaacgcgcagcggagagggctgcggccggcggcgccccgtgtggcaggctgatgccgcacggtctgatgccgtgccggtgcccaccgtccccggttctcctccgcgcgcagccggggccatggcggcgagccttgagcagcgcttaatcgaaacttaatccgaataaaacatgattaatcaacatgaaccagaatgtgattgcatcaaaaccgacatgagaacgagggcttagatgcattttatggcttctaaacggaatgatgggatcattaggctatagcagtggctctgataccaaatgtagattatgcgatctactgacatgagtgataagcctaacatgatcaccctaatgcggaattcttagattactgaccgttgtttgaagccattgatgcggtccttgtccttgtcggtgtagacgaagtagtggtagcagtaggtacgccggcttgatcccaaaggggttgccggcgatcacttgcggggtagcgacggccttccggtcgccacctacactgtcccggaaccaccacacgttctccctccagcgcttagttgatcggatagggttttgggattttcggggagaagaaggtcgtggagagatcgtcacctaaccacgacaccggcctctcctattagtatagcgctaagggagatcgagggcaatccaaattatggaaggatttagcgctaccgatcaatgcgcgtaatcatgtagttatggaaattgaatcgcgttaatcccggatggaaaacggcgtccgagattttggcaacgggtggaaaaccgccatccgagatttcctctcgatttccatgccgagagatatactttctgatgcgaacccgctagggtttgtggcccgatctttcgatgagaggtaagggataactcgattggatgaagacgacgttcagggcccgactacaaccgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtagaacaagcactgaaattgctagataaaaatgaaagtttcactatcaaacacaatatggtggggttccgattacaggcagacgggcggtttagccaacacgcgcgctacgagccagtagcaagtagctatctctatcatcaaaacccgaatgttcttggcggcgactagaggtataagaagaggggaagaacgaccatagggtcgtgctccaaccctaggacgcgcccctaatgggcccaacttggatacacagcccattgggccaaaagaggtgacgcagcaccatggacagaaaacagttgggagtaaaatgacaattgcggccgctccagaacagata

SEQ ID NO: 56637 - DNA, 18244 bp, Oryza sativa
ccgtcagaagttggcgctgccctgcagtccgaatccaccccgcgcgaatcctcttccctttggatcctctccatcgttcctgagtaagacacgagtgcacgcgtctccggggtataaagaagaggaatatgaactcaagaaagaactcacctgataatttagttgacgtgcacgagcgcgggtaataggaccatcatgctgtacatggaggcggcgtggatgtatcgatggtgtacatggggggaacgtggatgtatcgatggtgttgatgtcctcatcatcctccccttcttgcatttgagtcgtcctcgactcaagctcatcttcttctcccaaatacagcttcaaatctgcaatgttaaatgtgggactaaccctgaaatctgcaggcaaatcaagcttatatgcattctcattaatctttgctaacactttaaatggtccatcagctctaggcatcaatttagactttctcaaattaggaaatcattcttttcgcaaatgcaaccaaaccaaatctccaggttcaaaattcaattcccttctacctttgtcaccagcaaacttatacttagcattcatgcgctctatgttttctttagttgtctcatgcagttttaacatcaactcagcatgttgcttagcatcaaaattcagtttttcagaagatggtaaaggcatcaaatcaattggaggacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggctaagaaattttgtgtcacgatcagaaacaattgtgtttggcacaccatgcaagcgaacaatttctcgaaagaacaaatcagcgatatgagaagcatcatcagttttatgacatggtatgaaatgtgccattttagaaaatctatccacaaccacaaaaatgctatcacgccccctcttggtcctaggcaatcctaacacaaaatccattgaaatatcttcccaaggaacagtaggaacaggaaaagtcatatacaaaccatgtggatgtaagcgtgacttagccttttgacatgtagtgcagcgagcaacgaacctgccaacatctcttcgcatctgtggccaaaagaaatgactagcaaggatgtcatgtgtcttcttggcaccaaaatgtgccatcaaaccgcctccatgcgcttcctgcaacaacaacaagcgaacggagctagctggaatgcatagcttgttagctctgaaaacaaacccaccattgatgacgaatttgttccatattcttccatccttacaatgcagcaacacatcattaaaatcagcatcatgcgcatattggtctttgattgtttccaggccaaaaatcttatagtcaagttgtgtcaacaaagtgtatctcctagacaaagcatcagcaatgatgttctccttccctttcttgtgtttgataacataaggaaaagattcaataaattcaacccatttagcatgtctacagtttagtttcccttgactacgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaataccacccaatccaatcccactagcatcacattcaagttcaaaagtcttattaaaatcgggaagttggaggagaggtgcatgggtcaacttatctttcaacatgtggaaggcgttctcttgtgatgtgccccaagtgaaaggcactcccttctttgtaagcgcattcaatggtgtagcaatggtgctgaaatcctgcacaaagcggcgatagaaccccgcgagtcctagaaaactccgcacttgtgagaccgttttaggagtcggccaactctgaattgcctcaaccttggcttgatcaacctcaatcccctgcagagttacaacatagccaagaaaagaaactcgatctgtgcaaaaggtgcacttctcaaggttaccaaataaacgtgcatcacgaagagcattaaaaacagcacgtaaatgattaaaatgttcacccatagacttactgtaaatcaagatatcatcaaagtagaccaccacaaattttccaatgaaaggacgcaaaacctcattcatcaacctcatgaaagtgctgggtgcattagttaaaccaaaaggcatcactaaccactcatacaacccaaacttcgttttaaatgctgttttccattcatcacccaacttcatacgaatctggtggtaaccactacgcaaatcaactttggagaacacaatagagccactcaattcatcaagcatatcatctaacctaggaataggatgacgatatcaaatggtaatgttattaatagctctacaatcaacacacatacgccatgaaccatctttctttggtaccaaaattaccagaaccgcacatggactaagagactcgcgtacataccttttatcaagcaactcatgaacttgacgctgaatctccttggtttcctcagggttggttcggtatggcgcacggttgggtagggaagcacctgggattaagtcgatttgatgctcaatgccgcgcaccggtggcagccccggtggcacttccttgggaaacacatcagagtactcctgcaaaatgttagcaacagcagggggcaaagaatgctgcatatcgtgaagtgaaatcaaagcatctttgcataccaaagcatagacaactgaaggtgatgcaatcaactcattaatatcagatttagtagcaagtaagcatttgggtttcaaattgattgtctcaggtttcttgccattagattgggcttttttatcactctcacatttggatttggcagccttagcaacatcatcacgcaaaatatcttcaggagacatgggatgcaacacaattttcttatcatggtacagaaaagagtactggtttgacctaccatgatgcatagaatccctatcaaattgccatggtctacctagcagaatattacatgcttgcatgggcacaacatcacattcaacaacatcatggtaatttccaattgcaaaattaatgtgcaccagttttgttacctaagccttaccactgttgttcagccattggatgtagtatggatgtgggtgcggtttcgtgctaagtgaaagcttctccaccatctcgctgctagccaagttgttacagctacctccatcaatgatcatgcggcaacaacgctctttgacgacacactttgtttggaacaacgtgtgtcgctgattttgctccgccttctccatttgtgcgctaaggacacgctgcacaatgaggctctcatagtgatccgcaaatgcagccccaatgcgctcttccggtggtcattatctgcatggtcagccgcaagcaaagcaagtgtatcatcatcgaaatcactagcagaggagtactcaccatcgtttttgactaccaaaactcgcttgctagggcagtcacgctgcacatgcccaaagcccttgcaacggtggcactgaacatctctcgttcggcctgtggatgccactgaagaagcactcagtgctggctgagcagcctttgtcgctgacttgtcactagatggaggaggtgctgcccgactggttgcgggtgtggaagatggagaagcagtacggccggccggaggagtggtgcgtgtctgccatgatgaagttttacctgcagaaaaaatagccttggcactagcacgtcgtccctgcacttccctttcagccttacaagcaagatgaaacaatcgggtcatattagtgtaatctttatagtctacgatgtcataaatctcgcggtttaacccacccaaaaatctagccatggcagcatcctcagtttcctctaaattacaacgaagaaagcccatttgtaactcctgataatattcctctacactgtctcaattgttgcaacctattcagcaagtcacgtgcatagtaagaaggaacaaatctagcccgcatgacccgtttcaaagcatcccaggtttgtggcatgttattaggatttttcttgccatgttctatccatcaaaccaaagcaaaatcggtgaactcactagtagcagctctaactctagtgttctcaggaaactcatatcatgtaaatttttggtcaacagcaatctcccaagagaggtacgcatcaggatcatattttccatcaaaaggaggaaacttaaatttaattttagaaaaagcatcatcattgttgcgtacctcgcgtcgacggcgaccacccatacctcgtcgattgttgtgtagccgtcgatgatctcgagcatctcgatcatcttgctcagtgtcagcaatatattcatcctccaaattatcctcgacgtactctccgtcaatgtcatcgtcattacccccaccattgcctccagcattgagagcatcaaaatgcctcacaagtgcagcaaggctagtgtcaatgcgggcgaccgctgtctccagccctgtaagcttagtgttggtgaagatctgcgtggactccaattgtccaatcttctcatttgtcacctgcaaatctgtctcaagtctttctgtgtgctgcttcactttccttgtaaagtattggatggtgcctttggtgcgtggggaatgagatgcaccctcctcatctttattctctggacctgccatgatttagaaatgaaggacaacaaaacaatggagtatgtaatgtaagccctacacaactattgggatttagcttttgcaagatgctcactctcacttcactcgcaacttgtctcacaagctcttaccagttcttaccttgcccacaggagggggacagcaacccataagttagcaaccgtggaacgaggtgtatcggtgctgtagcaacaagacctgtcaagctgtagtcgggtttgtggtggagctgttggtgggctgaaagcaatgctcaagagaaaactagaaaccacgttagccaaagcaaattgaataatcgctcaagggtatagtgtacagtgctggtcctaggctagtcgaagtagagacgcgagcctaaccacaaaggacgccacaaaacacaaacccaaacagcaacgaaaacaagaaacggtggtggaaggtggtgacaaagggggaatggtggggtgtgctcgctggatcctcttttttttttgcttgctctctctagtgctgaggagagagacacaactttttttttatttttattttatttttctgatatttttttcacaaccaggagcacactggaaccaaccacagaaaatcttatctcaaacggacaaagtatgaagcttgtagaattttttcaaagttctatgcgaataggtcccgaagcttctcgccacaaaaacaaaattttgcaagaggaatttggcaattttaaatttgccgaacccggcgaagtgggggagaatcggatgtaactttttttttagatgtccgtggatatattataagcctaatttcgagtccgtctgaaaaagatatgactgttttaaggaaggtcactcgaatcagtgttctatttcttttctagtggcggcaagatacaagacaactcacaaaagctatcggcaacagatcaaacacaaatagaaagtgatttggtgggtgactgcgacggcaatgacggtggtgatgacggaaaaattgatgaaggtggcgatgtgcggtggtggcaagaactcgaaactctaatcgcctaacactaagaccagcaaattaacacaaccgatgcaatcgaaaactcaacaagccttaactaagcagtactagtaaaaaaaagcacaatggtctataggatcacgggaaaactaatctactatttttttttgttggccttttctggactataggaaaaaaaaattaatgacgaagggaagggtaaattctctcaccgatgaaccacgctctgataccatctgatgcgaacccgctagggtttgtggcccgatctttcgatgagaggtaagggataactcgattggatgaagacgacgttcacggcccgactacaaccgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtagaacaagcactgaaattgctagataaagatgaaagtttcactatcaaacacaatatggtggggttccgattacaggcagacgggcggtttagccaacacgcgcgctgcgagccaatagcaagtagctatctctatcatcaaaacccgaatgttcttggcggcgactagaggtataagaagaggggaagaacgaccatagggtcgtgctccaaccctaggacgcgcccctaatgggcccaacttggatacacagcccattgggccaaaagaggtgatgcagcaccatggacagaaaacagtcgggagtaaaatgacaattgcggccgctccagaacagatatggaaatgtagctggatccatttgaaagtagacttgataagctttccatgaagtacttgcacgcccaaatcggagttcgcatgaagtcatggcggccgtcagaagttggtgctgccctgcagtccgaatccaccccgcgcgaatcctcttccctttggatcctctccatcgttcctgagtaagacacgagtgcacgcgtctccggggtataaagaagaggaatatgaactcaagaaagaactcacctgataatttagttgacgtgcacgagcgcgggtaataggaccatcatgctgtacatggggggacgtggatgtatcgatggtgtatatggggggaacgtggatgtatcgattgtgttgatgtccgcatcactttcctaacatggtaaggctgacaggtggtatattggaatagaggttaggacaaatttcactaaggtttctctgctagttgagctgaaatattttcctttctaacctggaattctggagccaattttttcaatgagagggatgaaattgtcacatcttgattttcttcttatgatttataaattatttaataaattattattagaatttatattaaatgttcattaatttacaagtgatgttaaatgtgggaaataaaatttcctaaatataaagcatggctggatttaattttcattaacttctccatggttaattatactctctgaaattttcctggatttttcggagctcaattcctaattttaatgatacacagaacatttcagtaattaatcatatattaaattaatcataaaatggccctcttataattttgctaaatatttatggtgttcaagtactttcatgatttttcttgaaattattcgagcattggaagtattttttaacaattcaaagatcattttggtgattaatttaattggaaaaagtaattaaattcccccttttccttttcgggccgaattaggaaaagtcctctcactctcggcccagtctcctctcagcctgctctccctctctttcccgaagtccattttctatccttcgttcaatcgggccgaggaaaaggaagcccagcgaaagtctactttagctcctcagatactgttcatcttccagctccagacagagcccgagcccgtcctgtgcctgtgaagccgacgccgttttctccacaaatccggcctctcctttcgatcttttccgaaatttgttgaggggatttgtttcacttatcctcctctatcttttcccccaagaatcggactttatcccgaaaaaatcaacgcggaatcgagctcgattcgtgtttatctctccaaaccaaaccctagaaaatcccggctccgattctctcgttgtagggtcaatctctagctctcgtggctataaatagagtctcctccctctcctctttcgtttgctaccctcgcccgagctcgccgtcgcccgtagcaccctaaccgcctccaccctagcgccaccgccggcgtcgatcccacgtggttgccatatcatcgccttttcagctgccgtccttgccatctaagtgtcacgtcatctctcagatcccacggggctgccatctaaaatgttagatcagatcaatccgagccatccaattttggtcaggccaaagttgatctcagccgtctaaaatcaatataaatcctgttatcccttttcaatggcatattagttctttttactatatatcgtctactaaattcattccaataattttcggaggatgctttagtcttatatctcagttataaattatttgtaaattgtttaattaatttggaatagtcttttctttaataggtttaattggaattaatcttgtaaaattcataactaattcatatgaagtcagaatgaggccgttcaagtctctaaattcatctaaaatcatgatctacatgtttgtttactttttatgtattatttatttggtttttattagtctttttctctgttttgcgtgttagcttgtcgtttccgtcgttgcgaaggtttgtgaatgcgtcggaagtattcaagaagattaattgaagaccgattattgcaaggcaagtcacacagatcccaaacaaaatcctttgagcatgttgatcctatatttaaattctctatttatttcaactgtgcatttattttcgaatgtcaccgggtggtgtgaacctattcctttgttatggccactttgcattgattactctattccttgatacctcgggtaataaattgattagcttgaaccttatatattagtttggttcagctaaatgctatatatatatatatatatatatatatatatatatatatatataattgcttagccatgcttagaaacattagctcattaatgggatgaatcatactacattattatttatgattatatttaatggtatctcacgatagttaatcgtgttatgataattaattgataattaaaacttgtcaatggtgggttgtgagcacatggttttgtaggtcgtgctcatgacaattaaggaccggttcgcgagctactgttgtgagacattaaccgtaccaaccacaagccagcgtgggcaacggctttaccttttgtatagcatggttcattacggggtgctagactgagaagcggcgagaagttcatgggggtcgctggggagtccatgcctctggttatatttatagagggggtgattatgatgcaggaatggtgcactgtggtgagttgtgttgtgcgaggggtattgtcacagttcctttccgaggtatcgtggtggtattgaggcgcatggtgacatgtcgtggagctgtgtcttgtgggtacagtggtacacctcaggccagagtaaaactattcgaatagccgtgcccgcggtcatggacaagttgagcaatgtttttcgtgattagtctcacacctctcacaataattattgatgctataactggtaataatttacttaactcctggtttggagttagatctgtacagccgggtatggttgttcaggatggttgggcctgagcagcatgggtgtgttgttcagtgttgaataacattgattaattactctactgtttttcaattctcaaatgcttgttaaatgctgcttttgcaaatgagcctatattacgccattctttggtatccttgtgcacttgcatatttgctgtgtggcttgcggagtatgtcatatgctcaccttgcaataatcaatcaacctcagttgaagaaaaaggatccagaaggagaagacgtttggcttataccccaattgagctgcctatgggagtggagctgaagcaatcgctagaccgttattcggctgctgtttttcttttggtttgtaagtatgtaacgttattattatgatggatttgtatattaaattgtcagtttgtgtacctcggctgattcctggacgaggattctatgcacaacttagttcggaaattactagtgaatttctgggcgtgacagaaatctaccttccatagttttctaaggtgaagaggtaggctaagtaactggttgggaagccttgaacagctcctaggaaatccagcacaactgttgcacatcaatgttttcacaagcaattgagagaatttgagttttgtgcgcattgttcttgagactagttgctatgccaaagtgttccataatggtttttagattggataattcctgggctgttgggtgcaagaagaaagctacatcatctgcaaagagagaggttctaaacctcaaaggtccaccattgagtggggataagattccgtgatgctcagcttgttttataatgaagttaaggggctccattgctaataaaaatagtaatggtgagagaggatctccctgtcttaacccctttgcacgttgaattgcttggcctgggcatccatttaggatgatcttagaggttgaagttaaagagtgaatacatccagtttctccatctcagcccaaagccaaaagttgttagcacctctattatgtattgccaacttacagagtcgaatgcctttgagatgtcaagtttgagcaacaaggtgggtgttttccttctatgcagtctcttgaccgggttttgcacatacatgaagttgtcatgtatagctctcttccttatgaaagcactctgattagtggaaaccatctcttgtaatattggtgctagtctatttgccaagattttttatattattttagcaaaactatgaattagatttatggtgatgaaccctgagttcctctcgacactcaaggctgttgttggcccgatcttttggtgagttgtgataactacgatttgggagaaacgttgacgatccgactacaaccgtacgagacgttgtgttgcgccttagcaatcgatacacctctccgtgggttgttgatcttgccggtgcagatcaaccctattcctgcaagcaaatcgaagaaacaagcaagaacaagataaaagcaatcttatattgcaaataggaatttaatacaaatgataagttggggttccgaagaacaagcaaacggacggtctagccgacacgcgcgctgcaagcaagtagcaatggcaaaattttaatctatcaaaacccaagaaactctaaaggctacctagctatttaaggaggtgggaggacctctaggtcgtcctccacctagttggggcgcaccccacatgggccccacttgggccggggtcccaaacaaagttacaagcccattggcccatgacaggtgacgcaacaacttgtttttgtatttgcggccaaacaagatggagtctgctgataaagccagatctgttggaaagaggactccgagaactttccatcaagtactcatgggccgaaaacggaggtcgtatgcagattcggtagccgtttgaagtcagcagtgtagcaggtggccgaatcggattccagcacttagaggacttgatcttgatatcatcttgttcatccatgatgtgagctatggttgtatctgtagtagccatggtcacatcatcctccccttcttcacggaaaaccatcctcggcttttccatatggtgctcgccacatagtccattcaaaataacctatttcatccaatcaaaactagagaaactcgatgttgtgtgattagcaataacatgtttctctaaatccgaacaaatgaaaactctatgcaccaaatatattcctctatcattatattcgccaaagatatggaaaatagcattagttggacatggcaaatcagacttagcatataatttctccttcaaattatcgagctcacaaaaatcatcaaaatgaatatagcccaaaatattgaaagaagatctcaattcactctcctctacttcatcatcaatgtgaacaacatgtttaaaatcagcacacaatgaaacactagatatagtatgttcattcactagttgtggcatggatataagtgaagtactatcgcacaactcttctttatcacaaggaacagaatacaaatcaacttgtgacaaaggcaattcagaagtaggttccactaaagtttgctctaggtcagcatggaaagtggaaaaatgtaattcatcagaagcatactcaccttgagtaatttctgcaccatttaatttaccttttatgccctcttcagataatgtagctgcatcagccatctcctcattcgcgagtgatggaagtgacatctcaaacatatcgttcttctcattttggagacttttctgaacttcctgcaaaacatcagtgataggaggcacaagcatatcttgttgctccgttggattctccaaaattttgcactcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttattttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagaatggtaacttagatgcaacttgtgcaaaattatagtcatgtacctcatatgcatcacatgaagaagtcgtcatatctcgtcgaaggtgtagaagtcgatgttctcgtattcccttgcgcaatcctgccatggttagtagcaaacaagaaacacacacaagaatatgcacgctcctatcaactactaggtagtggtagctaaaatttcacacacactcaagcttttcaccaagctcttacaagttcttaccaaagcaagcggaatggtgacgtacaccgactcaaccaagcaccccaatggaggttggatgtatcgatgccttggcaaacacttgctgtacggctgcaattaaatctgtggagctctgggtaggcttaaatatgtagcaaaggaatagcaaatgctcaaatcagagaacgcaaagttgaataattgttcaaagtcaagtaccggtaccgtgctggtcctaggctagaacgtactagagacgcgagcctagacacaaacggtaccacaaaatagcaccagaaacaactcaagcacactccgatgtatgaaagcaaactcaaagatacaactaatttttccttttgcttctttctttccttttctttcttttctattttcttttctttttcttttctctttttttttcttggtgcggcttttcttctctttttttatgcacctttctgccctttttttctttcttttttttgattaattttttttaccaaaaacagactcaaggacctcaatgtaagatcacagggactcaaatgtaaatatgaaaattacagggactcaactgtaaagtccacaccaaaattaaaaattataaaaaatggaatgctgaatttatgccggttccgtttttccaaacagatctcgaaaccaacaccaaacgaaatttcaccaaggtgtttgacacaactcggaactgagataacgtgatttggagagggaggagggagtcggactgtcacggtggtggtgggtacggtaagtgggagggttcggcctggccctccacaagtggaaaccaaatccaatcaaaaaaaaaactttccttttcttttctttccttttttttctttccttccaccccaccgaatccaaactgatctgctatattcctctattcttcctcacacacatgcacggcatagccaccaaacagaagctatgcaactcaagaactcaaaaactaaccgacaaaaacttctgaaaactacgaaaatagaatcgtggcagcgagccgattccgttttcgtaggtcccgacgacaacagagacacggaggcgacgacgactgtggtataaaatgtgaccagaactcgaaactctaaatggactaaacgctaagaacagcaacacgactcgacgatgcaacacagattcaacaaagcaaaaactgaaaagaacaatgcaatggcacaatatggctaggtaaatgatacaatttttttttgtctggctattttctggttacaggtagaagaaaactcaccgagaaatgaaagctctgagaccacctgatgaaccctgagttcctctcgacactcaaggctgttgttggcccgatctttcggtgagttgtgataactacgatttgggagaaacgttgacgatccgactacaaccgtacgagacgttgtgttgcgccttagcaatcgatacacctctccgtgggttgttgatcttgccggtgcagatcaaccctattcctgcaagcaaatcgaagaaacaagcaagaacaagacaaaagcaatcttatattgcaaataggaatttaatacaaatgataagttggggttccgaagaacaagcagacggacggtctagccaacacgcgcgctgcaagcaagtagcaatggctaaactttaatctatcaaacccaagaaactctaaaggctacctagctatttaaggaggtgggaggacctctaggtcgtcctccacctggttggggcgcaccccacatgggccccacttgggccggggtcccaaacgaagttacaagcccattggcccatgacaggtgacgcagcaccttgtttttgtatttgcggccaaacgagatggagtctgctgatgaggccagatctgttggaaagaggactccgagaactttccatcaagtactcatgggccgaaaacggaggtcgtatgcaaattcggtagccgtttgaagtcagcagtgtagcaggtggcgaatcggattccagcacttggaggacttgatcttgatatcatcttgttcatccataatgtgagctatggttgtatctgtagtagccatggtcacatcatatgggcctgtaatgatctgccaatgaggcatcgcccttctttggcaacagaccgatgtgagcactatttaattcctcaagctagttttgatttaggtcggtaaagaattttattgcattgaacaggtccagcttgatgcgatcccaacatcttttgtaaaaggcgccaatgaaaccatcaggccaggggcttttttagatggcatcaattttaaagcctgttctacctcttccattgtaatgtcatcttcttgatcctgcaagtcaaaactgttcactcccaggttttgctagttgagtgagaaaactctgttatgcaccgttccaagccttttgtagaagtatgagaatattttttcctctttttcctggtttgaggtggcaattccattttcagtttgcaaggattagatgaaattgtcccttcttcttgcactggctttgatatggaaaagcttggtgtttgcgtcccctctcctaatccaagttagtctcaatctttgcctaattttgattttgtttaaggccgctagtcccagcactttgcttttgagagtggaataaaaagttctctcgtctgtggataggtttctactttcctgggccaagtctagttggaagatgacttcatttgcaattgcaagttgaagtttaatgtcaccaacctgcttcgactcccatctttttaggtctcttgctagtctcgagagctttaatctaaagattgccagggggtttgttgagttcagaggcctatagaaggaggggtattgcagccaaaaactctcaaatctaaataccttcactcttgcttgctcgtcctggccgattagaagcataggggtgtgaacaaaacaaaagctggaaaggggcaagagtcttgagtgctgaaacagaatgtcacagtcaggggtgcaaaaacatcgatcaatctttgtttgtgttgggttaggtgcacgtcacgacggctacctcatctgatcaaccccaaggcaaggatgatcaaggcaaagaaccaatatcacacaacgagcagagaaggaagtctgcgcgggagagacagcctaataaattgtataactcgagtgtgtggactcagtgatattgggctgggccactgtaagcgagtgaggccattagcgcaatgctataagaggccggcatggactggattgaatcgaacaatgtagaaacacttttcctgaaactaattcaaatctctcccaattctattgttgttcttccccaaatccctcttcctctgctgctcttgttccagtctcaattccgattccttcctagctaaaccctaattcttagaagtcgtgacaatttggtatcagagccgtaaacctggagaagccacgctacatatctcgattgcaactccaagtcgaagctatggagaagcagaatgtggatttcggcaaggtgctcttggagattcaggagttattgggggcgctgaatcgtgcacaggtcgagactcaagcggtggtcgtccagcaggatcaaggagttagcagttggagacctcaagtggaagctgcggttcaagagctgcgctgggaggtcgaggagatcaagcaacaattggatctcgccagcaaatcacagcaagcttccgcatcgacgctttcccctcgagttccgtcgacggacgaggaaaggaaggcaccgctgctgcccacgccaccgccaacttctcttctggcctcggcggagggtggaagcaaatcggctcaaggccaccattagcttcagagttaccggggaaagacttcagggggaaacatgaccctgggtccaaccccggtcaagggtacgtatgattcacactccttgcagtttccaaaatttgatagttcgggggttgaaggtataatcaccgtgttccaaagttggatttccctaaattcgatgggttggatccccaggactggtgtatgaagtgtgagcactatttcaatgtgaataacatgtttcctggtttgtgggtgagggtagccaccatctattttgtgggaagggctgcatcttggttaagatcttctagggctcatttgcgttttccgatgtggggggatttttgtgctgctgtgtcggagaaattttatcgtgaacaacatgaaaatttgatcagacagatggatagtattaagcagtcgggaacggtttgggagttttatgagaggtttgatgaactgatgaaccaattactagtttatgatcctggggtgagtgcaaaatatttgactcatcgatttattgaagggctgcgaagagagattcgtaatcctgtactcttacagagaccaaagaccctcgaaactgttttgtctgtttctttgttacaggaagaggtgttggagaatcctcaagtttccagtgtcaaggaagtcaagagaatggaaggcaactctagttttcgatcatcaggcaagggaccttggccattgccgcaaccaccagggaagagtggaagtttctctttgatgaatcgtcctgaagagaaaagaagcactgatactgttcgcagtccgacaaattcaacagataaagtgactgctctcaaggcttatcgccgagcccagggattatgttatatttgcgtagagaaatggtcccctactcataagtgtgctgcatcagttcaactcaatgtggttcaggagttgttcagtctctttctggagggaggagctcaggaaagtcaagaaatctcaattctatcatatgctaaagccggtgaactaatggcgatctcagtgcaggcaatacaaggttgtgagccagatgggactatgcgcatgctagggtaggttcaaggaacagaagtgttaattctagtggattcaggtagctcagggagttttataagt

SEQ ID NO: 56638 - DNA, 742 bp, Oryza sativa
ttggtctcagaaaactatcaaaattaacttgttgggagcagtggtgactctaaaaggggtttagtctgaactgtctaggtgtgatttgttatcagcaaaggagatgcagcaattgcaacagaaacaagcagtagctcatatggtccagctttgttctccctctcaagctgaggtatctgaagaaatgccaagtgccattcatttattacttcaggagtttgctactgtttttactaagccaaaggggttgcctcccacaagacaattcgatcacacaatacctctgattccaggggcacaatcggtgaacatgagaccctatcgttacacacctacccaaaaagatgagatcgaagctcaagtgactgaaatgttacagaatggcatcatacaacacagttctagtccctttgcatctccaatattgttggttaagaagaaagacggatcatggcgtttttgtgttgattatcgtcatctcaacgcaattacagttaagaataagtaccccctgccaattattgacgagttgcttgacgaattgtccggtgctaagtggtttacaaaattggatttacgtgcgggatatcatcagattcgaatgaggactgaagatgaacacaaaacagcattttgcactcataatggtcattttgagtttagggtacttccatttgatttgactagcgcaccagccacttttcaaggggtcatgaacagtattatgtcgggctgcaggaat

SEQ ID NO: 56639 - DNA, 1579 bp, Oryza sativa
atgtaaggtgcttgagcctttgtgctccttttgtttgtgaacatgtgtgtatgaactgagcttgtttggtcagattttctgtggctgcatacacccccgttggtgtagaagccaggttttataaattcccattatctaaaaaaaattaatagcaattaattttgacacctatttacaattgtaactcttacatattcattttacgactttaatgatttatcaccatgactcgcatgaaaaaaatatgtagtacttaaggtttaggatagctgaaattaatgaattatataatttatgtgatagctatttaagggtataaacaaatgaattgacttataaaaagttagaatattgtttaaagaagacactatttagaaacttggaaagcgtgcaaacaaaaatccaaaatatggaatcgagaaaaaaataaagggccttaaactccctttatcacccttatcacagtaagagttctattaatattcgtcaatattacgctcacatttataacataatgattcctttcacctttacgaacaaatagtacaaaatccaaatacgacataacacaatacattataattattatgtaatcaactctcggtttcaacttaaacagagctaattagtgttgagaaaaacacaacccatggtgcttaattattctctcgctgcatcacacctttaattttcttttcatgttattaacaacattaatcatctccatatatgatttgatatgtggcaaagcggtagctttacagcggttgtgatcaccttatatgtctcagacactacaccttgtcacacatgcgaaaggtaaaggtgcagacgtgcattgtgcagcgggcaaaaagagaattttggacgctttatttattagcaaacaatagatccgatgattataataataaatccaccagttctagtgtaagtgtacattagttaatatagattttaaattgttaatttaatgggtacacaatataatggtgtagaccttattttgaaacagtgcattacttaagaataatataccaatgtaataaaaagtagatccgatgatttatataatggggccatcagtttaagtgtacgtataaattagttaatatagatattgtttatttaataggtacataatataattgtgtaaaatttattttaaaatagtgcattatttgaaaggaagattttttgttatatgatggtagattctttgttttgtaaaattatgattatttaaaaaatatattcaatatatatatatatatatatatatatatatatatatatatatatatatatatatatatatatatatatatataaagttaattggaaaagtactatcataatcttataaactcaaactgaaaattcttatttaaatattaaaaaaattatcattgggagtacttatttttcttttttataattctctatagttctctattcgccaagcatgcacacgcctagtataccaagagagattttcttgatggagtttgatacgtgagaaacaatctactgcagttcttttattatttttcatgcgactggtatatggggcgtcagg

SEQ ID NO: 56640 - DNA, 7429 bp, Oryza sativa
actacggctccggccgcggcgtgtacgaggaggacttccccaacaagccggtgaatgccttcgtcaaccccaccggcgacaacggcggcaggcccttgctaacgaagcgcggcaccaaggtgaaggtggtggagtacggcacggtggtagaggtggtgttccaggacttgtccagcgagaaccatcctatgcatctgcacggcttcgccttctatgtcgtgggacgagggtccggaaccttcgacgagcgcagggacccggcgacctacaacctcgtcgacccgccgttccagaacacggtctccgtgcccaagtcaagctgggccgcaatccgcttccgcgcagacaatccaggtgagttattcggatttcgatcggattgtggtattttgatatagtactttcatgtgcagttttttttaaaaaaaaggttcgtgtttattttcattgttcaggtgtgtggttcatgcattgccattttgatcgccacgtggtatgggggatggacactgtgttcatcgtgaaggatggcaagacgccgcaggctcagatgttgcctcgtcctccaaacatgcctgagtgctaatgaccgtggttcaaggaaaataacaagagtgtgcaaacacaagcaagcggaaatttgtttgttttgttgattgatttagtggtttatttttttttccttctttcgctgaaaaggaagaacgtcctgccttgtaattgttagtcacttcgttctgtcatgtaagtttggaatttttgttattcaatttatttttttgaatttttgttattcaaattatgaatataactaaataatgtatttgcagtggatcgttattatgacatctttctttataaacacacacacccttgctatcttgactattaattcccagtgttaaattgtgttacactgttttagtttttcgcaactgtgatgaccttagagcaaatttaatagtatattaaactatagctccaaattatctataatcaatttaatagttaattcatacgatgggtacgtatgaacttatactatactattaatatattaatatatagtctcacacagtggcggaaagaggggtagggcagcatactcctaaacctaaatattcattaaaatttacatttgaaaacttcaaaaatatgaaaaataaaaggtaaattatgtaaattatgctggttgagccctagacttgagaaaattcttgctacgccacagatctcacatgtcatacacacattatattttagagccagtactataattggctacaaatctatagctcactactcttctctctactcttttatcttcttgacatgtgtctattgctaacttatactccctccgtcctataatataagggattttgactttttgcttgtattgtttgaccattcgtcttattcaaaaaaaatttagaattattatttattttatttgtgacttactttattatccaaagtactttaagcacaacttttcgttttttatatttgcacaaatttgttgaataagacgagtggtcaaacagtgcaagtaaaaagtcaaaatcccttatattatggaacggagggagtagtttattattgtacccactcttgcttaggccctgtttagatcccaccctaaaatttttcaccctgtcatgttcgaacgtttgaacacctacatgaagcattaaatatatgcttaaaaaataactaattgcacatattgtgactaatttacgagacgattcttttaagcctaattgctccataatttgacaatgtggtgttacagtaaacatttgctaatgacggattaattaggcttaataaattcgtctcgcagtttaatgacggattctatagttagtttttttagtagtgcccgaacatcctatatgacaccctatataaaacctaatgtaacacgccaaaactttacacctctggatctaaacaacacccccttagtctcacaatgtttttgtttgagtgaagtgcacatgcggtcattaaacttgtacggatatatcttctagttccttaaactcttaagatgaatttttcggtccccaaacttatcatgagtgtcgtatatgtttaaacgggttccaacccgctccgtgagatgacgtggagtttacttcctccgttccataaaaaaacaacctagtacgggatgtggcatatcttagtactacgaatctggacatacatgtgtccagatttatagtactagaatatgtcccatccaatcttgggttcgttttttatgggacgggggaagtacgtgtcagtggatccaacgtgtcagtcacgtagaaaaaaaataaatttaaaaagagaggagagagaagaaaatgatgtttttaattttgaaaaaagtaaatgataaaagagaggagaaaaatatgttcttaattttttccttactatccgtttgaatctatatacacacgagacaagttgagggaaaaaaattatgagagtttaggatctaattatacacccacatacatttagatatcagccgtgcactttactttttttttttttcgtgactactagtttctggagtaactaccaccaaagctgtgctgctgttgtgcttccagtggcaaacacagcagatagataatacagggcccgcgacgtgggcgagaaaaccgtgtgccccgcgcggcgtggcggctcggcgctggcgaaaccagggcggcgcgcgctcccggttcgccacttgcccccatctcccgacacgcacgaacgccatccccgcccccgcgccaccgatgttctcatccaaacacatcacctcctatctccaccggcacgcatgccgactcctattataaatgatccctgttctttttggcactgatcccaattcactagtcgtgccattccaatcacctcggcgagatcagtccaaactccaaagaaatcaagaattcgcagatgaaggtgcttgtggcggtggacgacagccgtggcagccaccgcgcgctgtcctgggtgctcgaccacctcttcttccccgccgccgccaccggcgacggcggcgaggaggagcaggtgccgcggccggcgccggagctggtgcttgtccatgccattgagccgctccaccacgtcatgttccccgtcggcccaggtcagtcagtcgtcgtccccgtcgggccgccgcaatgcgcagctgtctcgaggggtgattgcttacgggtgttcgcgcagggtcggcggtgtacggcgcggcgtcgatgatggaggcggtgcgggcggcgcaggcggagaacgcgcggaacctgctcgtcagggcgaggctgatctgcgagcggcgtggggtggccgcggcgacggtggcggtggagggggagccccgggaggcgctgtgccgcgccgctgaggacgccggcgccggcctgctcgtcgtcggcagccgcggcctcggcgccctcaagaggtacgcacacgcagtcacgcacacaccccctagctgttcgtgtcagtgtcagtgaccaggactccatggcgtcgcgcagggcgttcctgggcagcgtcagcgactactgcgcgcaccgcgcgagctgcccgatcatggtcgtcaagccgcctcccgacgccggcgacgaagacgacggcggccactgcacgagcaactgaactgatgatggatcgccattacatccggaagaccagctttcgagggggaaagagaatcaagagagagacacttgttttaccattgttgttcctgctcagtgctgaatttgtccttccaaagttcctaccctgaagcgccgtcaataaacatttttactgtgtgctgccctgcgtctcatctgtgcttttgctataccgttgcacatgtttcttaattttgcaaaaaagtttttgaaacacggtacaaacgacgcacaggcgcctcgctgcaacgactatcactgaaggaacaatgaaggaacaatgagccgtaaaggcatctcgttatcgatcggttgttgacggatacatgggctatcattgaaagaataatagcctatatcacaaataaccctaactaattaagctatactcacttcatacaaaactctaaaattaatcggtggtgaaatctctaataccgatttcagggctctatccctggttagagaagcttttcctccccaaaaatctgccacgtgtctctttgctccccaaaagttcgctgcgatggaccaacgaagcttgattttttctcgcaaaagcacttgacccctactccacccatccctcctcccgatgcacgcctcgccgcccaccggatcctccgccacccgcgcgccgcagcggaccacccgctcatgtcctccctcaaggcgcgggctcgtcttcttcaccaccgcccggccacctcgccctcccttgcgctccccaccgccatgctgctgtccttccttgacgcgcggggctgtcgtcatgctgcaggagtcaccacaagcacgcgatagtcgtcgccgatacaaacttcggcaagatccgttgagcccaatgaagagaagagcggcggtggtggccgtcgacccggaggccggatcaggagaagggagggggcgctagctagcagaggagaggaggcggcgtgcacgggtgagtggtggcgtcgcgccggatcctctgccacctgcgcgtcgtggctatgacgccgcggcgaaccacccgccaacggcccaaggagcaggagggattgcaggaggtggaggatagggagcgcatcgcagacttctcctcgctcatgttgacggcgctacttcgatcttgtagacgcaggcgccatcgaatttcctgcaaaggaggccatatactgtccgttgtcgcaacggcatcgcggcgaagatggagacgccgaggagcaaggagcagattgaggaatggagactggagagcagcggagtcgttgacaaataggagcggggactggggactggggactgggaaggacaaaaaaaaaatgactttatttagctgcaagcctacaactgaagacagcgtacgaacggctagatcaatgtacagacggacggctctgatttttttcatgacgttgccatctaaatgaaaaatcagtgagcattacattcagatagtgtagggcagaaaaactaaagatcttattatatcatttgattgtgctctcagttgacacttacaggctcctatcggatggcctaatcagctaaagaaaaagccaaattttaaatttttaagtataattttgagatattttcaaagtagtttctttttcaacattggcttttaagtcaccaagaacatatttataaaagttttatctacaaattcatttttattttctaacggcttattagaaaataagccaaacagtggggaccacagttcggctgcacatacaagttgcaatgggcagataaggcctctttgcaatcatttatccagggtataattttttgagggagtatccaggatataattaagtagtagaagagaataaggaggcactggtatcttttgctttagcttgagctcaacgcaattccaaattttcaaacaaataattaattccttactcttctttattgtgcaaatagaattttttaatgttatgcacttttagaagataaaattattttttaaaaagggattttcttgatttttatagacatgtggaggcaggggtgaagccacacctggctatcgcaggtggccgcgcaagttcaccaacaaaaactccattaaatttatatgttattgaatgaattgatgatgaaatttatataacaaatactagaagtatagtttgcttgggctcaaaaaatctttttagctccgccaggagataaaatgaaaatactccctccatccaaaagtccaagacctactccctccatcccaaaaggactcaattcttggattttcgtgcccaacgtttgaccgtccgtcttatatgaaattttttatgattactatttttattattgttagatgataaaacataaataatactttatgcatgacttatctttttaaatttttcattttatttcagataagattgatggtcaaacgttagacacaaaaacccaggaattaagtttttttgggacggagggattatttcttttggcaccaagaccaaggagtaattaatttatttacaatgtgacaaaaccaataaacatgcaaccaataagtaataaaatggtttattgggttctgatcaataatttaatttaacacataataactataaataggacttaaacttttggaaaaaccaaagaatggaataagttttagactttagaagaagggagtaagtagtttcattactttggtttcgttggaatttggaatttgtgcgcatatattcgacttccaacttatgtatatgaattcaatgtcttgctgctttaaattaatatatgaataaaagagcatagtttccttaattttaggcattaaatagataaagaaattaagtgtacttatcataacatatcatttactccctccattccatattgattaccatataactttttcaccaagaaaaaaaaagtattaactttcctatatttcatttaatgtgagtatgtggtagggaaaaatcaagaaacatgcacactttaactcctcttaggccccatacataagatcaggtctagttataaacacatttcgaggagataaaacagaaaagagaagagcaatgggctatagatttatagccagctgtagcacagactgcaagatacatgtgtgtatgacaggtgcgaccaagtataaattgtgtagtaatgtttataggagtatatgaatttcctactaaattgactatagatgatttggagtcagtgattggctatattattaaacttgctctaagaaacgatagctttactacctcgaattcctacatacatgcatgcatactcaattgtcatgcttaaatgcaataatattacacgtcaaacgaaggggctatgataatatgatgatcaatttgaaaatttcaatttatgttaaatgatcaatataaaacggatggagtatttcatactggctggcctattatgcggcaaagccgcgtttattttctagttgtaatcctaataaactatcaggtacggagtcagattctttaccgggaaaaaaaacagtgaccgtcaaaccaacgttttctttttttcttgaatgactacaacgtcgcgctcttttttatgttcttgttgttttgaagaacagtcaagatattttgccgtctgtattcaactattgatagagtagggagtttacagggcgctatctttcatgtttatgttgtggagccatctatctatcttatattatattattaaaacagttttgaaaggaggcaccacgttcactgtgggggttagaaatttacatg

SEQ ID NO: 56641 - DNA, 6082 bp, Oryza sativa
caatggcaaagccgctgacggtttggcaggacttttagaaagtaaaaaataacccaaacgataattatattcgattttcaaaatctcaataacaataaagagaaaagacagtggacgagccgtagaggagtataatagcaacgtttgacgggacttctaaaaattataaaaagaaacccaacaaggcaataaactctaaaaactataagatccattttttaaagtttccaagaagaataaatagaaatagtgttagatcaagcaagcaaataaaggagatgtaagggatagcaagtgtgacttttaaaaactatataattagaaacacgggaatgataatatttggtctttcaaagtcttaatacaatgagatagctacttaataaattttaagtaaaatcatactaaaaaatatatgattttgtttaagtgctagccgcataattgcgcgggccaccagcaattgtatatagagtagggagtttacatggcgctatctttcacgtttatgtttgtggagccattgaactgaaagtggtcgaggaagcgtaattgtgtcgtagtcatctctgctctttttcttcctcctaagagcaagtttaatagtatagcccactactagctctaattcatctatagtcaatctaatagctaatttatacaatagttgtttactatactattaatatatggtccaacatgtcatacacacattgcgtcttggagtccgcgctgcatctagctacagatctgtagcccactgctcttctctctcatcttttatctcattaaaatatgtttacagctagctaatatctgctctaaggtctttcacagtactcctacctgcagcgttatctcgtttgccagctagaccaaattctgacgtggatgaaaaaaggtagtgggaccatatctttacaaaggtttacatctcctagcaaggatctggtttcctcatgccaaaaaataatggacatgctatatttatggcgacacaaaattagcttgatcacagtcggttaatctgacccttcgatatcatgtagattcgtgttgcactttaatgcttgacttaacgaacgtttgatttgctaagtccgtagttatttgatctctctgtactacgaacatgttgctcctgttatatattagtttcccattaaatttgcactagcatctctcttatttatatttacttatatatgtaattttagtgtattaattagaacttacatggtctaaaattacatatgtaattttatgacctacatatgtaattttagaatttacattgtaaatacactaaaattacatatgtaattttatgacctacatatataattttagaatttacattgtaaatacactaaaattacatatgtaatttagacacttacatttaagtgcataccgactattttttttacacttactgtgagtggtcccctactccataaaacttccaaattcatctactctgtccgtctgtcgtcgccgaggttctgcgcgggcttggagctcgccgaccacgctgcctagtccgacgaggaaggggagtagccggagcacaggaagaaacggtgggggctggtcgggggcgcggcgacgccaaggaaggagtgggtggtgagggagagccaccaacggaagagaaaggcacgacgaccggtggcaaggagagccggggtcgccgccgtgccatctcctcgtcgccacgcttcttttccgtctccgcgctccgtctccttgttgccggctaagagaggaggggcccggcgccgctccagatccacgtcgccaccgccgtcctcctcgctccgtctcctcgtcgctgccgagagaggaggggcctgatgctgctccagatccgtgccgccgccgccgtcctcctcgctccgcctcctcgtcgccggccgagagaggaagggcccggcgccactccaggcccccgctgtcctcgctccgtctcctcatcgccggcgcgacgacggcaaccaccaccactgcgcgcaaggcgctgtcgagcaccccaccgttctactatgcgcatggcgtcatgtagactggagtccgccgtgtggaggtggtcgccggcccggcgccaagaaaggggaaagtgggagagagaatgggaaagtaacagagagaatgggttgggatggttggtttggggatcccgtgtagtaactgtgagaggtatggattcgttgtacatttatcttaaggtaattcaaataaaggacttgcactgctactgcctaaagcacagtgccttagagtttttttttagggaaacagtgccttagagttactcacacagtgcgacgaattctctcgacgttggcaagcagcgcgagcttggatatgttgacgtctgcagttcatcactcattcgttaatgcatgtttcccatatgaactttaattagcatgaatcatttcaacagaaaaatagagtagagtaatatgatcacatccgtttctttttttcggcttctggattttcgaaaggagcaatctcaatgaaactatggatgttgcattaaattcttcatcttgaaccttcatacgtgactatgtctagccgcaaattcatacagtaaacattaaagcaaatccgtctccaacttgactgccatcatgttgtagaggcgtgcattggttagcccctcttattcactactggcctaactccaattttactagcattctttaatcttgtcgatgaccatctgatctaactctccagctctatttatcaatgtcgatttcttactgatgaaattggtttatagcctctcgcttaatgttttctttacacatacgatgctttagattgactgcataatcttcttcattaaccttgacactagccaccaataaactctctcgatactagagttgttaagtacacatggctcaccttttttcagttacaattcatcactttacaagttgcataacataaaacaaaatttccatttgttggcaacagccaacatgacacttcaaactttcctttcaagctggagagcaaatctaacctaacctgaaatttgaatcgtagtagcccatccaatcagtttgcttctcaaatcaaagagaacaagaggaaaggcaaacagaagggaaagcagcccaggccaagaaaagggtagagaagcaaccccaggccggcaggcaaacacgcgccacacgttgccgctacaccttccacctcagcaccctcgatggcctcgtcgtctgctcgtggggtcctcgtcatcgctacccctgggctcgtggccagcggcaattggctcgcactgctgcgcaccaaaaaaaaagaaaaaaggaaagaaaaaacaagagatcaaatcgtggaactcaacgggagtctcctcgcgaggtcgagtggactccaccaccttctcctcctccactccaagcccacgaattcggatcagcgccgccgccgccgccgccgccgccgcgggaggagggctcgccgattccactacttcactccagtaggtggccaacgcgcggggtgggagcagcagcgacgacctccaatggcggcggcggccgtctcctccctcctcgccccttcgggatcctgctactcccccggatgccacagctgctggggtcccgggcccggaggcgggcggcgcctaccttccccgcgccggcgcccgattaccgccgcggctcgccctgtgagctcccccctctctcgtacacacactctctcacacacactcgcccactcactctcgaatcgcgtggatgttcgttgattgggaggtcgcgcagcctagatgagaaccggcacttgcgaaatagctactttagttggtgtattagagagagatatatatcctaattgttgatctaattgctttgtataattgtatttgcgccaaatgacttcaaactcgctctcgaatgcgcagtagaaaactagaaatcatggcctaaggctaagagcgcattaagctccaatgcacgtcagaaaactggaaatcatatggcctaaggttaagagcatattcggcaggtgcataatagtttttttttttcctaatctgaatgttgtacacttttttaacctgggcagacttgggcagtgccgaggaggagcaggttggagtgggggcgtgtggaggctcagaattcgggcgctcgcaccagctgccgagcagcactgcaatggctatcatccacggtgagccatcaggagtattattttgtttaccctgtacactcgtcctggaaattctaggtctgccacgtcgcaattcgatcgagtcaaaccagctgaatgcctgcagatttcagtttctgatgcaatgtattgtctcacctaggcaaggtcccatgtgaatgttggttatgggtcgccgctggtgttcccaggtttgaccaaaccggggtcaagcaggtgtctatgcgttgttggaatggtcggcaatgcagggaatcaagttggtgacgatagtgatgatggaatcaaggttaccaatgagaagcttcgtgctgttatccgcaagagcaaagaggtgttggagatccatcggaatctacttgagaaggtagctgttctataagttgttgctggaacaaatgtgtttctcaatcttaaaataagttgtctgtttaaagttatgatttagcaggttgtcacaagcccacaaaaatgatgaaactaaaaaggttgtagcattatttgtgtgacctttcatttatgtagacaatttttggttgcaggtacataaattgaaaatacaagattactatgaacttcccaaagtatgatatagttttagttgttggatcacctataaagctctcttatacaaacaagcggtagacattcatgttagtcagattcgttctatccacatacatgctgttagagcatttccttccactgttgaagtaataaacattgtagtctccattgttgaaagatataccttttagtcttggattttacattctataccatcacgagacagtttaagttctagcttctgaggaacaaggcggtgtaaaggtaatggaggctctgttaacatctaccagtgaggtcctttgcaccatgtttgatggaagcaattaggtattctactgaagggctgatgcactgagtttactgaaaatgtgtcctttttcatgttcttgctggaatgtgaaatgttactaaatgtagcatgctaatttcttaaatggttattatatagtggtgatgagaaaggcaccctgcgaacgaccttgaattacaacctttttttgggccattttgcagttacatttatgcatgttgctggctgttcacattaaaacattactatatgaaacagttctggtcctcctcttttattgtttactgaaaatggtggttttgagttatgatatgtggccaacttattcagatatcggcatcagaaaggaagaagatcacttcaattatagaggacagttccatttataatgagcaagatccatttggtcaaagagatagttctttttatcatcttgatgaagttccagacgatgatgaatttagctatgacctacagatgtaccttgatagacgtccagatcaatctgaagttgttgcaactcaggattatgaggcacaactaagtcaaataagtgaaatgggacagtcagttgctgagggcactagtgatgatccatctgcttcagctgctgtagatcttatcaatatcatattggtagcggcggagtgtgctccttggtccaaaacaggcaagatcataatagccacataccttctaattttttcagtttccatgaaaggacattgcgggtttaacctagtacctgtaagttggcggactggagggtgtgtgggctaacacccaaaattccaaatacaacattacatggttacatttcctgtgtgagctgatttaatttaaggacgtgttgtttgtgttcctatattaaccgttcttgttccgtcagcccgttatgtttctcgtgacaaatgttgatgtagtctgtcttcatgccttttttcatttcttgatagtttccatccagttactcacaattggcaactttat

SEQ ID NO: 56642 - DNA, 2738 bp, Oryza sativa
tcctgcagccctagtccttattttgtaatttggtgtcttgcttacgttttttatgctcaaagaaagatcagttgccttccttattgatctgttcaagcggcttttcaaggatagattttgaactaaagtattattaacatgattgacctttggttagccctgtttctctgtcttccttgatatgcttataaaacacaagattaccttgctttaggttccatggtatgttccttgtggtggctactgctacggtgatggaaatcttgtgttccttgcaaatgattggcatactgcactactgcctgtttatttgaaggcatactatcatgacaatggtttcatgatatatgcccgttctgttcttgtcatacacaatatagcacatcaggtatgttgatctttaactttcgcgtgtgatttgtgtttgccctaagtctcccaatgaatcacctactaaatgcacaatccatgtgttacttctggttcatggaaagttaacgaatcaaatctattaaatgtatctaccaagttgaacaatcatatagtccatttttagtccttgaggtcacagattgctcatgaacgaatattaatagatctttcagtgtttaacttgtcctttctagaaaggaaaacatttttagctttagatagcagatagattcaagcaacatcatgatggatatctgaaacattaaacagagactaccatgcagaaaattgagataatacagagaagaaagttttagagaagtctgaaaacatttcaaactttcaatgaatagattacagcttctgtttgttgtcttctgttttctgttgaacaatctacatagtggctgtactgaattatgtggtttttttgcttcagggtacctgttattctgttgataataagtttacttaatttcacttttcagggtcgtggcccattagatgacttcagttatctggatttgccagttgattacatggatcttttcaaactttatgacccatttgggggtgatcacctaaacatatttgcagctggtattaaagctgctgaccgtttgcttactgtaagccatggttatgcatgggagctcaaaacagctgaaggtggttggggtcttcatgggatcatcaatgaaagcgattggaaatttcagggcattgtaaatggcattgatacaactgattggaatcctaggtgtgatatccacctaaaatctgatgggtacaccaattattctctagaaacagttcaggcaggtaaacagcaatgtaaggcagcattgcagaaggaacttggtctcccagttcgtggcgatgttcctgtcattgctttcattggacggctagaccatcaaaaaggtgtagaccttatagcagaagcaatgccatggattgctggccaagatgtacagttaataatgttgggcactggacggcaagacctcgaagatacattgaggaggcttgagagccaacattacgatagagttagggggtgggttggtttttccatcaggttggctcatcgaatgacagcaggggctgatatactattgatgccatcaaggtttgagccatgtggattgaatcagctctatgccatgatgtatgggactgtcccagtagtccatgcggtcggtggtcttcgagacaccgttgagcactacaatccctacgaggagtccggacttggttggacttttgaaaaggcagaggcaaacagactgattgatgctctagggcactgcttgaacacgtacaggaactacaggactagttgggagggactccaaaagagagggatgatgcaagatctaagttgggataatgctgctaagctgtatgaggaagtcctcctagctgccaagtatcaatggtgatcagtccaagaagacctcgacggttgttcagtcattcatgaccgaaatgcctttttctcgtgtcagctgctcagatgcggccaccatctagttccatggcttacatcttcctgtgatttggatgaacagagtttttttgtcagatctgacatcattttcaagaaggcacatgatgaacctacttcccaggtgaatacagcagcggacgatgcctttgttggaaggtggcaaaacacatggaagattcagccgtctgccagcatgcacctctgtcctaaggagaggctccaagccccattgtgcgctctggagaggctccaaaccaccattgttcgcccctgggtaggttgttgagctcggttagatgcttttagtacagtagaatagcagatactagcggatagactagttgatatttcccctatgcaccgagtggttcggttgtaccttatttttttcttggctcttgttgtccagttcttcgatctttagacgattagcgtcccgggatttcccagatgacattgacattgatactagtgggaatttcccctgcaaatttactgtcagcttttccattggtctgcagctatgatcagttaaacccgtggatcccatggtggctttcccttctacttgtgacttggggaggtaggcaacactgccccttgatagttgatgcatacgcttcatgcagattcctcgactggtccattggcacatgaaagaaaaggagattgcaagtatgcaacgaccgtgtgggtatcagcgtgtgcaatgctcgcaagctcgcatgaggtggccgcaagcctgcgacgccggatgcttagccccaaggagagacggtgacatacaaggtaa

SEQ ID NO: 56643 - DNA, 7383 bp, Oryza sativa
cccatttttgatgagcagtcctattacatacatacatgctcttttgatttgttgctatgcatatttagctactttagggcatgtttagttcccaaacaaaatttttcgcgttgtcacattaaatatttggacacatgcatggagtattaaatatagacaaaaaaaaaaccagttacacaatttgccagaaaattgcgagacgaatcttttaagcctaagtgtgccatgatttgacaatatggtgctacagtaaatatttgataataacggattaattaggcataataattaaattcgtctcacggtttcctggcggaatctgcattttgtttttttattagactatgtttaataatttaaatatgtatccgtatatctgatgtgatgtgcaggggaaaactttttgccaactaaacatgcccttagactgagttcggccaactttgtctgacacggaaaacaaagcaaatgattagaaccagattaattaagtattagcttaaaaaacttgaaaatggattaataaaagcaactttcctatagaaaacttttgcaaaaattcacaccgtttaataatttgaaaagtgtgtgcgtgaaaaatgatggaggcgagttgagaaaaaaagggaagaacacaaccttaacataagaataaagtttcttttttctttcaaaatgcttttcgtgtgctctgtcccattttaaacgctgttgtatacgaaaatgcatagggagtacacattattagcacccgtacattctatacacctggaagatgcgtcctcgcagaaagaaaaaaaaaagttacttgtggtaatacacacgtcgtccctgacgattatttaaggaagaatggttctgttcttttcagttaattcaacagattatattattgccatcatatcatgaagtatttgttccacacgcaaaagaaatacgttttgttgaaaaatatttttgtactacattgctcgatcccttaacaaagctatttgtttttaaactgagatcattattatatttcaaatgatccggcttttggtagaaagccaagataacgaaatactacatgttaagtttatttatcaaaatatttaatttatatctacaattgtgtcgataatttgtttcaaattggacaaagtttatgactcgttccattttggtgatcgatggcgtgtcatatatgcagggtacaagaaggagcacatcaaggtgcagctggtccgcagccggcggcggctggtcgtgagcggcgagtgccccgtcgccggcgagaccaaccggtggagccgcttccggctgcagttcccggtgcccgacggctgcgacctcaaggccatccaggcgaggctccacgacggcgtcatccgcgtcaccctgcccggcgtcaagccgcagcagcagccgccgcccgccaagacggccgccgccgccgcggtagtaggaggggatcagcggggcggcggcgaacgatgccaattcctccgggagcggggaaagctcgcgaccaccctgctcggcgtggtgctcgtcttgtttagcttcgtcatctacatcaggtacagcgtgaagccatgaaccggggggacacacggtatttatttctgagatgacgagcactgatcgatcgcgatgatgcgatgggtttcgctgtaagaattaatgaaatccatctgaatggaaaaatgaaaatggaaatgtaaacaaagccttggctttttctgttcatatatatgatcatccatgtcgcatgaaagagatgtccccatgcaaatccttgtgcagtactatcatctgactttaagtggctaacatgtgggccttatacccatcggattcacgtgtcacaaaaagtcctccaactcctagacactaactttaggtggtgtttggttggagagactaaagtggggctaaactttagtccctctcacaaaaatagggacttatatttttgtgagagggactaaatttagtccctagttcccaaacacccccttaagccttgagataattttatagttattaagaaagtatcttaaggtatctaaattttacactaaaattttttataggtatttagtatttaaacgtatcaaattttacattagaaaatatgatatctctgtatatcttattaagaatgataaaattacccttaatctcaggccatgttttgaaacggatgattagctttagagcggcgaaggcacacgtaccgtcgcacgttagaccaagggaattgcgcgcgaaccattcgcgatgacgaaagctcggatttcatcttccgtcgcgatggcgctcccgccttttctcctcccctctcccacgagcggagaggagcggggtatcattgtggccgacggcgccgccgcgtccgcggcggcggtggcgccgcgcgtcgtcatcagccgcttggagatcctgcggaggtagcctccgaccgcgccgcccttctccgcctccggcgagcgcgacatgccgctgccgtcgtgcgcgcggcgcggcggcgacgccgtgaggccgagccggagccggtcgcggagcgaggagggaggtgaggacgtgggggaggagtatgaggctgacgagacggcgggcgcgtccgttgcaatggcgttcctggcgggcgccggtcggcgcccgctcttcctcggatggtgctccgccgtcgtcggctcgtcgttggccaccactgcctcgccgtttgtcgccgccgctgtctgccgacgcgtgcgggcgccgaagcacggcggcgaggcggagcggctgcgctgctgccgagacgacgacgtcccgagctggagccggtctccgatcggcggcggctcggccgccctgccgccctcgccatcgtccgccgccgcgggcgtcgtcatcgtcgtcgtcgcgcacaccgcgcatgggaacagccacgccgcgacgagatggaacagctgcatcgcgcgctcgccgccggctacagcacacaaaaccaactcctcgtcgtcgccgccgccgtcgccggcgtgatctgtgagcggtgtcgctgccaccgtgtgtatgcattgcatggggtggccgcgtcttatatcgtgcataggagaagcacgtagcgcgattgcaccggggttctcggcggcgcacggtgatattgccggaagaaacggcggcggcgtggggtatgcgagaatggaaagctctcccgccgatttctttgtaagcttccttctgcttgactgcttccatgtttaactagaaccgattgaattgagattaattgaacatatgccaaatgaaaaacagaattgctaaccatctgttgacagaaaatctatctctaaatattgcaaattttggtccactagatgtgcttcctgattcgtgatccagctgctctccaactccggcaaactcctctacttccccggcggagggccaacgaattagggtcccggggtggggaggggtgggagggaagggggaagtgttagtgatatgccctagaggcaatcatagagatgattgtatcacatactatgtttacatatttatctgacattgttcctcgaaatagataactcattatttgttaatgaatatgtgattcttttatgagactctttatgttgtttgttactatttctaaaggatccctgatcaaatatcatatgtggaacaaatatgtttaaatgatcagcacatgtattaattgatgatcatgtctcatggatcatagtatagagataccaaattaataatgtggacacatgttggtgaacatgttgttggatagacccaacatgaaacactgcaagagccatatgtgttgtgtcatcagtgatctcatttagtgttggtgttgaatccttagacctgagattatcatggtttccaacatgtgcaatagtttacttagggactgctaaacactactccgtaattgggtagttataaaaatagttttcgggtatgctatgaaacatgtagtggtatatgaataatcaagataggatttgcccctcctatggagagatatctttgggcccctcgatgttatagattatggaagtgcatggccatgccaaaggtgattgaggagtcaatcacaagttatataatctattaacaggttcgagtgaatgattgagctattagaggatggcacatatctagccttgagcttaatcgatatcgtgaggcaaaggggttcatacaagtatacactagaggttcagccaatatgatcttgatgtatgcccggtgggtcaatacgttctgctaggggccgctgttgacgcgtggaccgaaaaggagttttcgggttacagccgagtgtacatgaacatacagggtcgcacgcttaatggaccagaataagggattggatagggatcgaatataagcttaattcggatagggatccgaataggagtcctacgggccttggaggcccgagtaatggatcctatatattcgtgaggggtgtgaccggcggaggcattgcatcacgtgagaaaccctagccgtcacttccctccccgagcaaaaccctagccgcgcgcgggtgctagcacatctgcgcgtggcgttccgtccctgtacgtgtggataccggtagaggcgccgctggtttgccgtgctgatcggtgtgggagtacggcgaggagaacgcacgagtaggagaaggtcgagccgatgcgatcgactacttcctctacatggacgcgcgctactacgcgagagctccttcgacttctccgcgttttcttccactgcgcagcgcgtcgagtggtaacgatctatgatctaatacttgcatggttcctggtttacgcgatggaaaattttgatttatgctatcgtagcctacccgtatcccaacaggaagaaggggaagttcgccgagcttagaggaatggtcgtgggaggcggcggccctgcggtgagcggcggaacgggcgggcggcgaagcgccggcggcggcgccggagccatagggacggaggagggcggtgggccggcgttggtggaggggcatagcgagcttgtggtggccgatggtggcggatctagcaacgaggaagacggcgggccaggagcatctcgccttcgatggctcgaggagagaggtgaggggggaggaggctagtcggggtgtggaggtgggggctcaccggcgccgttgacgccttctgacaagccggcgaggccaggcagtggcggaggcggaggcgggcagaatgctctcgcactgaggagcggcggcgtgagggggaattgggagaggaaaggttttttagggtttggttgcctgcacgaatcttaaagcaattgggtggtccaaaatttgcaagatttctaagggggttttctgtcaagtgatctatagacggtcccaaaaaaaaggcgctaattgatcggcatgcttccatattgtatatatagaactggttcaacaaaaatggtagtggatccaaggcgtgtgctttgaaccggagtcttcatcaaagctccaaaaatgttgaatccgatgacccaatacggccttgttctgctaatcccaagagaaaggattggaggctaatctgaagagaaaggattggaggagattgagggctttgttcggttaagcccaaaaggaaggattggaggagaaaaagattgaagaggattaagagaaagggattggagggggttaattggggttaatttcatatcataatatgtgcggaataagtcccttcaaatccccatcaattctcttatgggagggactaaccgaacaatggcctataacatctgtcaggacgggcacaacttagagatatgaactgagccagcccattctaattttcttgtgagatcaccctatcatggtggaaatttgtcaactcccatgggcttttgacttcaggccctggggtatggcctacggtgtctatggtctagatccgctccatattccgtcttcattgagccaaatgatcagatccaatgcgaaggagatctaatgcgatgatgaacctattggaatgtttccaccaaataattaaggtccttctagaactagtaaattaaaggggaaaaaacaggacttcgatatgaatgcatatgcaaaaccgatgattatgaaataaaatacaaactcatgaatggcaatttgaataaacagtaagagcttgttcactttgctaccattttcaaccttatcaagttttggcattgccaaattttggtaaggttgccaaaattttgataatgttgctaaattttagcaagatttcatatgtacttactaaaatttgggaacaactaaatgtagccaatttttttggtaactttacttaaaaaaaagtaaggttgaaaatggtagcaaagtgaacaagccataagaaaagcatagtaattggataaggcagatagacatttccaagaggttaaacctcgtgctaactttccttcggaaatctccatgcattgaggcagaaatttccaataggattcaatggtgtccaatcttttgtttcaaggaccgttttgggcaaaacaatcatatagaattcaaatccgggaggggagctaaaactggtagtacccttttcagtttcccattgccctgcttagtttctttcaacatttcagtctgtagatgccctgaaaaggaggacatgcatcagcttcagcttcatgatcaagcaaaaaagatttgcaataataaataactgtaaaagaaaaggttgtaaaatggagttgcacaaaagcaaggaaatccatctactagctaggagttggccccattgatgaatacatgctggtcggcaaggtgaggtatcctcccctttccttcatcaccattaccagacttggcatgccttccatctcacgtcccaatattttactgctccatggattagccatttagcctatataacccagctgctgtgcacggcaaatttctcatccaagcagcaaccgagcaaggaagcaaagcacacagttcagcacaagtaaaatagcacaagcaaaatggatcaggcagcagcagcagcagcatctggctctcgctcccgtgtcctgtctgaaatcgacccccacagcgaatggattcacggtgacgagttcgacacgctcgtcctcgacgttacaggtatctcctcaattctgcgtctcaaattcaggttttgttcttagctaggtgttctacggaacattccccctgtagggagattcagttttcaaggcgatatgctagaaaccgaccgaaaccgaaaattcagactttctggactaagtcgaaaatacaaaatgttggatttttggtaagttagagaaaattaaactggattttaattgtttgataagatttatctggattacatcggtttttgttggtttatc

SEQ ID NO: 56644 - DNA, 9220 bp, Oryza sativa
tgttgcagggttcagcaaggaccatctcaaggtccaggtggaggcgtcggggagcctcaggatcagcggcgagcgcgccgtcaacggcggcggccgccattggctccacttcctcaagcgcttcgacctccctcccggcgccgccgacgacgcgtcggcgatcaaggtccagctcgacaagggcgtcctctacgtccaggtgcccggccccggcgctcccgccgccgccggcggcagcgacggcgagcagcagcagcagcaggagggagagatcgccggcggccgccgccgcgcggcggcggcgaggcgcggcgggcacccggcgtggcagctcgccggggcgctgagccggcaccggcaggtcgtcctcaacgtcgtgatcgccgtcgtcttgctctggctcgtcacgttcgccaacaaactgaccaagaacgagtgatacaaaccgcgtcaccctatgtgcaaacacaatcgctgcataacatggtatataccaacaagatatggatactttccagtgtggacgaggataaataatggaataaaatccctgtaataagcataattgggaagctcaggatattgattaactgtgctgataatttctgcgctgaactttcactgcttgctagccagagtgatgtcggaaatcactgagatgttctgagatgttagacaggaactcacgggggtgtggactgatgatatggagtattgtacaggattcagcaactactgtaaatctgtaattcagtgtttcttccaacaagcaacgcgcaaacaatgtcgacgaagatggacactcccctgttgtactatctgatagctccaagcagatttgcaccaccgagcttagcaccagttaattgctgctcaaaagaacacatggattaaattttagaaaacaatcttgaactactagaacctatgatgccacattcccacgttagatccatatcaagtaaattgcatcttgcagttgcatgatctaaacctaggggaagaaggtacacagaattattgaggttgtgcacttttatcctactagatgcgactttcctgtgcattcatatgtgaaacagaaatagataactggctgccatgaagtggagtgataggaagtagacatacagtttcacgtaaatcaacttcccgcaggtaagctcgctgaagatttgcaccttgcaagtttgaaccagacaatttagctccctgaaaaagtgaaaaggatactaatttagatttgtctcgtctaaatggcaattgttggaagagacaataaaaacttttagtatatcttcagtttccatgatgcacaacatgagagatagtatgcctgaattggtacagaggttattggacattgtcaaatcttactgaaggaaccattctagattagtaacacaaaagattatcagcttatcctgggaataaatgcatcacaaattcgcaatgtacaatttttaccttcagattggctccttcaaggttagctcctgtcaaattggcacctgtaaggtctgccctctgaaaatccatgtaaattgaagtattgaacaattggtgttaaaactgatcatgagaatcaaacagcattcaacttattataatatgtgtattgtaggtacaaataagttcacatacggtttctctgcaaagtgacgtacggggaaaaaggtatgtgcctatatggtgctacacataaaaaatgattggcatggatccagcatgcaagatgatatattagaatattagatgctacagaactagagaacaaaagaaagactatatatcgtaaatgttaatgttttttggcttcaggttcatcatcataaaaaaaaacagtttcctatattataagaaattggcagcagtgtccttgcacataataattaatggaacagaatttcagttagcatatagcagaaatacgcagcaatatggagtactgaacacaattttttatttccaaacctgcagatgtgctgaacgaagatctgtttcaatgaagctacattttaccaagcatgcatctgcagaataggctgaagaatttattgcaactactcatttgtttatattttgcagagaaaaggaaaactatgcaggttcaagcagaataatctgtgatcaagtaaaatgtgaaaagaatagaaggtcaagtaccttgcaggtttgcactttgtaggttggctctgtccaaagtagactcttggagatttgctcctacaaactcacacctgcaatttcatattttgtaattactaacagaacctccaaagtccaaaacatgaactagctaaaggagaagagaaactgaagggaaaggcgactctgaaatcttcttactcacgcaaattagcataattgaacgaagatcgagaagcttgaacctcctgcaaagaatacataggtgtttcacaaccgaattccacacattaccaattttcagtatttctcagttgaagcaaaaacacaataggaaattcatcaattaacactgagttgaaatatataaataaatgagatgtaaaaatccaaataggcaattcatcaattaacacatatgcaataagcagaatgatatcacactacaagttctgtacccgaaatttagctttgtaaagattggcaagggaaaattttgtctcctcaatacacccgcaactgaaatcaacttccgataagtcctgcagaacatagggaaaacaaggcacatacaaacaagttcaccgcaagtttacaagaagcatttcagtaacaatggatggcaaactacacaagtgagctttcccaagagcttacaagcttggacaggtcaaggccagaaaggttgacgcctcggaaccggactttatcagcctggatgcacttgatcacgtccttgcgagtcagctcggcctctgaagatcttccaatcttatcatcccaatcctcaatcctttcacttatgcaatcgatcaatccctagaggatcaaatcagaccaaaccaaaaaatcaatgtcaggttctcacacagcattggggtcaaaatccccccacacacacaaccagggtggcaggaggcattgctcatatacaggaagccggtagtactccgcctcccgcagcagctgccggtactcggcgtcggcgagcgcggggacggcgccgtccctgagccagttgagcacgtgccggaacagctccccgtcgcggtccacgaacacggccccatcctcctgcagcgacgaggtcagccgaggagattaggagaatcaaaccacaaccggcagcgaggggcgagcggcgtacggtggtggggaggccgtgggcggcggcgccggagagcgcggcggcgaggagcgacccgggatcccgctgcgtgagcgtgtccgccgtcgtctcgtacctgctgccccctgcatcggcggcgggctcgcgtgagggggtgagaccaatttttggatcgaatcgagcagaaacggatatgctacgggtggtggaagaggcggcggaccgatgttgaggaggatcggcggctgcatggcggcgagcggcgcgggctccggatctcgccgcgcttcgctcttgcggtttctatggcgcgcgccggcgctgggcccgcgtcccgccgcggcggcggcggcgggggaagccgagaagtgaggcgggtcgaggaggagaggtcgcgccggccgagccgagggcagagcacggtacgcgcagcagttgcagccactgcagcctatgatttcttgggatttttttcgaatggtttgaactttgaactttgaaacgataaggtgttttaggctgtgtttagttcacatcaaaaatataaattttgttgaaattgaaacgatgcgacggaaaagttaaaagtttatgtgtgtaagaaaatttcgatgtgatgaaaaagttgaaaatttgaagaaatattttggaactaaacacggcctcaattgtcttttcgttttgaaataattgttcatatcctctccaatataagttttagaaattcatttcaacgtaaaatagatatgtaataaactcggatctttagagattgtgagtgtgtgtttggcattaacaaattacgaagaaaacttcattgttttctatgtacgcgcttttctgaattgttaacggtatgtttttttaaaatatactctatagaaatgtttcaaaaatcatattaaccaacttttcaagtttaaaataattaatatttaattaatcatatgataatggttcacctcgttttaggtattcctcagtcttcttcgttccttccctctcaaacacaatcttgggtctatcgtactattgagagaaaaaaaatttggcttgtgaattcgacgtaataatcaatataactttatattattttgtattataggtctattatattataactaattgtgttttttataatgtcaatgcatatgcaagtcatatcctatattagcaaccatgattagggccactctatagcccaatgtctctttcgtttatctctgatgctcaaagatttaattcaaagggatttttgtctccgtacttaagtttctaatatttaataaagaagaatattgcttaaaaaaatttaggatcgatcaatgcttgaaacatatctataactctgaagaagatgtgcaaacgtagaaaaggaaaagagacgtcacgaaggtttatccaatccaatattaaagccttcgacaaacgaggtgtgactatacgtgactataggagaatgtaaagtattagccatacacccgtaccgtaattatgatataaaatagagtgatttatactttggatcacattcatatccaagttttagtttgaaccacccattatctcatatttttattccagattagatatttttacctttacaacgtttaggactatgtaactcttatgcttttattaaccacattaaacttctccttcgacaaagatgttagctgcacgtaaataaaggagattatcagcatgaaggtgtcgatatgttcgaggttattgatatgcgcatgaagagagtttgagtggtctaaaaaaagataaatatatagcgtagagtgaaaagatgaagtaaagagtggtgtagagtaaattttagataataaaagatagtacaaaatataattcactttataaaatataaatcttgttcttcaatctagtcaacatgtgaaagccaaagtgagatatatatgctgtacactacatcgaagatatacgtgagtgttattttgtggctagtccataagcaatagctattttaattttagtgtcatgttatatgatatctaaacttgaagctgaggttttgggagaatgctagctatcacgcgcctgatgggatcatgggataacaaaatattgggctcttttccaattgccggctcacacaagaggatggtagcccctcccaaccttcatcactatcaacaccgtttcgccgctgccagaaacccccaagtcatgtcaccactgctttagcgccaccgacgtggtttctccagcctgccaccggtgataacctcaagccctatcacccctgcttcgtcaccaccgatgccgtttctttggtctcatcctccgctagcagcaaagccgtattggagctctacagttcggtctactcctctctgttgccaccgaaggagaagaagaagccgtatctgactggtgtattttgtgattcttttttttatgtttcaaccaatgtattttgatgtttatttgtgttggatcaaaatgttgcagtgagaatttttatgatgttttaatttttgtcttcagttcttgtggatttgttgatgtttcagtaattgaagctttgatgttttgtgtatctagacaaagtgttttaatccataattcaaccgtgtttcatcacttaaatagtttgaaagctagtggtgaagcattcttctccaaatactgaaacaacgcctgattttgaagataaaatcagaagtccgatttgtagtttcctccatatttttatttcgaaaacactgaaattttagcatcacgaagttctcaccgagaccgacccgcgcgcttgtgcgtttgtggcactaaccaaaccagctcggtggtcggaatcggatcatgccgaagaatacccgactcaacccaaccccggtcggttcagttccgttccccttctccataaaacgcaacgaaacgaaacgaaaccccccaaatcccccaaacccccacgaagaagtagaagagagaaaaaagctctcatcaatcccacacccatggcctccacaaccgccgccgccgaggaccacaagggcaagcgccccctgccgccggaggaggcggacgaggcagcggctgcgccgccccccgccgccgcggaggaggagggcgagaagctggtgctggtgtcggacgacggcgtggaggtgctcgcgtcggtggcggcggcgcgggtgtcgaagacgctccgcggcatgatcgaggacgagtgcgccacgggcgccatccccatcgccggcgtccactccgacgtgctcgccctcctcgtcgagtactgcgagaggcacgcgccgcactacgacccggaggcctccgaccgcgaccgctacccgttcccgcccttccccgtcgagctcccccccaccgcctcctccatcaagcccgtcaccttcgtcgaccccgacgccgacccgcacggcctcaaggcgttcgacaagaagttcctcgacgtcgacaactccaccctcttcgagatcatcatggtataagcgcaaccacacccccgccaaaccttattctgtttttttctcccccaattggattgtgtggtctctcgattttaacaccgattgttgcaatttgggatgatttgggaggctgccaactacctgaacatcgaggagctgctcgacgacgcgtgcaccgcggtggcggacaagatgagggggaagaagccggaggagatccgcgacatcttcgagatcgagaacgactacacgccggagcaggaggcggaggtcaggagggagaacgcctgggccttcgaggactgaagggagaggaaggcttggcttgttctgactattagaagataggcctccacagattgagttctgaattactgaaaaaacttccatactggtagaatcaaattaggcatcgaatactgcaaaattttgctgtgagttgtggtggatgttcttctgatctggttcagatcagcacaaaacagttagatagagtaaatcggtatgcttattttatatcttgctcagcttcagtaattagtttatttttgcttggatggttctgcagctgtgagatgttctttacctgcctctctgctaggaattgtgaatctgttatgctcaattgctttgtcagggtatgatacgctggctaaatgcgtttgtgctatttctcgccgggcataaaaaaaatttcaccgggcgtgtttgtgttagtcgctgttgctgttcttggtgagttgagattgtcacctccagttttatgcctgctagataggctgcaggattgatgattaggtgtacatggaagattatggcagaaattaagttagcatcctgcaagttttagtgtgaagatgagtatttttagatttgttcatatcagtactaattgccttttttagccattcatctctgagaaatcttcgcttgctagtatcttgcttagtctggcagtgttatttctgtttgaatgcttgataccttctgcattctgttctcagctgtgaagtgtgcatttctgtgatgtttagtttgcttgatcagtatgttggtaccccggacacagattgatgattaggcgaatagagaagattatggcaggaagttaaccattctgcaagttttagtgttgaagatgtgtacatgtatttagattggtttatatccgtactaattgatttgtggattgcacatttgtgatcaagttagttttttgccgtttcgcaagttcatatctgagaaattttggattcctactaatcttgctaatttagtctggcaatgctttattttctgttggcatgcttgatgcctttgcattctgctctttgctgtgaattgcattttgtgatgtttagtttgattgatcagtgtgtttggtaccatgaaaacaactggtgtttgtttagtgcccaatcttgcttatagtgccttatctagttatctagccataccatcttgtgggcatgtatacatagaaattatacaatatgaatgttgcctgtacaaggctgtgaatgacattaggaaaactttgcgaattgatgcattcagagttcaggtggttcatacctggaaattatgaatacttgagaagtcacatgtcccatgagtgctataaaaggattgctttactcaaaatagtgcggatatagccatattacctgggcatttatgttctaagattttctggagtttgagtatatatatacttttgatatatattgtttttcaaaatgttggagtagcatgtttagttgacgccagttgcaacgcactgacactaccacctcagtcaagaataaaattcaagactattaaggaatggcaactttagctcaaatttctgagagctacagattacaattaacttgggcacttttggacaaaaaagttaaaggtgttatcaaatttactcaaattcgagttcccttttgctatctaaagcaagcgacgatcgatatgttggtggtagaaaaaaaaatccctcaaaaagcaaaagaaaaatgaaatctcactcaggtgtaaattgaaggagggcatttgtcacgtacgcttattatatctgcaacagatttcagagcaaaaaaccaaaacaccggcatgaaggggaagaacgggcaagtttgatcaccggcgtcacatgagccacgacgacctcagcaccagcgccggcgtccgcttgtcgccgtccatggcgatgacgaggcccggctgcaccctgccgcccttgccgaggtcgaagctgaggaacccttccacgtgcggccggtgcgcgttcctctccgccgtgccgccgatccgcaccccccacccgagctcgtgctccgggcagtcggacacgcagactccccaccgcgccaccggcccgcgccgcctcgccggagtcgccgccgccgccgtctccatctcgacccagccttctgctctcaaggtgtcgtacatgtcgcagtccaccatgacggccaccgtgtgcgacgac

SEQ ID NO: 56645 - DNA, 5343 bp, Oryza sativa
cgccgaggtcgctgaaccgggacgccggcgagcggacctgccacagccccgacaagctgagcttgatgtcgtcggccgtctcgtagctcaccttgccgaacgtcgtcaaccggttgggcacctcgtgatcgccattgccgccgccgccgccgccgccatgttcgcctggagaaccaaagatcagctcagctatggaggccctgaatcttgatcccttgatgctcacgccggcgccgcagtcatgacgctccgaatacgacggcggcccgccggacaacgctctgctctggatactctgcggcgaacagtttcatcgtcagacaaaagctcgccgccgcaaccgccaatactccagcgagctcagtggcaagttacctggatcaggctcgaaccgtgcaagaagttgttgcactgggcgccaaacgggacgagggtcatcgacagcaggtcgctgacgtgggcgcagtactgcagccgggtgagctccagtggcctcccgccggccgccgccgccgccgccgccccgagcccggtggcgagctccgcggcgacggtgtccttgccgccacgggtgctcgactcgaacacgaacctggagccgagccccgtcgtgttcctggccttggcgagcctgtccctcgcctgctcgagctcgtcgccgtcgacgaggagcagcgcgccggccgcgtcgagtgcgaccttcacccggacggggagctccgggaggtggaaccccttggcgctgctcgtgtacagcgcgacgaggcggtcgatctgctcgtgcccgtccatgtgcttgatcatgtcggcgaacttctcccgctgcagccgcttcatgatctcagcctgcaaacgcgagtgtctcagtgaagaaggtaatcgccatggttgctgatcgagtgtgttcgagctcacgatcgaggcgtacgcaccgggcggttgtggtggtggggatgctgctgctgcggcggcggccgaggcggaggcggatgccggtgagtcaattggccggagttgccgcggaaggcgaagcggaggagcgcctcgccggacctgagcaggctgcggaagttgtcggcgacggtggggatcggcttcggcgtaggcagcggcggcggcggcgacagaggcgcgggctcttgcggcggcggcggtggcagcagcagaggcgtggggttggaggaggaggcggccatggcgaggcggctgctcggaggcgacaggtggcgcggggtcaggtggatttcttctttgcttcgaaggggatttgagaggagtggagtactggagtgtcgctaggcgcttcgattcccgcctttttctttccttcacggctcccttgttcggttattcttgtgtgcctttgcctcttttggcttttgcttttgctttattacctttcatttttcgatgtttcgatgtattcggccttgtctaatctccatttttagtctcgacgtgctatttacgctatattaatttgtcttgacttgtatgtgtgtgtgagagagaaatgtagagggggtcgggggcgtggcatgtggatttcgattgaatttaaaggaaaaagtacgaattatcctctaaactatcgcggtcgaccgaattatccccctaaaccacaaaacctaatattttttatccccaactatgcaaaacggacaactaaccccccgcttcaatccacgttggttttggtcctacatggcaatacaatcagcaattcttttaattaaaaaatcggtggaccccacctgtcagctcccctcctatctctatcccaatctctctctcttctcactctcctcactagcacaggccacggcggcaccgaggatggcggcggacggcggaggcggaggcggaggtcacgcggcggccagcagcagaggcgaaggcagagctccccgggcagcggcgcgcggggacggccggcggtcggcgcgcacggcctgtgaggaggaacgcggtcgcgatggtgagtagcgcgaggaccgcggcagcgccggcggaggcgacctgagcggcgagcggcggaggtgaaggcggagctccccgggcagcgggtggcggaggcggaggcagagctccccgggtggcgggtggcggagacgaaggcggagcggtgcggccgacggcggaggcggagcttcccgggcggcgggcggcagaattggagctccttcggccgtgccccgcgcatcaccctcctactcctcgtcgttgtccatgcccggaccacgctgcggcgctccaggcctagcggcgccgcgcacgcacgaggggccactcggcggcggcgacagcgaccaacaacgccatggaagagggcgtcgacggcggcgacgcgggagcaagcgtgtgtggtcggtggcggcgaggtgacgacagtccggcaccgcatggagagggagaaggccgcgccggcgagcttgttcgcgcgggaccggcagccatcactactctcccttccatcctccctgagaccggtggccatcgcgcgtctcgtccccaacttccgctgcttttctccatccttcctgacctcggtggcctctggtggccgatgtcggcgagagacagagagagaggggacatggagaggctgagagaggatgagagagatctgacagtgggccccactaattttttttaaagaattgctgactaaactgccacgtaggactaaaaccaccgcagattaagctgggggggattatttgtccggtttcaatagttcgggtgtagaatgtctggtttttgagtccgagggtgtatttcggtcgacctcgatagttcaggggggtaattcgtactttttccaatttaaaacgtctgagttgacgatgagatttatgcatgatttctctttctttttttttaatgatcagctcgagacggcacgatgatttattgaatagaatatgaagaagttacaaggctagtacccctataaagcaatagttaggaaggaaaaaaaacactaccatgcaccgccagcacctacacataatcaaggagaaagctagcatcagactggacgccactaagcgtgatcgatcgccgctaaaccaacaaggccgtgagtagtagtagtttggctgttgctcttggtctgaggcatatatatgagaaccaacttttgtgagcatattgtgcatgcttgagcttatgtgaagcctcttctctcctctctagagtgcattacttacgaattgagagtggtagaggcattgtgcttgtgcatgcgattgagctttggcgcttggtaagagttaagtgggtcttgacttgttactcttagtgtttgctgacatctagagggcttggtggcggttgtgacccagtgacctctacaaaggagtttgtagaggaggcccggtggttgactgtgaaggtttggagctcacctatccagagatcggagaagagataccactagtgatcgaggcttgggagactaattcaggactggctcccgccttgcctatcccttgacgaaggggttcggaggctcggtggtttaagtggtgaagttgggctcacctcaacagtggcgtaggaagccagtaagcttccgaattccaaacatcgggtgaaaaaatcttctgtctctggtctcttttatttaatgccaatttactttgaacaagaagatatatgaaattgatgtatacatattgccccgaaaaaaaagatagtatatatatatatatattcaaaacaaaagcagtatgttatgatactacttttatcatggcaaaatagccattttcgtccctaaactatcgcccgaggctcagtttggtccctgaactatcaaattgtccaatttcgtccttcaacaattgatttcgaactcaatctcgtccgttccccttgatagcacgccacgtggccagctagacatgcgaaatgtccgtcctgcccctcgctcaattctttacatgttggatggctgacggcgtcgtcctcgtcttctctgttggtgcggcttctgttcgtcgtcgtcgccgccggggaggaagacccactagccgccggtccccagttctctttgcctcatctgcttcatccattctatctcgtccatctcccccatctactcgctcctcgtttcctccccgatctggtcgctccattgtggaggcggcatccgttgtgcctgtatccccatggagcatgggtccagggaggggagagtgagaaggtcgatgccaagaatgggagtagcgccgaatcccggagcatcgagttctggcgctcatggagctgcgcgcgcggtggaggtgagtacagagctgttggcgctggggctagggttgatttgaattggggattgatttgttttttgataaaaattcgtcgatttggtgcagcttgaaacattgcttgaagaacattcagaggggatgctggtgaggacagggcttacatgtcggcatggattcttcccaattttgtgttgttgttggtctggtccagacactggaagaaggttcctggcatgctcccaagttgagcagccctgtgatttcaagtattggatcgatgaacaatttgaaggtagagcaaaaagggtgattcaggacctagtttccatgaggcacagcatgtcggagctgtacgaacattcatctagacaatgggatgatatgtatgctgatcgacagagagtaaaacaacaaattcatgaactaaaatgtactattaaagaacaaagagagtgcattgtaatcttaatttgttttagcattgtaattgcttgtggtatatggctcattgtgtaaccactatttgaggcaatgtggaatgaattgaaaaacaattttaacatgtcttatgctcttgtccagaaacaaatttaacatgtcttatgctcatggttttgacataacaaatgcaagcgttcatgacatcatgactaactgatacaaaagcattattgctttgggactatatttggcaagctacatcatcttgttcttgaaattcagcagcccatttttctgtgatgagctgctttgggcagatactgatccacgaccaagtgaagttgaatggatttttgcagaggcatgcccaccttttacattgattgttgcctttgcaaatgagctagcagtcccagcattggtttcaatgacaacagaagcactccctccagcagatgccttcgccgatgcttgagcacttgacttcgcagatgcttgagaactctctccaaaagataccagtcttctcttatggccagactgtaaacaacaaagccaatttaggcaaatatacaaattacttaggctatagcatggacatgtcataattattacctaacctgtataa

SEQ ID NO: 56646 - DNA, 1480 bp, Oryza sativa
ttagcattgggcaaagatggactactaatcttggtgttgaaccattaatctgatataaattgtgttcaaaaaatattttctgcatgtaaattctattgaagtagccagagtcatgctggatatgcttaatgcttttaatccttcaataagcacataatgggacctgaaatccttaacttcactaatatgtcatatattatctttattaatatgcatatcttgatatgtttttgtccacttttggaacaaaaagtcactagttcttcccattttcctttggaaaagcctagaaaccagagcaaccctgactaacctcagatctgttaaaattgcagaatatggtggacaagataaaatcttcagtggcacttcctttccataatttctgtggcggtgcaaaatctccggccactagcattccattggaagaatcagtgcgtcctgaaccagaaagcatccagtatagtgatccagcttgtcagacggaagatgttatacagttgggcactgaaacagatggtccccaacccccagaaaatcacaataaagatggacaaggccaccttgtacctgatgacatggagatgtctaggtcccctcctgagcattcttctgctggtgccaagcaacgcttccagtcactcatcgaaagtagaaaccaacaacagaaccacaagccacaccaagaaccagaatttaaccaccagctgaagccttttgattacgctgaagccagaaagaacataacatttggagagcgtaagccgagagaatcaaagacaatgcagtggccagggcaataaacaaggattctggagataaaggtagaacctcaaaccaattcggtgctggagagaacgaggggaatcgccagaatcctcgggggcgacaggcattcccgccttctggcaacagaagtgctacataccattagttgttaagatgtataaccagagacattgtgttcttgtaagaggtattatgttcatcttagaggggaagtgtattgtctctggttttcatcgttagatacttagatcatggcaatcttttgggggacaatgtagcggctttcttagtgatctatcttgagagaagtaggaaagcccttctggctggtggtgctgggttttaactgaacatgattcagaacattgaggatacttataccagatattgaatcatttcagtaaagcacgcatataaaatatgcttgcttagaatgtggaaatttaagatgatttcattagtaaatactgctatcataatttccctcaaaaaaaaaatactgcaatcataattctagatttctagtgtagttcgtataaatatgtgccttagagcaggtacgatagcgctattaagaaaggctccaaaacttattaatcagcctaatacaaaattagggaaagaaaatcgctaggagagaaacaagcgggcgcttgtattagcgccggcttgcacagcgccccacgccgta

SEQ ID NO: 56647 - DNA, 3074 bp, Oryza sativa
aatccatgatattatcatcttgaaatagggcaaatacatcctcatctgcatactgtgttccagattcttcattcccacccatatcaactgattcggtgtatatatctactgttgtagcagttcccagctcatgaatcatgtccaaacatgacttgtcatctacaagtaacctcataccactattcaattctgcaccaatggcaaccagtacatcctaacagattgaggaaaagttgtgtgatccaataggtggccttcaagttcagggatagagatcttgtccttctctatgtgggacactccacaatccccattgcaatacgacatctttgactcatcaagaacaaattccccattaaaatgaaattgaacttccagtacctcaaatttagacattgcttcgtggccctatagatcaactatatggtcaaatttaaacattctacaatgaaatcaaactcaagtgcaaaactagtgaagtgccactctcttacctttgcagcacgtcctctcctcttcctgtgtcttggttgcctatgagcagtccgtctgcccaaggacaagggcacgcctccaccaggagaaggggtgcgcctccaccccttcgaacacgccgtcgtcctgtactgatctccgccccagcccccaagccaaaaccctaacctacctatgtagctgccatgacgaacagagaagacgaggatgagagggaggcaacggggagcctgaaacgccgttagccatccaacatgtaaagaattgagcgaggggcaggacggacatttcgcatgtctagctggccacgtggcgtgctatcaaggggaacggacgagattgagttcgaaatcaattgttgaaggacgaaattagacaatttgatagttcagggaccaaactgagcctcgggcgatagtttagggacgaaaatggctattttgccttttatcatcgatggaaaaggagtatagttgtttgaaaaaaaaagtggaaaaagtagtatctatcccagaaaatagtgcatcgtcggcttcgtcgccatcagcacggtgtggcaccgatagcaggaagggagtagcaattagcagctggcaccgtcgcctgaaatcgaccaagggacgaagcacgctgactagtgcaacggatcggctactcggctgcgcttggatgaagaaacgccacgatcattcatctctgcttcgatctgatgcatggttggttctgctagcacgccgccatgtcgtgccgtcgccgatcgatttaaaaaacggccgcagcagccgggggagcgcgagtctgtaagcaatagaaatagattaatggaagaactaaacagaagcttcgatctccatgcataaacaagaagcaaagaacaggaaagtacggaaggacatggcagcatagaatgttacggtgcccatcttcctggcttgatgagttcgattactccgttgcacgcccggcggaaggcaccactatcgcggcgcgcggacggcgccggtacaccgaggcacagcctagagtcacagcagagcagccgtccggcgagggtgactagcgatcgacgggatgaaagagacaccgcgccgattggcagctgggaacgcggtagatcgaactaccgccgccgacgaacttgctatttattaatgaaacggatcagtattgttgtgccttccgattaggccggccgggataattcagaattaatagaatttcttttcaaaaagaaaaggatcaaacgggtttaatataaagacccggtaggagggtgggatggattgatcggtgcttacctttgatggacggtggattagagtgggagtacatacacctgggtgtatagaaacattttccaatatatatatatatatatatatattctacatccctcccctaaaataactattttacacctccccttctatgggtcaaacccacctccctcactctccctagggcccaaaacccccctcccacctcggtcaaagccccctcccgccggtcaaacccgagtcaaaccgcccattgactctctaccccgcccaccactttgctgttcacgtctcgcaggacttccgcagtaacataacggttattgtgcagtaacatgacaactttctcgcagtaacaacatcgaaaaatagtcatgatggatctagttctcgcagtaacaacatcaaaaaatagtcatgatggatctagttttgttaagtatttttttacgaacatcatggtgcagacggattagaaaaatactatataacctgagagatattgctctctaaagattgagatttacttttttttaagttcttgtctcactgtaacggcgtagtaacgcgacgatcaatatgcagtaacatgactactttctgcattaccaacgttataaaagcatttttgtctcgatcatcgtgtagtaatatgactattgtctcgttgtaacatcgttttaaagtattatagtgaaaacggttctaaaaaataatttgcgatgtgagagatattattttttaaagatttcaattctaaaaattcacttatactaagcttgctactacgtatctttgtatggataaagagaagtacttttagcacttgtgttaacttgtgaccatgcacatacacttttttagcacttgtattttatataagattgagatttaaaaatttagctatgcgcaagcagtggtactgtagtagtactgttactaccatatgttctctgttactgcaatttcatcatgatgttactgtaaaaagtgcagtaacgacctataaattttgcagtaacggcctataaatttcacaataacgtatcgtgttactgcagttctgcgataatgttattgtcgaatcataataataaggtatgatttcctacagtaacataacgggtttgtgtttataaaatttgaacagatatacaggtgaattggttaggagagtttgttatgaaccatgagatcatgggttctagtcttgaattcagcaatttatttttattttttctcaaaaaagaaaagaataggtggaaaaataagagaaaggagggagaagaaaaaaaaagaggg

SEQ ID NO: 56648 - DNA, 1371 bp, Oryza sativa
tcccttctatacccctgaattttgctcaatcccttacatacctctgaattttagtttggatccctttcatgctctttccgctagttgaccgttagttgaccataaaattcttttaaaaaagtccattttgccctttgctatgaagaatcataataaattaatgaagtacattgttagaatgtaaaaatttattggatgagactattatatttatgagtctgtgatgcaccatattatttgtgacaaatttacttttacatatgatataaaaatttaatacttatttattagttattaaaagttttttatgtagcatatgtgttttcatagtaatacaacatatttgtttattactatcagaacacatatgctaaaaaaataaataagtattaattttttatgtcatatctaaaagtatatttatcgcaaataatatggtgcataactatctcataaacatattagtctcatataacaaatttctatgctccagcaatatactctattaatttatatgcttctttataccaaagggcaaaatggactttttcataagaatttaacggtaactaacggtcaactagcggaaagggcatggaagggatccaaactaaaattcaggggtatgtaagtgtcacgcccagaaatttagcctaaatttccagactattttgtgtattaaatccctgttcaggaatcagccaaggtatataaaacgacaagtaataaacagttccaaacgtaaataaagcgtaaatacttacagaagaggctcttagtcctcacaccaaaaagaaagcagcagcagcggaaaaaggcgatcctagcggggattcagctccactccacaggcaaaactcaactgggtctgagccttggttctctaactccatcttcagctcagaagcactacacttttgaaaagggggaaataatagcaaggctgagtacaaccaccgtactcagcaagccacaccaaagatgcagacgtgcaagggacacaaagatggcttgaggctatttgcataaaggcggttgtaaagcattttattgagcaaatcagtaaaacggttgagtcatttaaggtaatattaaatctccactgatcaacgctacaccacgttgaacaggcccaaccaacccacatgaactacagtgcattggggcgatttattaagtgtgagactaatcacggttgacggagctcgaggctcctcaccgggagaccgcgcaggcccccctttgccggttcggccgggggcttagggtgagatcccaagctctctctctctctctctgtatgtggaaggatcgtcagccagcaagaaacgcgagacacggacgatctatacaggttcgggccgctcggaa

SEQ ID NO: 56649 - DNA, 13574 bp, Oryza sativa
tgagcagcgcgcgaatctgggtgagcagatttgtctcacccggagatacggtaacgccgcttcggtcggcgagcgtaattaacgcgcgcacgatacaatccattttgattgccacaaccgcatatccacttcatgcgccataagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgaggaaaggatttgcttccttcctttcgccattgttcctcttgccttcgccgcctgagctctaactctttctctgccacgccctactttcgccacacgcgctcgttctcaatcatctcttcctccaccgccatggcacggggctctgctctgctcgacggcagtgtattaccgccttcccgcatcgtgaacgagaggcacgccggactgccgcgccgcttcatgccggagtccgccaccggtcgggagatagtgatgctgggcgaagggcgcccggcaccagactacccggggcggtccattttcttcctccccttcgcaatggctgggctggtcccgccattttcctctttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgcggaggcgtctcgcattcctcaggagatcctccccctctgcagcgatcccgaccgcgcctccattctaaccattatgatgggggtcggggcctcagaggagagagcccctaagggccacgacggcgccggcgggggccgccaggaagaatcagcccccggagggggccgtgcttctgggccccgcgacgggggctcggggagcaaccgccctgccgacgcccgggggaagaggaaacaaggaggaacacctcccccatctcctccccgagggggcggggcggcgcgtgccagcagccggcgcccggagggggccgcgccgacgtcgcagcccgagggggagcgcaaaaagaaacggctccgcaagacgggggagacggaaccatgccggggaaatctgatttcccctccaaagtggtcattcaaccgaccccctcgcaggttcgtctcactctcattgcaaccatctttctcccaaaagtaagtttttttcttactcattttgttcgtcttctggttttttcttctgcttcagcaatgtcccgtcgcattcctcccgccaccccaagtccggccggtccgaggccgaagatccagcggccgcagaggagcggaggcgagaatctgaccggcgtgaagccgcagatcgccttcgggaagctgaagaggccgctcgggaggccgcccgggttcgccaagcggaggaagctgctcgggaggaggccgcccgggctcgccaagccgaagaagctgcccggaaggaggccgcccgggttcgccaggctgaggcgacagctgctgctggcgcgtcacttgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccgagccgcatcgccttctctccaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcattgctaccaccgcgatgatcgaggcgcaagacaccctccgccttcagcacgcaagctgggaggcggagctgaaggaaaagctcgacgccgcccaaggggtccttgactccgccgctgtccgagagcggcgggtaacggagactgaagcggcgtctcggcggcgcgaggaggcccttgaggcccgtgccatggcgctggaagaacacgccggcgccgtggagaggggcttgacggaccgcgaggccgccgctggtctccgagaggcgacgctggcggcgcatgaggccgcctgcgccgaggaggagtccgcgctccgcctccgcgaggatgcactcgctgagcgggagcgagctctcgaggaggccgaggccacgaccagacggcaggcggacagcctgtcccttcgcgaggcggcgcaggaggagcaggcgcgccgcaatcttgaatgcgtccgcaccgagagagccgcactggagcagcgggctgctgacctcgaggcgcgggaaaaggagctggacgcgagggcgcatatcggtggggcggccgcgggcgaaagcgacttagccgcccgcctcgcagctgccgaacacaccgtcgccgatatgcagcgagcgctggactcctccaccggggaggccgaggcccttcgcttggcgggcgagattgggcccgacatgctttgggatgcggtctcccgcctgaagcgcgccggtcggcaagcgggcctctggaaaggccagacgacggtgccccccaccaatctggaaggcctcgctccgcacctccacaggatggcctgggttctcgaacaactccccgaggagcttgagaagaccatcaagtcatcctcaagggacctcgcgcggggagcggtcgaactcgtgctggcgagttaccaggcccgggaccccaacttctctccatggatggcgctggaggagttccctcccgggaccgaggacgacgcgcgcgcgcgggtcggggatgctgccgaccacatcgtcaacggcttcgaggggtcggcccctcggcttgctttcgcccccagctccgacgaggagggcgacgccagcggtgaggacgacggtggcgacaaggccggcgacccgggcgcgttggaatgagcccccgagcccccgccaatctccaattttttcttttcctttcttctaaggccttcatgcctcttttgtgtacaaattaacttaatctgcaatcaaaaatgatgaaaaatttctatgttaacttcattttgctatacatatgagttgaggatgatttgtgccgtggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgtccgaaccgaacccccgagggcaaggttgaatacgagtgaccttattttaagttaagattcttcagaaggaaaaacggcacagacacaacctttaggaaattggaactgcttttattgaaatgctgaaataagaaaagtaagactgtgcatgtgtggtagcccccggctaaccctgcacacccgaggggggtgcggggttagcccgagcccaaaacctgacactcgaccccccccccctcctcaggggtagaagcgacgaaggtgttcgatgttccacgggtttggcagctcagtgccgtcgcccgtggccagccgtacggagcccggccgggggacgccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgttcttctaaatagtcgaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaacttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccacgacagtggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaagggatcgggtcgcgccgacggctgggtaagcctttcttcaaaggcgcccggtggggtctgggctcgcgaggacgcgagccgtgagagttcgtcggctatcatgttatcccgtctgggcacatgccgaagctctattccatcgaaatggcgctccatacgccgcacttggcgtacgtaggcgtccatctgtgggtcagagcaccggtactccttacagacctggttaacgactagctgggagtcgcctaataccaagaggcggcggatccccagtccgactgccactctgagtccggcaaggagtccctcgtactctgccatattgttagtcgctcgaaagtcgagacggaccaaatatctgaggacgtctccgttcggagaggtcaacgtgacccctgcaccggcgccctggagagacagagaaccgtcgaactgcatcacccagtgggcggtgtgaggcagctgagaggggttcgtgctggcctcgggtattgaaacggtctctggagccggggtccattctgccacaaaatcggcgagggcctggctcttgatagcgtggcgtggttcaaagtgcagatcgaactcagaaagctcgattgcccattttaccactcgtcctgtaccctctcgattatgcaagatttgaccgaggggataagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacccttcggtggggccgatcctctctgctaggggccgtatccccggggcgttcttcgtccaagtggcctctcggggcacactcgtctcctgcgctgatgacctcggggttcgaagatgacaggtgcggccttcccacagtggcctcggggccgtcctgggggtcgggggctcctggcgtcgtcagacacgcgggcaaagggccagctccgatcgtcaggggcttcaggcctccgttcggctcgggggcctcttctccctgctctctcccgggtcgaatcagcacagggttagcctcggggtcaaagggtggtaggtgcggccttcccacagtggcctcggggccttcctgagggtcgggggcactcagcaccgtctgacaagcgggcagagggccgactccggtcgtcgggggccttaggccaccgttcgactcgggggcctctcctccctgcctgctcccgggccaagtcggcacagagtgggggtacgcagaatgaggattgtcctcatcgcgctccacaaccaacgctgcactaactacttggggggtcgccgctaagtaaagtagcaggggctcatttggctccggggcgactagaactggaggagagctgagatacgccttcaactgggcgagggcattttcagcttcctccgtccaagtaaacggccccgagcgcttgaggagcttaaataagggtagcgccttctctcccagcctcgatataaaacgacttagggcagccatgcaaccagtgacgcactgcacatccctaagtttgctgggggggcgcatccgctctatagctcgtatcttctcggggttggcctcaatgcctcgggcagagaccaagaacccgagaagcttgcccgcaggcacaccaaacacgcacttatcggggttcagtttcatgcgggcggagcggagattttcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaacccaaaaggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgcgtggtcttggatgggccgtcgcccaaggcaacctccttgaccgggacctcgtcgcatgtgacgatccgttgcctcggggcggtgggggcagaagggccaagcctctcgtcaccaccctcgggcttggacgcagcagcgaggcggtccgcgcgctgctccatgcaagcgagcgcgactttaagatcgccatggacagagatggggccacccgggcccggcatcttcatctggaggtaggcgtagtggaccgccgccatgaacttcaccaacgcgggcctccctaggaccggttgtagggcagactgaggtccgccacatcgaagctcacccgctccgtgcggaagttggcgggtccaccgaaggtgaccggtaggtcgatgtgacctaatggccacgtgtgccccggcgtcacaccgataatcggctgggacggtcggagcaccatccccggggccttgatggcatcgaaagccgcgggggaaaggatgttgagggccgctcctccatctacgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgagtaggggccatggccagaaactctcgcttcatagccttgaagctccggcgagagacgtgagcacacgctcctccatcgacggtggcaatggtggccccaggttcttggaaacctaggtcatcatcgccgtcatcgatgtcaacagcgggggccttctgcttggcctcacttcgccgtttgccggaaggatccgccggggacttgccctcacggcgttcctgcctcctgtcctcctcccacttcctcgttcgctcagctaggtttttgactgcacgacagtccgcgagatcgtggagggaggtgttgtggacggagcaccacctgccggcggggcgctccctgctgggagtaccagcctctttctttttgtcgctcgcaggcctcccctttcgagtggcccgcggagcgccctcgacggcgaggacatgaccctcgtcgccggaacggtctgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatagtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacaccctggacgaagaggcaccctccattgcgcggggagcacgccgatcactacgtcggcgctcaatgtcgaggcgggcatccggctccccatgctgatcctcccgagtcgaaggtgtcgacgagggagtggcagccgaatgacgtgcagccgccgccgctcgccgtgccctccgtcttgacgacgcggaaccggtagtggcggcgcctgaggtcctggtggtggcggaccgtccgccagcacccaggcgttgctgcgccgtcatgaccaagttggccacgtcgtccagccatcgctgggctggagactccgggtcatggacgacaggcgggtgtcgtaggagtgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtggagtacgagctcgacggcgtgggtttggctccccgtcgtcgccgctcacactcggagagaggtcgtgcgcctttgcttgctcagccattaggttgaacaagggaagcttggtgcacacggaagagtatgagagctcagaaaaaacacgctgagccccctacctggcgcgccagatgacggagctcgaggctcctcaccgggagaccgcgcaggcccccctttgccggttcggccgggggcttagggtgagatcccaagctctctctctctctctctgtatgtggaaggatcgtcagccagcaagaaacgcgagacacggacgatctatacaggttcgggccgctcggaagcgtaataccctactcctgtgtttttgtggatttgtgtatggacaagttacaaagtgtgagcccacctctccctcgttctaggctctgaatctggaaagaatcaacccccttctctatgggcaaggtcctccttttatacttcaaggggataccacatgcacccttctctttccaaactggactgttctttttctctttaatgggcggagatcggtacggtttccatccgggagcccttctgatgggacagcccacacctacctccactcccggcggagacggagatgacgcgggatcgtggctgcccgttgctgatgcgaccagtgtcagaccggtcattcttgtcccccacgcgtcagtttaacaacgtgcatgtttgcccttcttcgagtaacaccttgcctgtaatggttaggatgaagcctggtataaatctaaccagggctaacgtgccatctcttaaggtataacacgctagctccggtttgagacgagtgcctagaggctttcgtcttgacgggatggggcaaggcgtgcgtcagaccgccagtcgccacctaacccttgatctgaccggtctgtgactggtcacagaccggataaaagagcgtgctgtactgcgctgcatgcagcgtgacacgcttgaccagactgcaataaatgctgttaggtgagcacagctgtgctcacttatcccatatatgtggcgcagacttccttaaggggtcggggtgccccggccctcggggccggggcaagcgcaacccgaccccccctcgggggaaatcaggaggagggcggacacctcaccctcgggcccgacgttcccgaaggtgccaggccacgtgggcgattgcgtctgcctcaagcctctggtcatgatactcccggtcccatatcaccgacaacggtgattctggtcgatcgcccataaccgcgggcacggctattcgaatagttttactctagccagaggtgcacaactgtacccacaagacacaatccaccggcatgtcaccgtgccaggccagacacgtcaccatgtcgagtgattgtgacaagacccttcatataaccccctctgaccaagcacacaacacctcaggtttcacccccgcccccggcaggcagcgggcagtcccctctcgtgcctaggtaaatcagaaagccgcataggctgtcgtagggcccatccgaacttcatcacgctcacccttgcctggatgcgtcagccagcggaaagctatacttcaagtcaggcagttacccattcccgcttgtggcaagcgttgtatgtcttccagtgcatcccgcgaaccggtccttaattgccatgggtgcgaccagcaacaccatgcacccatagcccaccattcagtcgcattttagttggataattacgaccatgaaacatggccaaatgtctcgagcacgcagctcgttctgatactaacaaggtctaatactacaattatcccatcaactgagttagtggcaattaagcatggctaagcatatagttatagctaggtcaacatagtaacacaagctagtcgatttattatgcaaggttgacaaaggacagatatcaagtaaatatggcacaagcgagcagataggtaaaccccgatcccatggaattagcaaaacatgcatatttatttgcaaacggtaaaacatttgtaaagtaggatcaaaatgctcaaggggaatgtgtgacttgccttgcttcttcgaacaatcttccgaactcttatcctcgcgaccgcggacttccgaaacgacggattctacacgctggcatacaaaacgaggaaaaactctaataaacaccaagcaaacagtatatcaaaagtaaacaaacatgtagagctcaattttagatgaattttgcaagttgaatggcccagtttggagttcatatgaattagatatgaattttagaagttttgggccatttaaatgaatttctagaattaaactcgatttattgcgaaattaataaataatttctcaaaggaaaaaaagatttgctgatgtcatcaagggggaggggtggcgccggcaagcaggccccaccggtcagcggcacaagggcaccagaccaccgtggaccgggaccaccgaggtggtccactggaaccgatgccccggatcggccctagccgatcgggcggccacgaggcggcgtagccgggacacaggcacggcttagactggcccgaccgagcgacggcgcgcggcaacgcggccaccggcgacgacggccggcgacggcgcggggagcggcggcgcatgcgggcggcgacggcgcacgctagggagcggcggcgcgacgcggcaaggtgaggcggcagccggctgcccgacattgctggcagtggcacggcgcggagcgcggcggcggcgacccggtcggacggccaccggcggcggcggcgcgtcacgggcaggcccgggaggctgccggcgaaggggaggaagagggagagggaggggagtgctcaccgataggtcaaacagtggaaggaggcggccggcggcgagcaaggcgacggtgggcgcctcgggatgacggtgggatggcactccggtgattcccggcgaagaccgcggcgcggcaagaaccggcaggacctggggaaggtatagaagggagctggagtgagggagatggcgcggaacgacggcaaaaggcggcggaacccgacgggaaaggccgaactcaccttgagcagaggggagggattttcggcggtgattcgcgaagacggaggggtggccaacgcgcagctcaacaccacggagacagagggggcgtcggcgcggccgaacgtggctccgaatgccagcggcgaccggctggtggctggggtgcag

SEQ ID NO: 56650 - DNA, 5386 bp, Oryza sativa
  unsure (1)..(5386): unsure at all n locations
tgtcggggagggggagcgagacagttggaagggggaggaaaagcaaacttgagggagatgggcctatgacacgagagtgggagagagggggcgcgggccgcaggagggggaaagggacttgggtcgaaaatggcccaagggggatggagggagattttatttgttttctttttattttatttgattatatgaactttgtattgttataattatttcttgagctctgaaaattcacggaaaaatccggagagtatattagggcacaaagaatattacaaaatattcccggccaatgatttttaaaggaaattttaatttcctccataatttcaccaaattaaattgattaaatttttatttaatttatagaaaatgcattattaaatgatttttattcccgaacgaaaaccggggcgttacagtaagggattgagcaaaattcaggggtacataagggattaggtgaactttcagggatacacaggggattttctctaaataaaaacagagaaacataaaaagtaaaagctttcatgagagaaagagaatgtatagcacaagacacattgtaaggccccatttagttccccaaaagtttttcccaaaaacatcatatcgaatctttgaacgcatgcatagaacattaaatatagattaaaagaaaaactaattacacagttacgggggaaatcgcgagacgaatcttttgagcctaattagtccatgattagccataactgctacagtacctacatgtgctaatgacggattaattaggttcaaaagattcgtctcgcggtttccatgcgagttatgaaattagttttttcatttgtgttcgaaaaccccttccgacatttggtcaaacatccaatgtgacacaaaaaatttcatttcgcgaactaaacaggccaagtaaaaaaaaatcattataggaattcgattcgacatcctacgctctgccttgctcagactagctttgagaatggaaataagggggtgtttagattcaggggtgtaaagttttagcgtgttacatcagatattatatagggtgtcacatgaagtgttcagacactaataaaaaaactaattacagaatccgtcactaaaccgtgagacgaatttatgaagcctaattaattaatcattagcaaatgtttattgtagcaccacattgtcaaatcatggagcaattagccttaaaagattcagctcgcaaattagtcgcaatctgtgcagctagttattcttttagcctatatttaataattcatataggtgtttaaacgttcgatgtgacatgatgtaaacttttgaggtgggatttaaacatggcctaaggctctgtttctttcagcttgggattattataatccagattattgggagtaagctgaaagaaacaaataatttattgaagtagtttattataatctggagtctagcttattataatctgataagcttatttaggtgagcttttttcagattattgggtgaaaaattacccaccatgccaccccactccctctttagacttgcaaacccaacaatctaggctttaataatttaggaaagaaacaactaaccgcttattctactgtacttcctccgtttcacaatgtaagtcattctagcatttcctacattcatattgatgttaatgaatctagctagatatatatgtctagatttattaacatcaatatgaatgtggaaaatgctagaataacttatattgtaaaacagagagaatagattataacaatctagcttatagtaatctgacttaataatctagattataataatcttaaactgaaaaaaacaggagctaactctgctcaatttttctttcccttaatagtacccctatagttaactccggtgggtttagatttagacttttccagataatgagcgagcaaattctcaatcgtgccgactgccgaccgctgacacgcaaggccaggaaaagaaaagctagcaaccgttctataataattgacgttttagacaaggttaagatcaaacttttataattttgactattaataacttcaaaagtaaagtatttagtttaaaaaaactagaacaagatatataaatttgtctttcaaaacactataataaaagttaacatgcatttatttattgtgtatattacaatagaaaaataagatcaaaggtatatttcgtagaccgtgttattatccaaaatatcaattaaaatgaaactggagggagtagtacattgccatctgccaatgcccaatgggctagcaacaaaagaccacatagtcttggttgaagggatgctgcggtgcagattagagcaggtacaatagcaggctataagccggctataaccatatatcgaggagaaaagagaagagagagaagaaagcggactacagatttatagccggctgcaacacagactctaagatattatgtgtgtatgagaggtgggatcagatattaatgatgtagtatatttttatagttaactattatatgaatgggctattagattggctataaatattttggagacagtagttggctatattattggcgccttgctcttagagcggacggccgcccgtaccgactcccgcgttccgacggagcacggggaattcttgcttccaacaccccagacgccgcacgcaagaatcgccaacctctctctcacgcgcaccgcgcacacggcacacgcgggatttcctcccctcaccgacacaaacgcaaccgcgcgccgaggaaaaacccccggaaaagccgacgtactcatccaccacccgtccacccgccgtctacgcctacggcctactacgggccaccaccaccacccaaccgcgcgccgcgcctgtctccgcggtttccgcttcgccggcacgccgcaacgccccccaccaccaccacaatctcgcgctcgcggctcgggtcgggagcggcgcacacacaccgccaagccgagagccagagaccgtcaccaccgcgcccaccaaaactcaccaaccacgaacacgcgtactagtactgcacgcgcccactaccaccaacaccaccacctgaaaaagcgacacgacgagtccgtccagccgacgcgcacggcgctagccagcggaccccacctgtcagccacatccccccggtgactgcgccgtcgcccgccgtcagatccttccgcacgtacggccgcgcccgcgcaacgagggcgctgctgctgctgggccccactgcaggtgggcccgcccgtctcggaagtttggggggggggaacgcgagaggtggggccagcaatgaatcctggctcttcccggtggggcccaccacgcccgcgcgccgatggccccgaggcgagacgagagtgagtttggcgccaaaaccccgcgaaaaattttcggtttccctcctctttccccctctctctcatcccagtacaaaaccatctcctcgatactctctctctcttcccccactacctcctcaaccagcccactctgctattccatctgcgtgagagagagaaagaggggaggggagagagatttgtggcgtcgtgggtgctcggttgcggcggttaccgcggggaggaggagggagttgtgctgttgggggtttggatctagagcgagcataggatgggagctgctggctcctgagctgcgccgcgcgttgccctccggtaaatcccgcctcaccttcaaagagatgctgttctttcctcggttgatttctccttctcgcgctatcggttgttcgttgggttgctctccgcggctgggagaagattcttgttggtgagcttgttttgtgggggatggatagatggataggccggtggcgtgcgatttaggagtggacgtcttgggttcttgctacaggcgattttcctgatgcgtgggatgcatatgcgtgttcttcctgaatctgtggcatttactgtagaatggggataaatttgcacagtagaaagcaaatattgttagaccctattttgctgtagtacatttcggcagattgggaggattggtgttcgttgcatgcaattcctcccctggaatcaatccgtttggttgctttatgctgttaattacttgatctgttatacttcatgtaattgggtggtctattattgttcaacaataaattggagccttttccaggattacttagggagccatgcatttaatcgatgataatgattattgtgatcttgaggattcgcttcaactgttatctgatgctgttcattaagcaaagcgttttattgctacatccctagtaatactgaatgatttgctccttaaactcttggcataaatatgactgccttcaatgttcacgcgctaaataaaatgttcagtttttttgtcaagatgtcccgttaagcttcaagtgtgaatgatctgtactgttcagattcgaatttttggcactgatgttctgctctggttcattcaggtaccatgcatttaatttatcccctaatctggtaccgtggtacattaaactacacaaatgtccagatgtctttgaatggatctgatgaatcatcagtatgaacttgattgataccatgctttgtataactatgttatttaatcctgccaatttcttcaagaatgtgagatgtgccaccagccactacttaaggaaaacattcgaagtgcttgtaatatgaaaagggactgctttctttgttaaatatagtgtatatacacagagcatttgtcctctttttcagtgttttccagtttagtaaattctcagatggaattttacccaaactctctgattttgtaaagagcaaagctccccccttacctttcttccacctctatttagctaagagaactgtcctgattcctgacccaatcttgctagtttggctacaataggccattttttttgctttatattttgttcctcttacaaagaatgaatcttgctatagagaaggctctgcctgaatttatattatttccttaagacaagttatccgtgttaagtgttctttttttctactgattgattcagggagatgaaattcgataagaatcaaagcttcacaacatctactgcgaaattggataggaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56651 - DNA, 2127 bp, Oryza sativa
tccgttgataggctacccctgtcagtgagctgtacttcctcccatagaagacgtatatgatggcaccaaccgctagccacatcgaaacacgaatccacgtatgaatcctgcgaacgatgaatcaaagggtgtgagtacgtgtgatatcagatatgataatatccagatcgttttcagaagttgctaatctcacaactcacaagtataggtttagatagttcattctattttaatctatccagatcatctgtttacagtgtattgtgaattgaataatggtgattttggtttcatgattttgcaaatctactagataatataataggagacggtgcaagcttcaagatgcaaagtaaatcagagcaaaagctaatcttgaacccaagttgctcacccaaggttcataagcaggtatacgttgatgagaatgcaacatactggaagtataggaacaaatgggcacataaaacctgaggaacaaaggagacaatttgatgttatttgtaaactgtatagatcagaagttacataaattttgtcaatttcgtagtagtataatggccatagtctttgtacctccggtttgtcttaaagagctcttgtcttgcccaatgaaccagagtgcaatggtagcactaaccaaaagcaaactaccaaaggcacctgcaatggatcgcaaaaatctacagaaaggaaacagatcaaatgagtgggtgtcaagagcaagtcaaaaaaatttgcagtgggtggtttcattttcacttacaacggaaaaaaggagaaagaaactgaagaaacaatggtgacaaccccaagaaaaattagtataatgcatgctatggctttctgtcgccttatcttgttggcttcattggcagtaggtatgtcttgaactgaacgcattaagaagggggaaaaaatcagaaagttagtaactatgaggctgttatacaaagtattttgaaagtgatgaactaatgacaaacagataatacattaatatcatgcaaaggcaattgagaagtgggattacaaccataaaacaaaacaatactaaagaggagtcatcttttttatcaaagtatcaaaccccctatcccaaaaaaaaagtatcaaacacccaatttatgttagtagaggcaatctggtaaaggcaaacaggaagcataagaactaaatcaggcatgtgcagtacttttgatgtttaattagatacttcctccgtattttaatgtatgacgccattgactttttgaccaacgtttgaccattcatcttattttgttctgggaagattgttggctgcagggcacttcaatttggtcactggcgccggcagtatgggcggctgtcccaggccgcttgcggggcaagcgcacggtggctgaggcgctgcacgacaggagatggattcgcgatatctcttcggcattgggggtgcaagcgatccttgagtacttcaaattttgggcgctccttcgatcagtgcagctgtcagaggagccggacaggctttcttggcattgggagaactcggggcagtactcctcccgcttggcttatcgtgttctcttctttggaagaactcacttccaacacaagccaatctggaagtcttatgcccctcctcgatgtcattacttcctttggctggtcgctctcaaccgatgctggacggtggaccaccttcgaagttgaggcttgtcgcacccggatcgctgccccctctgcgatcaatgcgatgaaacgattgatcatctcttggtcgcatgcccagagtcccggcagctttggtggattgctcttagcgctattggtcattccgaatgtctaccactcaacgagcagtcctgccatacttggttgtgtgacagtcgcaaaaggatgattaaggatcatcgccgagggttcaacacaattgcgacactggtagcgtggacaatctggaaggaaagaaacaatcgggtcttcaaccagaagagcaggccttggatggagatagctagggctatgacaagggaagcggacctttggcggatgactagatcagccataccggccatggtagtccattcgtttgtacatgggtcgccaaatccttcgggagattaggctttttttttcttt

SEQ ID NO: 56652 - DNA, 2248 bp, Oryza sativa
gcaaatataaaagtatttatgtcatacttaaagaacatttgatgataaatcaagtcacactaaaataaatgataattatataaattttttaaataaaacaaatggtcaagcgttggtcaaaaagtcaacagcgtcatacattaaaatacagagggagtaattcatttgtcaataatgatttttatcttgccactagtgttaagtaaaatcaactcaaggtatacaaatcactagtattttcattaccgttgcccaaaagatcctccgaattttcctcatctggttctgaatacccagagtctgaagttagtgattcagatgaacctggaagagccactttcgttgctatctcatttggaggagcatatcgcactattaaaacagaaatggcaaccatagtaaatgccaatagtgtgcccacgcttacctgaacaaacaatcaagaaattattactacctggagtagctctccactcagcaaagctaccgtattacatggcaagtaacatattaccatccctgccaattctgagacgtccatgaaaagagccaggatagcagcacatatccctgacaatattgtgctcaaggttgggacttgggtcgttggatcaacagctgaaaagagtggtggaagcaatccatctcttgccatagccatcacaattcttggctagccaaaaggcattggaagtaattagtcagtttttttcctggtgtaatttggatgatcatctatcatatataaacatgagatggttttttaaaaaataagctaacgttaagaagcttaacttattacattttctagtcaagctatcagttatgtatcctgtaggatgagaaaggaattcaactgggaaggagatatacagatgctttagtttctcaattcacgtagacacatacctgagggagaatagcacctatcaaggatgctataagagcaaaaacagccccagtggaaataatgtacctacataataacagagataattacatggatgcttaacactaacatatatacagcatgagatgataatctccttaatagtcaagcaattcgatttaaatatatatatatctagtacttacactgcccattgcattccatatttagcaaaagcagatgaaataggagtgttaggatccaatgcataatatggcaccaagccaacaataacaatagaaaccatcatgtagaggaagcagcacaaggacaaggtcagacacattccccatggaagatcacgttggggattcttcacctgaaaagtaccttgacaaataaagataattgtgtaactgcagatttataatggccttccctgaagtaccagactctggatagagttaacaccaaataggaacataactaattgagtaattttcataaaatcgcaatatctttggtaaacaaaataaaacacatgtacgtattcaagcgaccattctagcagagcagttcttttacatacatttcacgaaaatagacttgcatggctattgtattgacaggtcggatccactggatagtctcacaagcttatccgttttagtaaatgaaataagtaagcttgtgagaccaccaagtggacccagacgtagtttagtgaaacattatgcaaaaggaagtatggttcttgtgatggttttaccacaaattttgcagttttgtgaaatttgctcaaaacaaattaattaataaatagcagaataaaagccaacctcttcagctgtgctagcaactgcatcaaagccaatataggcaaagaagagggttgctgatccagatagaacaccagccacacctttagggaagtaactacataccaaccaagcaaatatcagagctatatgcatatggaattctgtattgaaaatgtgaagcacaagtcttagctttacccttgttcatcattatagccactccagccattctggaatgctaagtatccaccagcacaaatgacgaacagcataactataacatttgcaatggtgatgatgccttccacaaatgaactctgagagggcatggttcatacttcagtactacagaattgtaagtagtaggtaattcatggacttcaagctatgcatagatatcgaacagcacaatttacctccttaattcccaggcaaagtaatgcagtaactatcaatacaagaatagcagcacaaggatcaagcggggtttcaaaccatttaacatgtatttgtgttaggaaaaagggaagcttctcat

SEQ ID NO: 56653 - DNA, 1164 bp, Oryza sativa
aagtaatcggacagcgagaagtcaatactccgatcaaactagtgatcttactatctatctgagtagacattctcacattcatatgatttgccaattgccagttgacaccaacgcagcatgccattaggcactaggcacaaactgaaggaggagagatactagtagattctaagaatgcattacgcattgtattatcttgaagcaatccagaacccaaccaaacagattcagagttcctccaagaccaactcctaataatctatactcttcttaaacaccaagtataatattttttttatttaccatctaattcatcatgttttctactaactaccccatatacttttatgctataaaataatccatctacatatatgattctatcatatttcacctgaacaatagaacatctccaggtacaaaattgtcccaaaaacctcactattaaattgttttaatccgtagcaaagcacgggctagtagtaacaatactccaaagatgaactgctgctacaactaattaaaagaaacacacgcctcatttcttctagggtgttctacgcaggatgaaaacgaagaggcggagattagaacaaggcgacgcgggataccgatggcgatgaggtcaggaacggacagcgccttggcgaggtgccgccctttgcccccaccggccggcgcccccgccgccgaggactcggcgcggtcggcggcggagcacgccggcttcctccgcaccaggcactgcaagtcctgcagcgagaggcgggtcgcgatggccgagcccgacgcctgcaaatcctgccacgagaggcgcctcgccatggccgagggacgacgagtggctgaggggaggggaccgagggaggagagatcaagaactcgttgttttggtaggcagttgacttttctcgataattaaaacaacaactagccggaaaagtcgggcgttgacttttatgtgtcggtgttgggaaacacttctacggtttagcgagatagtagtggtaaaattccattaatttctactgctcccgatttaatgtgaagcaaatcatcaaaagcgctattttttatataaaaaatattttgacggtgcatataatctttttttcgaaagcattttctagttcattaatttctacagctcccaatttaatctga

SEQ ID NO: 56654 - DNA, 20002 bp, Oryza sativa
ctgcacccccaccgcgttcaatgctatctgtgaggtgattatgtttttgttttttattatttcacataagttaagattgctctgaaattaactaactgttggattttcagttttctgaacaattttcacttatgaaacaggagtgttgacatattacgtagctctcacaggaccaaaaagggtccctgtctttatccccatgcaatagttcctgctaagaagtactctggaaatgagtacacattatcatacttaaaatcctctccagctgaacaattgccagttgcagtttcctctgtgcaggtggtatgtatcggttctttcttagtagctaacatcttaaactacaatatgagtggtattctggatttatggaattttttggctcttctttttcctgctagtaattattatctccagatgatgtcatgatgagcttaatttcattaaaaaaatatccacagtattcagaaggtaaccacaattgccaattggtaatatgcccattcaaactattgtggttatgtacttatgtggaactgtaaattatgaaaaaccttcccttttaatacctctgtggtttagtaaacagcttttgccacttctctgcctgtttttatggtaaaaactcagttaaagattttctttaaataaatcacttggcactgatgaaggttcgcttctaataatctagcattctagccctatgtgttgattataatttttgacagaaacgtagcacagatgatccgcttgatactaagacattaccttgtgaagtgaagactggctgcactctatctcccatccaattaaagcacatccaagcaaatgctggtcatgttcctttgtgtattcatcaagacatgaaagcatcaatgaaaaggaaaactgaagtgccagaagtgacaggatctaagagcttgactgtcatcgtgtcaactgctggaaacatagaacatgattttgacatcatgaagcttgacctaactgccaacctcctgagcaaggtacatgtatcatcctgagtattaaacattggacttggctctagatggtgaactccccctaaattatgatatctgactgcttactaactcttttaaatattcttttttccggtgatgtttcttagaaattaaattttctttgataatattataccacttcctgtttagcattttctccctctctttgtgcttttatgccgtttatttttaagttatatcaaggtatcaagctatttggttaaggtgtggctttattccattacttgtgtttttttccctctctttcatgtataccattcgaccttgtttgatctgcaatgtttgctactttaagaaagaagataaggagctctttgtattataatgagctttagattcacattctcattttacaggttgaacaactgtttagagaaaagccaaacccagatgatttagagacagcaaaggcgatactcaaggtgagaaccctcttgacttggataactcagtatgtaagcattggatttcatccaatctccgcttgttctaagcattatgtacttcaatgccatttaaacttgaaccaggaacaagaaaaggtccttttagatgcagtccttaagctttctgaagtatcatatgttggtgagtcgctttttgtatacttttttgttttctatagcttagaatgttagttcttttaagaaaatattttagtatatcaactacactactttagggggttctgcagactctttcctttttttaaccaaaaaaaatattgcatcaccatcataatatattcctaccaatgaactactggatgagtcctcttagaagttaccaaaactcttagatatatatttagttattgtgatccgtatttggcataatagaatgtgctatgagactgcaaatataacaatatttttccacctgaaaatattgaatttgatgattgacccttatgaagaacggcatccatcaaatccctctgaaaacactggattcaccatttctattttttctatcttcatcaaatccctctgaaaacattgaatagcaccgatttagaactgacatccttctctttgtcccatctactccgtagaggagtgtttcagcaccaactgccagccagatgagttcaaccagcactatgagtatgagagcgacgacgagatgccgcagaagacagcgagcacaaacgacgccgagacgccaccaaaaccggtgagcccaagcgacaaggaggcgcctccgcagccagtgccaggacgtggtggtggcgccaccagcaagggtaaggcgaagccccgcgactccggccggagctccggcggtggcagcggatcaggcggccggctcgacgcagcggacgaccaacccacctccgcctccacgtgcacatcatcaagcacactgtcgccgcgatcagaacgagagggggaagccaaagcccagcgcgcgcgcgggagggtgtttgaaccaccggccaagcgggccggcgcccctccgtgaggctctcacggtcggaatggctctggtggtgaatgcgcgcgcgactgtgttcagctggaagcccccgcaatgtgaattcgcttgacaacaacatcatgactgaccatcaccaactctgctactgcaaaatttgacagttttttgctggagacctctcacctctgatcaggtaaagtatagctctcgcctctgtccggcctcttaagctttaagcacaaagtggtacatagaacatagttaatgtaactagctagtcctttcttccatgcacatataggtccatcggtagtcactttcaattatcaaaacacattttgagacagtttcatgttcccactaggttatacagtacctaaaaacatttcattactcactatctgctatgcacttgtggcatatttttttgtgctttgccatggattggaaacagtgataaaattgatggttttgatagtgtactgaattaggctgcattctcaggcagctttaagatgttgcctgctagtagcatagtactatccctgcactgcagttctggaaagtggtcgctggctgtgcccatgtgagtgaagatggtggtaatgcctgtgccttgtctatcccatgcaattctccctattcgagctgtagatatcatgccattaggtacagagactcgagtgaacagcattagatctgaaaaacttgcattggccttttataactgctcgcagctaccactggtcccggtcacaagtacttcatgttttttgttggtctgtccagctccagcatggttaaactgtacattcatcacggttttgtgatggctgagtggcttactcatgcaagatctagttatgcagagacagggattggtcttaactcttaaacaaagtgtatcatcatgatgtgatcgtcgtctaatcaataaaagcttccttcatactccctcagtttcgagcagtcgtttagtcattttcctagtcattttttaaaaaagtttgattaaatttatagaaaaatatagtagcatttctaacacaaaataaacacattattaaaatatactaaaagttaattaaactaatttggtgttgtaaatgttactaaatttttttataaacttagtcatatctatctattatatactgaaagtccattaaacttcttacaaacgctctcaagctgccacgtgactctcaaaacgcttttaagtcgtcacgtggcacaacaagagagttgagaaccccctagggcccgcacgtgcagtgcatgggttatttccataacgtgaactaacgaagatagttcacgaagattagttccatatataactgtgtatgggaggcaagagattcgaaattaatttcaaagcaaaatctaatcacatatggcaagattaggcacgtgcagcgcatggatttgtcatgaataaacgaagattagttccataattgtgtacacaaggcaatatttcaaatctatctcaaagcaaagcttgcttagtttcatgaggcaagactacatatatatacaccggcttgcatacatatatgtacacctcaccagcaacacctttcaatccgtctgcaacacacaattttggtggctccgtcctcctgtcctctgcaataagaggcctgcggcaatttggacgagtcacccttgcaataagaggtctgcggcaccagcccaatggctgacacccaatccattaattaagggaaatactttctcattccgtcccaaaatataagaatctaggattgaatatgatgtttcatagtacaacgcatctggatagactccctgtcatgatacattgtaatagaaaacatctcattcaattgtagattattatatttgagacggaggaagtagataggacatagttactgaacaggaatcttaggttattatatttgagacggagggagtagataggacatagccactggaaaggaaggagataaagagagcagggcaggcaggtcgacctaggagataactattttttcatgtacctattttttttcaaccataaattcataaattctttcaccaagagaccaagtcataatgtaaaaaatcataataacaacaaaaaaatgatattttaaataagatgcccgcgcaactgcgcaggctaccttcctagtttaaagaaaaaaaagtcaaacgacttataatataaaatgaaaggagtattaaaaaaattagttgtttgaattgagaagatatcttgaagtatataaattttacgctaagaatgttaaaattacccttccttttaacttaggaaaatctctagtttacatgatcggatcccctaaaatcttgcacaggttcaacttacaccataaactgttaacatcttctactagaagtctagaaaacatcatgtagctaccaaaaccctgcaaatcacacctcgagcaaggtttggggatgcttttagccttttaggtgatttattagcacctatgcgtgataactgctgaaagaatattgtctgtccttactccaaaggtgtgtttagttcacgccaaaattgaaagtttggttgaaattgaaacgatgtgacggaaaagttggaagtttatgtgtgtagaaaagttttgatgtgatggaaaagttgaaagtttaaagaaaaagtttgaaactgaactcggcccaagtggtgtgaatattgtgtaaaaaaaagggggaaaaaagaatgacgcggaggcagccacgagaccgctttaaatgcaatttacaccaaccaaatatccatggtgtaaattggaccagaccaataattgtgaaaccaaaaggaaaccgcttcgtgctgctctacgtttttttaagcaagtataggccctgtttagttcgtggggagtaatccattactctcttcccttttagtccctaggaatccaaataagagtgactaaaagtgactaaaagtgtatattggaactaaaatccattagtctttccatagggactaggcgtgtttggaggtgggtgttaggaacccatctcccatacacagaaaacggagcgatccattaacacgtgattaattaagtattagctaatttttttttcaaaaatggatcaatataaatttttttaacaacttttgtatagaaactttttgcaaaaaacgcatcatttagcagtttgaaaagcatgcacgcggaaaacgagagaggagtgttgaaaacttgctcttgcaaacacaccctaaagtggcagcctctctcttctctccccctcggtccacgtgcctttagtcctttttagttcctagatccaaatagtagggactaaaaagtttagtccaagaactaattttagtccagggaactaattttatctttttaatatactagaaaaagtgtacgtgtgttacaacggaaaaactaaatcgtgacatattttttatgcagtatttgagcattgtgaattgtgaaattgtctcacgtggctggttattgcattgcgatcgcttcatcctgattatgaaaatctcacaaaaaaaacataataggaatattctaaatacataaataatagaaataatatgaagatatgcctacatggttgtttatgcagcaacctttgaaaaatagccaagccatatcatctcatccatatcataatcggatcaggaagagcatgcagccggtgctagctgcgcttctttctaaactaataaagagagatttacgtatgcatagtattctagcacgaatcgatctgatgacctgttctcttcttctatacatgcaagcaaaaaattcgaaacagacatgtacatttgaacttagactaccgtattcatactcgaattggacgacgcaccaaacaatcagtaaaaacatcttcaatttttataatagtagagatgtttataaatagcttatagtttgctatctactgttttgtgatttgttcgaaattgtgctagttccaaccaaaatacacccaaaatatgttgacatcacacttcccaagttgatgctgtgccccccttaatcgcttgagctgtaacccccatatgatccaagcgtgatgcgtcgacgtcacgaaccaatctgcaagggacatccaaaggtgcaggctcacgtcctatcatgaattttgcctttgtcgtcctgcaaccatccaacccaatcttcatttttccttcacccaactcttcacttatccccgttctatcattttctttcatttcatatagtatatatcagtagagagaacagtaaaagttatcttcatggagtagtacacaccatttgacatcctgattatgtatagtaatttgaaacacggagatttcaagtggagttccgtagtcatttcatttgaaaatggttcggccaaaattcggtgaatgtttgttgggggcttggagtgacgtttgctactactgacggattttcagtaatagcggtgatccgttttgtcggctacggtctgtgatcttcagcacgccactcgcgctgcgcccaccattatgcatggcaaagccttctgccacgtcggcggcggcggcgccgccggcggcgagggtgctgatcggtgccagcgtcaacgtggccttcttgctcctgctcgccttcttcttcttcatctcgccacgcggcggctcgccgccggaggtggtttcgtcgtcgaaggaggtcgggatccgggggcgtcgcgatggcggcggcagcggcggcggcggcgtgttccgggttgagagctacggggagaggtgcgagcacgtcggcgaggaggatggccttgatcgccggcgattcccgcgtggctacgtcgactacctgtacctgttcgactgcgtgttcggcgaggagcggcgggttcttggctacgccgtgatggcggcgtggctcgccgtgctgttctacctgctcggcgacacggcggcggtgtacttctgctccagcctcgagggcctctcgcggctgctccgcctctccccggcgatcgccggcgtgacgctcctgtcgctcgggaacggcgcgcccgacgcgctctccaccatcgcgtcgttcgcctccggcgggggagagggggagaccaccgccgtggggctcaacggcgtgctggggagcgcgatgctcgtgtcctccgcggtgctcggcgtcatcggcgtccgcctcggcgcgcgcggggtcgccgtggacagggtggacttctaccgcgacgcgtctttcctcctcgccgccctcgccgccgtggccgtcgtcctcgccgccggcgaggtgacaatctggggcgccctcgccttcacctccctctacgtcgtctacgtcgtcgccgtcgccttcacccacggccgcgccccgagcaaaggccacggcgcggaggcggaccacacggcggacgccttctccgagctctgcaacgtcgcagagacgaagttctacggcgaccaagaaccactcctccccgacactgcaccgctactcagctactaccccggcgacggcgacggcgacggaggcggcggcggcggcggctccaagaagaagatcaggagcgcgttctggtcggtgttgcgcgcgctggagctcccactatggcttccacggcggctgaccatcccggacgcgagcaaggagcggtggagcaagccggcggcggtgaccgcggtcaccatggcgcccgtcctcctctcccacctctgcagccgcgccaccggcatcacctcgcccctcgctgtcctcctcggcgtcctcgccggcgcgtccctcggcgccgtcgccttcttcaccacctccccggacgcgcccccagccgacccctcgccgcctggctcgccgccgggttcgtcatgagcgtggcctgggcgtacgccgtggcgaccgagctcctcgcgctgctggtctccgcggcgcacgtcatgggcgtcgactcggcggcgctggggctcaccgtgctcgcgtgggggaactccctgggcgacctcgtcgccaacctcgccgtggcgtcgcgcggcggcggcggcgggggcgcgcaggtggccgtggccgggtgctacggcgggccggtgttcgacgtgctcgtgggcctcggcgtgtcgatgttgctgtcgtcgtgggcctcgcatccgcggcccgtggcaatgccggcggaggccggcccattccagacgctgggcttcgccgccgcggggatttgctgggccgtggtggtgatgtccaggagagggatgagggtggacaggacgctggggtttgggctcctggccatttacttgtgctttctttgcatcaacatttctcaggcacttggaccggtatgaactttttttattttttttattcttttcataaggggcccggttggccaccattttgtgttggcccctccgcgcattgcaacgaaaattttaagggaaatgttacaggacagtatacagaagagaaaagatatagtattattagtacacgagctttcaagaaaagatatagactttggaataatatcgagttcgataacaactatcagtgacaataataccataaacattgacaaaacaatgagaataaaagagagagagcatgtgtgtcagcaagcgactaaatagccacctcacatgcatcaattcccaaccaaccaacatcatacatttttgcaacatctgaaaaacatgttctgaataagcattgcaatgttatgatgattcaattaattttgtcccctccggaatccacaatgttcagacataccaggcccaccgttagctacttctccatcgacgcgtcggcttcgtcgatctcttgattttgtttcaggtttttattttccacgttcatctcgcgatcggataaatcgtgctcccaaaattttggtgaaccaccgttcatgttcagtcacctgtccatatcaaattattatcagtagttagctgtaccagcatcccttttatctctctgaattattgtctcgagtttaagccaaggaaaagaacacctagatcatcaggtggtcctacttaagtgcatacgtgcaaggcacctcatggtgggaattagcctggaatgtagatctgtaatctgaaggaatccatgtttcattgttcagaaaacactgtcggcgtgggtttaaggaaacaaaaatggacgttatagttctggaattgtctcttccaagaaaaaaaaattgtcggtgggctaattgcttgcaagatactactgtagcaatgctgattgtaacatccatggtaactcaaaattgacccaaaatttcactcccttgaatccgtcatcccttccggtcaaaaaaaaaagtcaaaccgcgacaaatctaccctgaacatcaacaatatgtacttaggttgtgttatatcttctactttctcatttttcacatgcacaattcttgaattgttaaaatagtgcgttctttaaaaaagttatctataggaagttatttttttaaaaaaatcatattaatctatttttcaaaatttatagccatacttaggccctctttgtttaggcttataagccaacttataagtcgaaaagtctaagcctaaacaaacaagcagcttttccgtttggcttttttgaagccataagccactctaacactattaagccaaaagctaggttggagaagcttttttggcttatgtgaggtagatgtatgactcaactactaaacttaggacattaaatccaccggcttataaatcatataagccaataagctgacttaaaagtctaggccaataagcctaagcctaaacaaagagggctttaatcatgcactaatgagctatctcgtttcacatgcagggacgagaagttcccaacttctccaaaacaaaggcttaggtgtgagttcggaagggagtttgggtttagaaatttcctcattcctgttaacacgctttctaaactgctaaacattgtgttttgtgtaaaagttttatatgtagaagtttcttaaaaaaatcaaacaaaccattttcaaatttttaagtaattaatacttaattatttatacgctaatgctcgcgtgccatcaaaagtcctatccgaacatcacatctgaactcatccttacatgcgttatattgtcattaattctatgaaatactcctccattgaaaaatctcaagcatgaccaaggaaactcatactcctccgattcatttagggcaatcccaacctaaaaaccatcaattattttccacatttatcatgtcatataaaaataagagtaaagtgcatagacggtccttaaacttatagagatgtatcatctagatccccaaactctcaaaacacatatccaaatcatcaaacttgttaaagtgtgttatctacatcccaaatcgccacaacccctctagcatcatacatggcgcggcgctgatatgatatgccacacgggcgtgacgtgacataatcttgactgacaaataagacccacttaaaaaacttacttttcctttttttttcttctttccatttcttttgcttgttctttttcttcttcttcctctcactgtaactgtaggtccgccgcacggggtgcttgggtcacatagaaaggtaaagaaaagaaaaaaaagagaaggagaagaaacaaagtaagtgggtctcacttttcattcaagataatgccacatcacatccgtgtggcataccacgtcagcaccacgtaggaccctggaaggactgtggcgctttggaacattacacattttgacaagttcttggactttgatatgtattttgagagtttagagacctaaatgacacaccctacacgtttaaggactgcatgtgcattttactctaaaaataaaaaaaacggttcgatgtagagactacataaaatatacccttctaaaaaaataaaaaaaatcatgtcatatagatgctatatagagaaactacttcttccgtttcacaatgtaagtcattctagcatttcccacattcatattattgttaatgaatctagataaatatatatgtatctagattcattaatatcaatatgaatatgggaaaaactagaatgacttacattgtgaaacggagggagtacatatacagtaagtaattttttattcaaaataaatctgcattcaatggcctctcttctccccccttttatcctcccatctccttattttcattattgatttttattataaggtggagggtagtgactgatccatttaatccagcatggccaactaacatccccttgttcattcaaagctttgtatgcattttgatttttaggaaaacctaagaaatataggcttgagatttttggatggaaagagtaaataacttttttttatagcgaaagtacctctatcttgtgggctttactccgtattttcaaaccatcatcttgctgatttaaacaagccaaaagtaattttgtttaactagaggctgtaccattcgtaattccacccaatgtttccttttcaatggagaaaatttctaaggattctggaaaaggaaaaaacaaatcatgtactataaaaatagtttgggacattgggtaaaaggtgcttttaaaaatacgcattttttgcccgctgctccgaaggtgaatgcaccaacccaaaaaaggccaaaaacagacagcatctggtgcgaaacgtcatcggccgcactcgacccccaacatctccaagtgatcagcaacgctgaataattaaattatcaggcactgctagaaatagaaaaatgtttaaatatgaacaaagttagtgcacgcatctgtcagtcaccttatcatcatgtgacgagagcatgtgaaaaagtgaaatccaatcgctgcatactcctatgctgctatgcacccgtgatggatgagagatccaaatccacccaaaggttacgaagaccaagactacattgacacgtccttctgctgcttttttctggcagtgtgtactgtaacgaaataaactgaaactgcatcatctcgaagtttcaagatagtgttggacactctaccggtttggacacatcgggtaaagtaagataagctgttataattaattgagtattaattatattaaaaatatttttttaaaaaaaacatatttcctccttcctaaaatataacaacttttacccctcaagatttgtcccaaaatataatacttctccaccaacattctcttcccaaccaatcacaatcctccaccgttcacttttcccacctacctacactactcaatcaatcacaaccctccatcattcacttctatctactttcttaataaccatgtacaacactaaaaatacttatattctgagacggaggtagtatcgtttaacccttggagaaatgtacgcgcaaaaaacgatatactccctccgtccaaaaaaactcaacctagtattggatgtaatgtttctagtacaacgaatctagatgtactcatgtccagattcgttgtactagaaaacgtcccatccaatactaggttaagtttttttttgggacggagggagtacctctttcctcattgttcttgagacgaacgtacattttgaccgtaagttgctgagtttttatcattaacattctctaaaaataatcaaattatatatgtggtctaaaattgtatcagttgatttataattaaaagtattctagtaatagtatcacatattttagttttagttgctttaaaactagctgttagaattcacctattcttagtcaaagctaacaaacttttagcaaacttttcatgacgttaagagtgtttgtaggtcttatttgagaagctcaatattgtgaaaaaaacatttgatgagtactccagtgtttgtaggtcttatttgagaagctcaatatagggctggataccacctagccagctcgattcatttgaactcgtttctttcaagggaattcgtttgaactcattatctaaaaagcatagctggtcttggcccataagctagctcattaacacacttatcgcaaatttataatttcaaatttatcttttcggaaagaaaagactaagcgctagttaatagcacaagaccagctaaatttcaagaatgcacataactgctcctctaaattttaggctgtattatggaatctctcgtgtaaaatggaactaatcattaacgtatgattaattatgtgtttactaatcttttgaaaatatagattaatacaacccgttttaagataagtgcagccgtggatatccgtgcccaacgtttgaccatccgtcttatttgaaaattttgtgaaaaaattaaaaatatttagtcacacataaagtaatattcatgttttatcatataatagcaataaaaatagtaatcataaaaaaatttaaataagataaaaatagtgtaaaactgtacttattttgagacagaaggatatatgattttttcaagcaattttctataaaaatatttaaaaggacatacggagtactagtagtctgagatatatgcgcacggaaaagtggtcggcgagttgaaatgggaggggaagaacgcagccgggttcccacttttgcgcgtgggtcccacctgtcagccgcccgaccaccggccgacagtgacctcactccaacccccacagctctttacttatctcaagcccaatcacaacccactcccacctagctcaacctcacgctcaagctgcatctctctctctctctctctctctctctctctctctcctccagctccggcgaccatcctgcccgccgccattcgccggaagagcccaccagctgcaccggcgtggcatcgtccacttggcgagagtggcggagctagatcggctatcgatatatacataggtggtggatgcgtgcgtgcgaggtggtgagggtgagatgaggtctccggtgggccgcagggaggtggtggtctccggcgtcttcaccgcgctcctcgtcctctccatcctctccctcccgtcgctcctcctcaccggcccggcgtacaagagctggccgttcttggcggcggcgagggacgactccaccaccgggagcggcggcggcgcgggttactacccggtgtcgttcgcgtacctcatctcggcgtcgacgggcgacgcggcgcgggcggcgcggctgctggcggcgctgtaccacccggccaactgctacctgctccacctggaccgggaggcgccggcggaggagcaccggcggctggcggagctggtgtccgggcagcccgtgtacgcgcgcgccgggaacgtgtggatcgtggggcgccccaacctcgtcacctaccgcggcccgacgatgctgtccacgacgctgcacgcggtggcgatgctgctccggctcggccgccggtgggactggttcgtcaacctcagcgcctccgactacccgctcgtcacccaggacggtaattaattgccaatccttaatcgtaattaccatcgctaataatcgctactagtaccattttagtgtttgtgggaaatgctaaattaattatctgctgataattgcagatttgatggatgtgttctccaggttgcctagggatctcaacttcatacagcataccagccaccttggctggaagatgtaagaactccaatcgtcactaacttgaattgtttcatcagttttcaagattagtttttgattgcttcttcttggtttcaattattcgcatcaattggaataacttagtggcaaattatcaagtgcaaacccccgatttcaaatctctcaaattttaaaagaaggccttgattttgatgaggggattgaaatatgctagctctgcagaaagaagagggcgcggccggtgatcctcgacacggcgctgtacgaggccgaccggtcggagctcatccgtccggcgaacctcaccaccaaccggcgaaatctccccaccgccttcaagctcttcacaggtacgcgcaaaaacatctcaactaaatcaacctcaattgcgctacgaaaacccctcacacatttccgagacgacacagaaaaaaaaacttgcatacttcctccgtcctaaaatgctacaatctaggatgaacaacaaatctggataagagattgtaacacaagtttatccaaattcattgttttgagacgaagatagtatcattgtattgtattaagaaggatgagaagatcgtgtacagagtacaaaccataaaacctctcgtgctggaaagaacatgccactatatgtagaaaaatggatgcgtgtcagcgaccgatttgggatgcgttttcgtcaactctttttctggtaggagagtgagtacggaccgtacattgcgccaccggttgatctgtcacaccaaagacaatgccattgacggtatggttgtacagattgatcgttggatttgtggctttgtttgttgttgaagtaatagtaagatgcgtcatttgataggcacgggcagtactcaccttggaatctggcatacaaaaagaaaatcttatctgaaaccgtatctagtcaatggagcaggtacaggttgtggagttgtgctaagccaagcccctgcattatcaatttatcactgcatgtactggagatggttaaattaatctgatagatctgaatcagtggagatcgaggaatggtttagtgttagtttatgctctggagttgccgaatccaggcaggccaaccaatgtgctgtgctgttgcattggcaaagcaaaagcagcttttgtttcgatctattgggacaaagcttgatggagtactactactcacttgcttccgtattcccaaaaactcacttgcttccaagaaacggcagggatatagaaaattttggaaactatgaacttttacaagagttagtttaatttatgcagcatctctatttcaaaggaggcccaatgtgttcaccttcgtccatgtccgaccatttttcatttttcagctagcaatatagagaaatttgtgaaaacaaattactagtaggttttgttatgagtgatggaactgggtcaaatcgagatgcatttgataggacagtggtaaggggtgtatgattttaagcttgaggttctgtattcaatccttaacacgttcacaaaatcttctaaaaatgttttagaggtgcgtctctccctctgaatcttgtttttttttttaattgggtcgaatctctgcctatcgaacaagcattttgactatagatgggagatgcaggttcagcgtggacgatgatgtcgcggcagttcgccgagtacttcaccgtcggctacgacgacaacctgccgcggacgctgctgctctactacaccaacttcgtctcctcgccggagttctacttccagacgctggcctgcaactcccggcggttcaggaacaccacggtgaaccacgacctgcacttcatccggtgggacagcccgcccaagcagcacccgctctacctcggccccagggactaccgccggatgctgctcagcgccgcgcccttcgccaggaagttcagggaggacgaccccgtcctggacaggatcgaccgggacatcctccgccgcgacggcgccgccccgggccgggctttcgcctacggcgggtggtgctccgaggggggcgtcaggctgtgctccaacccgcaggaggccgggaggaagggcatgataaaggccggtgcagggtccaggaggctcagggccatgctcaacaagatgatgaatgcgagaaatttcaggaggcagcagtgtaggtgaaactagaggcatttttatatacagtctaattctgatgatcagtgtgtgtgttcatgtatataatagaggagaaatcgaattacaggaagaatttgaggcagttttggttgtctggagggaggttaaaagtagagtgacagtgtaatctcacagaaataagaacatgggggtcattagtaaggttgtaaaaaaattgacaggattaacgtcagcttgtgccttggttggttcttcttccatagggctattgctgaggttggcgcattttttactgtgggaatgacatgatactactgttggattaaacctgtatgcttgaatttcgggagccagtttgtctgcattttgaaagagaaaagattgcatcatttgttctccaacaccatttatttgctcagttacaaaagcccttatagagttatactgctatactatgtgttgaaagtaatatgccaccatgtaaatcttttctagtgtggtactttctgttgttgcaaaattaacttttttgggggtgtttagatccaccggcaattttttttaccccgtcacatcgagcgtttgaacacatgtacgaagcattaaatattgacaaaaaaactaattatattgtttgcgtgtaaattacaagaagaatcttttaagcctaattatgcctaatctgacaatgtgatgctacagtaaacatttactaatgacggattaattaggcttaataaattcgtctcgcagtttacatgcggattatgtaatttgtttttttattagtctatgtttaatacttcaaatgtgtatccgtatatctgatgtgacccggcaattttttttgccggtggaactaaacacatcctttgtaagtttttcggatcggcattgaagtaaaaccctgaccaaattttattaagagcctgtttagatcccactctaaaattttacccctgtcatatcgaacgtttgaacacctgcataaaatattaaatataggctaaaaataactaattgcgtagagagtaggtgaaaattttaaagtgtgtgggagtgaatagcattttttgtgcagttcagttagaatgtccgcctgcgaaaataaactcttttttttgtgtgtggttcacttaagaggaccgcacggtcctcttaaatggaccgcacgggaaaatgagccaatttttctgttaccgtccgcacgcaatgtaaaagggtccctgtacaggaaaatcatttgcgtagcagcgtcgatgctgttgcctacaccaacgttgcccaatggatgatggcagggttaagaaaatgggagcccatattccagggtgacaaacttctagtatgatgcctgtaccatgtccataaactttgaaaggaccattttttttattttctagaaacaaaagttatttgtttgacggtctaaaattaccctgtatcaactgtgcattacttcttgattaaagctttgagaaagcaaaaatgatcatagctaggtgagatgaaactctgaagcttaagccaatattgtattccaaatgtgtgatggcacacttgtttttttagccaaaacattctcttaatcttgtgcattttgaaggaaattgaaatctacaagtaatgcgaggagatctacagatggtggtaccaaattaccaatcatgagcggacgcaatggatattacgtgtattcgtgggaatacccaaaaatttcagaaaaaaggatatttgatatatgtaggatatgcagtgatgaatctagaaaaaaaaactactgggattctacacatactatataattatctaattattaactaaaatatacaaattaatatgatataaaatagctcgaatcgaataatttacgtgtggtcttaggactagaatgaacgtaggaatgccgctggatatgcatatattcattgtgtctcaaacttcattttaccttttttttcccgagaatatagggtgtgtttggttaccggccacactttgccacaacgaaggttagataagttgtgacagacataaaagtgtggtgaacaaattagcagtcataaaatatgcaaagttgataagaaaaagttaagtctgacatgtgggaccagtggcggatccactgttggggctggttggtgggccagccccacctccaatccatgcatctagttagctactagaaaattaccgtgccggttggcacgctaataaatttatagccatgtgtgtatatattaccatgtgtattactataagatattgatttctaccaaagcaattgctgtcagttctttagaaatataagatatcaacatggtaatagtatttgtcttaactgtattttcaacattatatgaaaattcttggtggtacttgcttatgtacttgtaattttgcttatgttttctttatcttcaattaaacctgtagtagattgtatgtatttgaagatttttgatactaagattattgctactacttctttggtgcttttaatttcactatttactgttttattttctataaatataggatgttactatcatgaagttacttacctcgattttgatttaatatgaagtaattgcatttacgaaaaaaaaattatcatgggttagaaatcctaatattttttcccttttctttcccttcattttttatttattcagttttctattgctccatccagccataaatatttggccaaacatctgtaacttggccactaataacttctcgtagcttataggcttggttctttcccaactttctcaactctcctcactcgttttccgcg

SEQ ID NO: 56655 - DNA, 884 bp, Oryza sativa
attcctgcagccccataaaatcgcattgagttatacttctaatgtttttaatgtttgatgtggttaatttatcttattaaaaaattatacgaatacgcacaagtatatcattcttaaaatacttttaatcataaaaaaataattgtctagtattttttaagaataaatcgataagcagagcggtaaaagttagtatagaaaatcagtgtttgtaggagttctataagaaaaaaatagtatttttttcctttttcataatatattgaaccatatgagttgtagaatatatttttaatagatgacgccgttgatttttgaataaatgaatgaccattcatctccttaaaaaatttcatacaaatatataatatataaatcatgtttaaaatatttggtaaaacaattcacaacaaaatagattataattatataattatgtaagttataaataagacgaatgatcaaacgtgcgatgaaaaatcaatgatatcatttattaaaaacagaggtagtactgaaaagaattaaactgtgttcgggaggggcctggcatgcaaaacgatgttcgcattaactcgggattaattaagtattagctaatttttttaaaaaaaatagatcaatatgatttttttaagcaactttcgtatagaaactttttgtaaaaaacacaccgtttagtagtttgaaaagtgtgcacgcagaaaacgagtgtgaggagttgggaactccagcaaagaacgcagcctttagatttagtcatctaaattgtagtttccgaagaatatgtctaaaagtaaaaggatcgatatgacatgtattagtgaccagcggagtatatgcaaaagcaaatataagagcaaggtcaatagtgcagctagcag

SEQ ID NO: 56656 - DNA, 6195 bp, Oryza sativa
cgccacctctttaaccattgcagcccgcactattttctcctctatcatcttgcccacctcttcctctccatcaccctgctcaatatcatccccaccttcaacctcccgctgtcctatttccccttcatgcatagccggctgcccttcctcatgcattactttatcacacacctcctccaagagacttacaacagccccatcaatgattttcgaagccatttctccgaaaaacttttcctgcaccccatccataccttggttcccattgtcaccactgaaatttccctccatcttcccctcctctttgtcatctaacaccatatcatcactcttcgacctcttggtctccttttcccttaattcatcctcctcttgacccccatcctccttatcatccccaccatccccaccttgctctatctccacctcatctccactttcgtcatatcccttcttttctaactcaaactcaagctcaaagtaatgatctccaatcactacatccaccctcctaggaaccaactttggacttaaaacagccatgaaaattcttccaaaggtattcttccttgtggttttcatatccaccatttgggtagcacccaacaaggaccctaccgcccaaagtgtgagatattcccttaatttcttcctcagcccgtacacctttacccaaactttgggcaaaaggtacccttcctcttcttcaaaccattcctcaaattgcaagcgcatcccggtggctaacccattgtccttcacatcagcccctccaaatgcaattgctcgttgaagttcaactttcgatggaaaaagaacaacaaaagagttatcatctttctccgttggctaccacttccacttgttagacacaattctttgttgttcctccaccacttgctcctttagtcaaaacacctcctacacatgataccaacgccatcttagtagtccccttcttactccttggcagcgggttgtgtggtatgtggtggaaaccaagtccctctaccgagtaacctaccacttgaaccgctggcttaggaagcttcaaaacagggcagcgatggttcacatggtccttgtaatcacatatgtcacaataaatctctgtgctgcaatttttgaagcatggcctttttgaaaacatctcgagcatactttccctttctctacccctagttgctgatcctcaaacaaagatggatcacactccatctccacaaagtccccattttcttctttcttctcaaccattggttgcttctcctttcttgccagcaccaggacctccacctcccccactttcacccggcctgcaccaccattcctctccgagctagcagctccccccttctcctctccctttcttcccatatcatccattttcctctcaaaagctggacgttgtgacccgaatcctcttgctgaccctctccctggtcttcctgcaaaaccgccgcaccttgggccaaagccacgagcccgtctcgggcggtaaccatgcctctgccacctttgaccgaagctaccctgctgcccaaaaccatagcccggatcaaaccccatgcgacttccctgaaagcctgttccaaaaccttcctcctcctccctgaagctacctctttgcccccaatctttgttgctgcacccatcgtaatcatctttcctccttgccatccctcccttccgaacctccttctcctcttcggctctaacctgcagctcgccacctacacacagacccccttcttcgctgcctctttgcctcccctctctattgcgaatgtttagccctagctgcgactgccgcctcggtcgctcaatctcccccttgttacgttccttccgagccaaagaatggcggcccgcgtgcgagaggagtcggcccaacactgaacaaaatttaacatttactcccctatatctcccttgccgatctgcaacgtgggaccatccatattagtgccgccgtggagaagactcgaacagacagacgcctcgtcttcttgcgctaattgtcgaccagaaaactgaagactacttgccttatcgaggttccccgagaaagtagatgcattaacatcctctctttttgagaacttcgccggcgttttttctaaccctgccgtcctcttcctctgccaatcctcaagcgctgctgagaggaaggtttcaagcttcctgggttgcgagatccgccgtgacggcagaggtcctttccagggtttacacatcgaaaccttcttcctgcaaaccgcagccaccaatctatctacaagatggttcttccccttcgtccttgtgctccctggaaacgaatgagcctttggagatgaatttgtacacaacaaatactctcccgctgaaagaatttcatcaagcgtgaaaccttctgccatagccttgcgtacgatgcttcctttttgaactgatcctaccacctcctcttctcggtgacaaacctgctcttcttcctcctcactatcttctccatcgagcacccaaaaacgtgaaccaatagccctaggcctagtttcacctctggtctcactagcgaagtgttttgttggtgcggaaaaactgtccttaggacacaattccaagtcacacgcgaggttcacctgtgacggcattattggcaggcatacttcttcttcctcctctaccttcttctccctttgcaactcatccctcaaaccaactagaggctccctcgtcatcaccggctgtggccaactcgccgagctggctgccggagccaaggtcagcctccgaccaccatagccaccgaccatcctagcactcatcaccacgactgctcctccaaaaaaccacatctgccgctccttcctccgagcagacagcgaacagcgcaagaaacgccgttcgccggcagccagcgccgccgctcgctgtcgaccgcttagcctgactgccgtcgcacaccgccggccaccggtcgccgaccactgagaagctgcctcttgcctagcccttgctagctaggtccagcttgccaggtactgaaattggacgaaaaaacgagaaggacgcttccgccgccgaccgccgcacgccgctctccggctgtcgcgtcgccggctgccctccgccgctcgtcgctggcagcaggcctccgagcctggcaaccaacgcacgccgccggctccccgtgccgccggacgacgccggtaaccgaccgccgaccaccgtgcagctgcctcttacctagctccagctagctaggtccagcttgcatggcactgttacacgaaggaaaacttacaatgccaaccgccgcttgccgtcgaccgtcggccaccgctcaccggtcgccgccgatcgccggccgccagccgccgctcaccgctgccccccggataccgaggttgcttagcgtgtggtaccaggacagttagtgtcaattgctattaattagacatctaatggcttgtaagccacaaaattaatttcactctacatgtatgaatataaagatggacgaagttggaacaaatattaccatatgtcccatacatatatattgcgcagttaatattctaattacatgtgttaagtcatttaaaattcatgaaaatgctctcaagctgcgacgtggtgctctaataaattagggcaaatattagaaattctaagaaaaaaaatcaaagtatctatttcttgattttcacttaaatcgttaggtccaatattataaaccattagattaaattgattctagaacaaactaaatactacgaggtcccacctctcctcccgcggcataggtacgcacctacgtacgcttcccctccctttttttcattttttctccttcttttttttcctatgcatatgcttccctccctttattcctatatcatacgcctttatgagacgatttaatcaaaagaattttgagtatcttgcactcgcatttttcatttacggtcatactacacggtatatatatagatggactatataataattaactagcaataccttttaataatataagtgcccgcacatacgcgcgggccaacttcctaatttataagtaaaacttttatatacatgttcttagcaatttaaaagtaaggctgaaaaataaacttcgatgaaaaaaaacgccaaaatgagttttaaatttaaggttgaagatttaaattttgtttgataagaggctttgcagcgggtggcaacggatgtggtttaccagtggatggtgatgtttttgttgccgttgttgtggacgttgacgatgacgaggtcgccctttcgcgcgtagatggtcgggccagggaactgcccgttcacggtgaggatgctcttcttgtggcacagcctcgtgtagttagtctccgtaatctgcagatctcatcacgcatggttaaaactcaaaactcatttcgtgcattcattaattcctgtacatcgacgacattgatccgcgaacacgctagaattcaagtagatcatcacttgcaaagaaatcgtagtggcgagtcttggcgccatgagcggggttaactactgcaagtgctaacaccatgcctgctagtaaccaaagcaataatgcaggtatcttgcctgttgatcccatcgccgaacgcacacagtattcaatctccaatccaagcgtataagaacacacagagctaattgagattcttgtacgcgcgaggtagttatttggttcttcgcagtagctaactagctagtgccgtaagctgctgctttgcctgagatggccatcatctgacgaatatgtatttatagggaacgcatgtatgcatcatgcatgaacgtgacgactgatgactattctcccacgaaattagcaatttattaatcgttctccagccgccacggcgtgaaaacgttaaaatggcgtgagttgattggcgacaaaactgacggcatcttgaagttcaaatggctcccgaacgagaaaattacatatctaccatcgcataagaattgcttcgctagaataccatcattaaaataggcttcactgaaataccactctcaaaccatgggtgttcactgcaatgctatttttgtgatttcttgcatttcgaaattatttttcctcaattacatattttcttggaccgttctacccctgggtcacatgttgaatcacatggtggctggtgtgaatctcgcgagcggagggtgaagcggcgatgccggtgctcgtgcggacgccgcgccgcggggcaactgacgggtgccgcgtctgccgcgctcgtcgtcgcctccgtcgcgcgaaggagggtggcggcggggaggaacgactccgacgccgcgccgggggagaacacggcgctgcgaacgcgcttctacggctgcatccgcgtgttcctcgtcctgtcctgctgctgctcgccgtcgaagaagtggtgtctctcctcgccacttgcttctgtcgggagaatgctctcgaattggaatttcagatagactgttcattcgcttgtcttgccacattcataatctgcctgaatcaaaatattcgaattttgagctgtaatagaaattcgatccctagttctagtttttctctgcgcgaattgaacaggaggattctgttcttttgggaattcggattttgtgtggactctgcattggattgggttggatctttgacctgtgttcctctttgacccgtaaatgtttctggatggtttctgaaattatgaagttgccgtgatcttgcttgctccatacggagtacactataacaagaacataatttggtgttttaaaggttgaatttcggcatctgcaccagcaccggcgtcgccgcttctccaagggtagaatggtccgagaaaatgtgtaattgaggaaaaataattttgagatgcaagaaaccaaaaaatggcattgcagcgaacacccacgctttgagaatggtattctagcgaagcccattttagtgatggtattctagcgaatccattcttatgcgatggtagatatgcaattttctcctcccggacatgcgcatcctctgtttcctgcttcttcaaccaaatcaacactagatgtacatgttggttaacttaattaattttgggcatatgggagcagtcgaggttgttaacgaaccgatgccctgtttagtttcaaagttttttttctaaactttaaacttttcatcacattaaacctttcata

SEQ ID NO: 56657 - DNA, 3279 bp, Oryza sativa
ggtggttttcgtgatttcgtcgtagcctagcggaggtaagtaggcacgcactcgatcaaagtctcaaagggcacctttgcatgcgtttggcggccacgaagcttcttcttttttaaaaaaaagaagggccgccaggaagattttgaaatcgactactcctatcaaacactgcactacagtgaacaaatcaaacgccctgaaaatcaactgtaatccaagacaattttactgtaatccactaaaaatatgtcaacgcaattttagtttttccccacaaataaacaccgaaattgctatgcatctattgcaagattttttttgttagagatcttgcaatttttctgaccattggatttttatattgagattcatgttagggacttcccataaaaaaaatgcaaatgcgtgagagaagggatccttaccacttgaccgagttgctgatttcgtagccaacaagatatttatagcataactagaaaggaaacccgcgtatatacacatgaaacttatttattattcataaaaaaatattaaaagaagtcatatctctccatatttattataacgaccgtaaattatcttataataataaaagaaagaaatttttataccgtgaattgactataaacattaatatcttaaatgataagaatatctcgagtgtcacaagtcatcccttaaccattttcatatctattacatccttcgacatcgttagtagcatcctcatatcctccgatgacttcgggcttgttcactttgctatcatttttagcattgctaaaacttggtaaagttgctaaaattttggtaaggttatcaaattttggcaagattttatatgtacttactaaaatttggcaacaaactaaacgtagccaaaattttaacaactttaccaaaaaaatggtatggttaaaaatgcatcaaattgaacatgcccttctttgccccttttgccaattatgcatttttagtctctctcttactcatctttgatgctttgagcatgcacaccctcctaagtcatgagaacttacccatcctccattttcaacgtctcgtactatcacctttccttttcttttagataacagagtatttcattaatcaatgagaacgtctgacatttgcactaactagaagtgcacatagtaaaaaagaaaataaatgtaaaaatgctagacaacatgaacatattatgttgctatatgctgcaatgtgacggctttgctctactaaaaaaagaagaagacatagtaacaatgtaacataaacacctttctaactatttacgcttttttaagctcttttccgttcacttctggactttttggctgtgtgcctacgagtagaggaggcagaggccggagatgtaatccatttccattattaaaaaaactatttacgctgagcgcttctctattgccaacattatgggtgtcattattgttgtctatcttgaaaaaagaaattacgatttgtcatcggagaagaggaattcattgtcaactaaaattcaagtgtttcttaggagattcatacctatataatagaaaattcaatccgttgaaaatattgaaaatatgcagttctcatgttctaaacttgtcattgattatttgttgtagcaccttaaatattggttttgattgcttacgtatggctatcaaaagtgtattaaactcgtttcacatctacactttctttatgttggttatttatactataaaagagaatggagggagtgctatattttgtagtataatcacatttgtgcaatctaaactagcaccaaaagagtggactgaaaacaacatacataataattggaaaaaaagaaaataacttcatcttttcatttatgtttatcagccaaaatttaaatttacaaccttaaattggagttgattttgagattttttttattgtattttattttccagcctttgtttttaattcgttaagaatacgtatataaaacttttattcacaaattatttttcatttgcaaatatattgtttcgcattttccttctatatgcttgacgaaggggccgaaaatttgtttgtattttgaggggccaaaagcccaaaattgggttcattttcaattcacacaaaaatcgcttcccacaccgacacaccgtagtagtagtagtagtagtagtggtggtagtagtagtagtagtaccgtacaagccgcccttgtccgccttcacttccctaaaccctaaaccacccactttccccaatccccacctcaatggaagaagcggacgacgccccgccgccgtggaggcccagcaagccggcggcggccatcgacggctcgtcggggcccctcgccgccgccgccgcgcgcctctccggccgctcccgcgcgctcccatcctcccgcgacttccacttctacaacaacttcccctccttcaggtcccccgtcggcgccgccgccgccagggcgggcgcctccctcgccgccctcggcgccgcccccttctacccgaagcggcacccgccgttccccggggacgacctcgacgacgcccaggactgggtcgtcggcgtcatcgacgacctggccgagcagttcggcgcctccatggacgagttcaaggcggcgcgggaggaggaggaggcgactggccggagggcgacggaggaggacgggttccaggttgtttacggcaagaagaagaagaaggtgatgggcggcggcggcggcgaggagggggttggtagaggtggtgaggcgtttggtggtggttctggctcggtgaagatggccaccagggataagtcggccgcgccgggggcgaaggcgaaggtgccattccacattcccaccatcccgcggccgcaggacgtgcaccgcatattggtggacaactcgagcaagccattcgagcattcatggcttgagaagagcgatgatggttcccgtgttgtccatccattggttagtgttctgctaaataccttacatttgtgctaacctcacatcacaatagttgtccttccttattgcccttgatttgattagtttgattataatgaaaagattccgccagtaaaaagcaatgattttttttatttagtgaagcatgtagagagattatgggattaagagatcagcaagtaatgtaacagctgattatgtgaaaaatagaatgtacagtgcaaatagaagttggtaagatggcacatgaatataaaagaatcatgtattctgctagtggagactatggtattactaatgggcaacatggctat

SEQ ID NO: 56658 - DNA, 873 bp, Oryza sativa
tgaacacagcctaagaagaaatggaaaagtaggacatttccctttccgcactgcaattaattgagatccatcattggacagattagaaagaagtggatgttttcttgttctgcatttatatttctatcaccaaatgtgcaaaacaattcacacaggaaaagatccccatggaacaattggttgacagagattttcctgaaagcgagccgataaagcctcctgctttggatgataccccttttacacatgtcgaagacttgaaatccttggaggtgctagctacaaagctgaagagtgcaaccgagtttgctgtaagttttagtagtagtttttactaaagatattttctttttggcttcaaacaaataatattgaaaatattcagaattctattactcttattagctgagattagcattgtaaagaccagggtttcaattgtcttttttcaatatatcgctgagcaccgtatggacacataggggtattgctttcctattataacttctgaggagtggatgttgagagttaaacaatcatattccatactgcaactgtagcctctctttatatattatatattttggtgggaatctgaagatgaactgttggaagtaacatgtgagatcagttatgttatattgatctcatgatcctatctgccgccaccacgcaactatcttttaccaataactaacaaaagttggtggtgaattgatggattctgcacgttgagcttacatttagcaaccacatttgaaaatttgcatggactagttaagttgaaacttaggaaaaagtccactccccactcaactctttatccggttaattttacaccctgaacttcaacgccaattagttttcatccct

SEQ ID NO: 56659 - DNA, 9064 bp, Oryza sativa
  unsure (1)..(9064): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacacgtatgcatatatcttttattacatatgtcctaaatttttctatcccttattatcatcacgatgtctatatgagtcagcaagcaaaatacgtgtaaagagattatctttttacatatacgctcattaacattatcgtgtgatctgaaattttccatccttaattaatatcacaatgtccgcggggatataaaagtttgatcacatcaaagaagctttgaaaattacgtattagataatatggcaataagctttctacaagcgtgcatatctctagttacattgattccttaatcttccataaccttttaggtaacaccatgacgtttaaaaaaaaaacatatttcatcaacacaaaggtttcttatacaatttctgaaatggagtggcaatcttccagttacgcccacgtttagattttacgtccgcacgtattagggtctttttaacatagtgccagctatatttttacttttcttgagctatagttcagccaacagtttatgctcttctcaaaaagagagtggagatggctgaaactctcacaaaatgaatttgaaatgtagtgttgtgtttagaacgctccacaattttacttgagactcaactttaataagagatatctaagttatatgggatacataaatttcataatatggtaacaaatacatagttcaatgataacgaagaaaaaaccaatcatgtttttcatctgttttcactgttcttatgcaggaaacaaatgtaaatatgcatttatgaaatcttcaaaaacggatgcatattgcattttccgaggccatcaaaattcatgagagaaagagagagagggaagcatggagctcggtcccgaagctttccagccttctctctcacactgcatacgcaagcataccctaaaaaccagagaatctgcttcccaaaaacagagagagaagggatgagaagagacagcacaccatagatttccagtggacgccaaaatgaccgttctgcccccacaacaaacactgtgcttttcgctttcatgttcttgccaaccacgcacaccggaacacattccttcctaaccgcttcctgtgtctcaatgttatccttgtataaaactaaataaaaagctatgcactatgtcatcatatgtaaataaatttctaagttctggtgagaaacatcaacacaacattcctcattataactgtatcactatacaaaacaaaaaaaaaattggtcttcgcatgtaattcagtctaaaattattattattttcttcagcaagctttttggctcctttgaaacaaagtcatgaaatattatagaaaatttgcatatatagttctttggattaaaggaatagttaaaaaaatcatacgaaattcctttgtgttgggtcaaaacaggaatatttaaccatttgccacatttagatgtggcaattaactttttgccactggacccatatgtcattaagataggggtgacaaatatttatttaccaaatttaaaagtgacaaatagttaaaacccctgtcaaaacatagtgatcttggaagaattttattcatggaaaaaaaattgtctgtgtttatctttcctctaattgctacgcttccctgcattccatcgaaacagttatttctatctttttagggggggttttaatcaataggacactctaaaccatgtattttccatgttttatgatgaactctttccatcacaaaataattatttttctagagttcaaaaattgtctcaaaatagttcatatcatcctatctatttgtcccatcaatcatctcctattctagcttctctccattttatccccactactcacctacttacatttcaataagagatattgcagtattttctttttaaactttaatttatactaaacagtatagaatgatcagtattataggatgggagggagtgagaatattgtagtgtaaacgagccctcaatcctaagggcatgttagatctcaggagttgtttagatttcaacttttttcctttaaacttttaactttttcatcacatcgaactttcatacatacacaaattttcaactttttcatcacatcgttctaatttcttcaaactttcaattttggcgtggaactaaacacacctcaccctaaaattttacaccatatcacgtcaaacgtttaacacctacatgaagtattaaatataggctaaaaaataactaattacgcagattgcgactaatttgtgaaacgaatcttttaagcctaattgctctatgttttgaaaatttggtgctaaagtaaacatgtgctaatgacgggttaattaagcttaataaattcgtctttactgacggattctataattagtttttttattagtgctgaatattccatgcaacactctatataatatcacatgtgacacgccaaaactttgcactcctgtaccaacaccaccaaaaacaccccctaagttgatgtttgtaaaatttacctacccgctaccaacaaaccatacatgcaaccaagaaaacacggaaaaaggagagcgaagggcagtatggtaaattgacgttccccacgggacagggtcagcaagacatgcgtggcgcgtccggggagaacacccgcactgccagctaagcacgtccacctcatgtgggcagtgggccccactcagggtaggctcgggtcgtcaccttcacgtcggccgtggagtggagatcccgacggaatattccctccgcatccacgtggcaagccctgccccctgactaagcggcctccgtggatttaatcgaccacatttcaacttttcaactttcactctgtagaactgaaaagattaatagagcagagtacatttcagagtattgagagattagcctcttggcttactaaaaagataattaacgtacgattaatgttaaaacttctataatacaaacttaaatattgcatttacttgctaaaaaagcacttctatacataaagctcttttaaaaattgcaccgtttaacggcttgcaagcatgcacgtcataatatagtagctagttctctgtaatctactagtatttgtgttagggtaaatataaaattttggagtaattttatgagtattaaacttatttctacgaaaatcatgtattatttgtgttgctaaatgtgtccttttggccgtatgttcacaagtgatctccattactttagtgttttaatggagataaggtttggatggcataacacaatattccactatgaaagtgagccataggtaggattaagtactgtttaagtgcccaagccaaacgttaacaccatcaccaacaaaataattaggtaggtgaaccgctgctttccgtttaggattaagagcaacacgacgcagattgaattataaacagcagcgtttatattaccggtgtaatgcccatgttggcccctagcatttaccttaatctcaatactgccacctctactaaccacaaccccatcttttgtcttattcgagtttgcaaacgaaaaataatttataaatataacttttacatacgtcttcataatgatctaaaagcaaaagctgataaataaattacgatgaaaaaaaaatcaaaatcaactctaaatttaaggttaaaaatttaaaatttaactgataaaatataaacataaatataagggaaaagatgagtccgtacatctcatttttaacattttgaccggcaactctcgcaactgtgcatgccatcatacgtggcgttttgatcatgccctcgtgccagctggacgcgatctcctgtagcgtccacagcggccgccaagtacacggcctacccgttctgggaaaaaagcccaaaactttaccattattagtttattattaccggtttgttacacactgcatgcgaagccaccggaaattttatgcgagaaggggaaaatttgcacggcaattagctgtaatccggctgggaatttccggctaagcaagtacttaatgtgtccgatcatatcatatcgccagctatgttcggtgcaattagtggcttaagtccgagagaagtttttatgtgcgtgcttaatttgttggagagggtactggatgggcacagcagaactcaacccggtgcaattcacctgcaaaatggtgaggtttttggagatggagaggtgcggtttaaattgtaaattgtgcccgtcggattttattccttaattatgttacgtccatcatacaaaagtagttgtaagcatatgggattctaaagattatgacaataacaaaaacactgacggaaggaacataaatgatatagatggtttgacgtatataacgacaattttcatttcatatctatatcatttatggtcatgcagtcatgccctcatataacatgtggtgattcctttagcaaaactttcaatatttgagtttcgatcattttctattaagtaacctagataaacgaaaaccatatttgtatattaccattggaaatactttcaggatgacacagttaaatagctcatgctgtgatcctattttaaaaaaaaagttatcatggttatatcttaaaaccccgcgtcatctatttggcatttgtcatgctaaagttttacgatatttgtgctgacttaaattcaccctccactaaaaattaattggtgatgaattgcaacactgaaaatcattccatccctacctaagcttggacttcatgtctacccttccaatgcttccgtagttccattccttaagttttctatgatgatgataaagctagcttccattctactactgccaccaccacgtaccattgcatacgcacacatattgaaaccagcgaagctaaccctcatggatggtggtttacaatcccatcatttagcctttagttcatatgcataagcggaaatttaaaattttaattttaatcccagagttacttttgggtgtttcgtattgtacattctagcgttaaaaaaaacgcgttaaatagttttatttataaatcaattttattgctaataaacagtttcactataagcataagagggacaataattatattattctcttctctcatgagggggtttgatctgttcaaaaaggacaccacagtgcaaaacaaagccggaccacgctatgtgcttgggctacatatatagtcctttccttgccacgcacatatataggggagactggtcgccactgaccaacaactattggatcctaattaaaaagcctctccatggccggtaacacacagtggcggcgtgcatggtatcgtgcaagtcagagctaaaaagctggagtattgtgttgttgccagccaagtcggatgatgatggagacaccaaggccaggtcgtcgtgcacacatggaaaaaggagcgaagaatattgattttgggctttgtttacacgccgtgccggtattattttctttcgttatctgagatacgacgtgtaccatatactatcttttttttctcctgaaaaagggtgtaccaggtttgttctaactttcttcgattatctactacgcaatagcaattaatacgaaaatattgacttctataacttttttttttattggcgataagttgggatgaaaaaaaaatcagttctagcctgatgattgaggatgagaccaatgtcggagaaataggagtgataacattgtcggattaggataaaaccagtttttagttacataaataatactatatgtaatatttgatctatttgggtggaaataagaggtgaggtgcaaccaacctactcttctctcccagctgtacttgtaaaactcctggtgcatcttgtttggagctctataaaggatagggtcttgtttagttacaaattttttctttaaactttcaacttttccatcacatcaaaatttttatacatacgtaaacttccaacttttttatcacatcgttccaattttaactaaacttctaattttagcgtgaactaaatacaccccacgttacacacatggagagcggttttaatgaagaggagaaatgggaaggcaagaaagaagaatactagaattcaaggaggtcacattggccatgtcatgtgcctggaggccgtagacgagtcgtagtagattctctcctctcttctctctgtgtatgtgtgtgcgtgtttgtctttctgggctctggattgcagtcttgcagaggaagcgaggccatgatctgagcacggaaaacgctttggctgcacacaaaggctgcccctttttagctgttctgttcactggcctgcaggccatgacacaagcctcggctccagcacccacttcttccagggaggcacaagccctgaagcaccgtatgtatctcattggatgccttcgtctcttctgatattctcttctccggggtgtatgaactatgaagaatgtgggcactcaacgtgccaaaagcttgaccagatgtttatgttcgtcttgaattattataggttggccatgtctcgaccgggcagtgtgcgttatttatacttgcatgattacatttacatcaaagataacatggcttgtctgttaaattagactttggaaatgtcatgtgttcaaggtatcaataatgtaccgtgcatatcaccgtgtcgatatgtcgcagctcagctccatgaaactctgggcgtcagacgtgcatggagctactatagccacaggccacagctttctattctcctttaattaattaggaataccagatactgagtgtgtcggacagggaacagagcagaggaccgatgcgaaactcctgaaggcatcccggcgatgtgatgcaacaaggacctaggccaggagataaaaacggtatattttcgaaaacaatgctccgtcgatcaataattaaccagatttatcaattaaactatttagtattgatatcaatatgataagatattatctaaaaaatcaatatgataagatagaaattagaaaacctctcttacgttatgtggtaaaaaatatcggtcagaaatgatacgctcggtcagtagttgcaatttgcaaattgctgtgatcctatactcttcagtaattagtagtactactcgtacagtactccagtatatacacactcgtttattcccgatgcacacaggcgtttcttccggtatatgtttcgcggggccaactactctgccacacaacgctggctcaacaacccccccacggtaaacgaccgacctcgagtcacgtacggttagcgccataccggatgccaccccccaccccctccaccgcgcgctcatacgcggcgtggcggcggcggtgccgaacgctgaccccgaccccccgaccgacgacgacgagaacgcacacgcacacacgcacgcgcggcagcttgctaggctagcccgcctctcggccgcggcccgcgcgcgcgcgcatcatggcggactggatgcggtgatactgggatggcgcgtcgctgcatgccgtcgtcgatcgtcactactcccgcgtgcccgtgcccgtgcgcgcccacccacctctccagcgaggtggagcgagctgcgctacacgcggtacgcgcgctagctgcagctgctgcatgcatggcggctgggtggctgcctttggctggccgcgggtacgtacgtatagcgaccggaccgatcgacatatatgcggggtgatgggcggccgcgaccgcgcgcccatcacatgcacgctgcgtgtgcgtcggtacgtacgtacgcgcgcgccgggtactcgaaaggctgcgtgatggatggggtgtggcgcgcgcgggaggacgggacgggcgccgcacaacgtaattgcccatcggctcagctgcgtgcgtgcgtgcgttcgtgacgttttgcaccggcacgcgataggcgcgcatgcagccaccgaccttcacggggccgggagacccacatcggcgtttcttctcgacaaacagctcttccagtcttcttcttcttgtttttttgaatggtttagcgaggtttcagatgaacacaattaattatgtatacattgcacgagtaacttttcatctatgttatacacatagttattttcagcagaataaagaaattaatatttaaagactccatccgtttaatattgtaagttgtttttttttcaaagtcaaacttttttttaactttaacaaagtttatagaaaagaaatagcaacatctataatattgaatcaatgccattgaattcaatattgatatatcttgaaaatgttgctattttttctatgaacccaaccagaagtttgactttaaagaaaatcaaaacgcttatgatatgaaacagagtactatataatacttcatccatcccataatataaggcgcggttaaagttggtacggtctccaaaactaatctctagcttataatttctcataaactataaggtctgtagcaacaaaattataactatatgaaagtaaatttatatctcaatccaatgatataatttttaacaaataaaatctatttcatattatattaagtattggtcaaatcttttataggttgaatcttgaaaacacttgtacgccttatattataggacggagggagtatatgctaatttatttcttttaaaatagtggtagtattactctgaacctttatatgacctgtgtacaaactaaaatgtacactatcatattcttggataagaagattcgaattctaatatgttcccacgacttcaccatcacagaccatactaatgatgcttttccatgcatg

SEQ ID NO: 56660 - DNA, 14013 bp, Oryza sativa
attcctgcagcccgtcagcacaagagaacacgacaagtgtctcaacctaaactcatcgatacgataaagcacacgagagcgcattaatacgtagctgctttaatttcgtggagtattccttactacacatgaaccctactcctgttaagtacgtacgacgaaaccactaacaatttaattaagcaaatgcctcgctggtttccagccatctctgtgtgctgatacccaaactgcccaagttttgaaccacctttttccagacacaagctttaacaactaagagcacccgcaatggtaaagtagggtgctctctataaaacatgtacatctcagcaatagactagattaatagtaaaccacctcaatagtatgtctacataggtatctatagctctctcatgcattgcctcgtttttctctatagactatctctaagctagtagatagctttgctctctctcttcatttaatatcttccaagtaggaaaatatgctgacatggatctcttgtagatagcttatagataaccattgtgggtgccctaattaaggggagtacttaattacgagtactactcaaaagctggcaaaggtagtacgtaccacgtattagctaattctttctttccctaaaccagcgaatagtcttacactccctctgtacatcatacattctctttcctgaacgtgcaggtaattaaaagagaatagaaattactgttgcagtcttagttatgttctcctatttagaacagtaataatgtactagtattattgttatgtggctttttggaacgtgcgtataaactttcccagtgattaatccaaaattgatctctctaatgaaattaaaggtacttgtatcaatctatctatctatctatctatctatctatctattatcttctattatatactaaaagttcattaatcttcctacaaacactcttaaggagccacgtggcttcctaaaaacgctctcaagccgccacgtggcactctaataataaattagagaaaatcctacaaattctgagaaaaaaaacaaaacatctagcacttaattttcacttaaattggtgggacataatatttcaggccattagattaaatctattaaaatcattccttctaatatagatacgatgcatggagaggaaggtacgatgtactattcgtaaacagaaaaaaaaatcatatgcgatgcatatggaaggagaggaatgtacgtatgtactacctaaaaaaacaaaaaaaaaattacatgatatacgtttatatgaacgtaatgtaagatcgtatgatcggaaattaaaaagcataaagcgaaaaaaccaaatatatataaaagtccactaaactttctacaaatgcttttaagctgtcacgtgactcctacaaacgctactaagccatcacgtggcgctctaataaattagagaaatctaaaactttttgagaaaaaaaggaaaacatcatatcattgattttcacttaacatggtggacccatcattttatctcctattatctcacctgctcacttctttatccaaattttctagatagcagctcagtacataaacaataagaaatactatattaactatctattatatagtaaaaatcaaataaactccgtacaaacgctttcaaccaatgaaaaaaaaaaccaatgaaagtttgttgatatttcttcacgaaagagatatataaagaacactcaattcaaaattgaaaatacgttactttaattttaatttttttgttagaactattttcgaaacaaactaatgcgcggattatcttcctggttgtcatgaaaagacaacctttgctatcatgattatgttctcatatttagagtgtgaacaatgtattgttgtctctgattaacttaactagcaggtccattaagattataacgatacgacggtgcccaatgttaaagcaatgtaatgtacttgtaatgtacttagcacatttttaaacagtcaagggaatacagtaggtgctgccagtagctagcccagtcagtatacaatgcgactatctaatctaaaatccagtgatttgatttataataatcacatgagtacgtagtacatatggttgtcgcatccatggacgtgtacgtgttttgtttagaggagacagattatctccaagcccccatggccctcctgctttcggtttggtcggttgttgcagtaattaaacatgagcacgccttaatcctcaattagcaagccgtattaagctaattaacaagctcctctctctaattaatcttaattcttctctcatgagacaaatcttccaaagcgtccatctgatgatttgattaatccgagcctacacaaggctgggcatgcaagataggtgcatggaatattacaggcaggcaggatcagaaattcagaagtactacacatgtgcagtccagctgacactggctcttataatctcctcccttcacattaatcaaatcactcacaaggtgcatgcatggattgttcattagttggttagtagttaattagggcactcgttgatggagattagaggtgaagttatgtgagtggatggatctgggccgtccgttgctcctcgagatcggtgttgagagccattgatcggatgatgcatgcatgtactgctgctgtagtggtgtgtccagtgcaggagaatcatgtgtgtgtgggtgtgcggttcttgtcttgtccctgagtttaaattagggctgcagattaggtgctgaactcatgatgtttacaataatcaagctcctctcagacagatgaaatgtactataattaagaaggaaaaacaaatgcttcacaccagcccatgcatggtccctaacagttactgtttctgctcttttaaagaaaactgcacgaatcgtaaagcaaattacatgtcttgctaatactccgtgataaggaattttttatgttcaaaacatgatttctttgaaatttaaattttgacattacaataatttataaaatgtaataatttttatgatatcatgacaattcttttaagcaaatctactaatactatttcttgtttttaaagtaagcatttcagatgttattggtgatcaaagtttcaaagtttgatcaaatcttatcataaatgctatatatttataacttgagggagcagtttcattttggcttgtatcagagtagtcactacagctctcttggtgaatggtgatttcaagtgcctatagcagctcacatggaagatgaagtcattgtacgtgttctcttagccaattaattaagctgtctctgatctgtgagcatttgaaaagcacccgagttaattaaccaaaagatcagttctagttgggcatatggtatgaatgccagcaatatagtactcctagtgtgcctgtgtgtgtgggcaatgcaagccaccatgtttgcaagatttgcaaggttttaaacaaatggatttgatccaacaagaggccatgtgcatcctgtcagcaaagagaggggataactgcaccctcattctgtgcacttaccagaactgagacctccatagattccactgcactgtgcatgctgtgctcacaaaacacaaaaggaaacacaaaataattagttatctaacaaatcgtcctggcacaagaaacagagtttgcaggccagccattggctctggctgctgcttaatcagtgagaaaaagcaagtgattacagagatggatggccttgatcagttgtgtgcttgggatgacagtatctcctctctttggtggcttttggcttgcacaatggtaataaggttcagagcttttcatgtgggaggttcagtgtatgcagctgatgaagaagctcttcttttgtgcagagcatatttatagtttacctgtggcctgtctgtctgtcctccatggaaagataaagcgtcaccttaatcattgcatcccattattattattgcacactacagattcttgtgtgtgtatatatatatatatatatatatgtgtgtgtgtgtgtgctgtgtgagaggatttgaagccattgcagttcttgaccttggcagagtggacgttcagaaaactattgaattcaaggtcagatagatagatagcacaaaaggtgaatcaattggagcatggcaacagcaagcatactaaaagggagcaggtctgcttgacccagattgaggccatggcaaaatctatccaatgccaataaaagttgtcatgcaatgcaatgcaagggatgtttatggccatggtggtggtggtggtggtggtggtggttgttgttgcagcagaagcaagcagcagcccagcatgtgagctgagtggccaaggcataaatgttgatgagaggagaagatgtgtgagaaagagagccaatattgccaagggggttaccctacccctcttgtgaacccctaaactaaagagttgagaaaagtagatggggttgcacattgcacacctgtcctacttaatgcagatcaccatccacctgtgagtgtgtgtgtaatgcatcaatccacgtttgtttatcatttcatcctctctgatgatcagatgattcttcactcagtcacatctatgctttggggtcacaggttaatcaacggatgatggcacaccacacactacctagctaccactcctacttggtactcccattggatcaaatcaccgccacattgtttcatcttttcctcctctgatttgatctgcacttccaactcaaacctaactgagtttgtacttggtgaaccctctgatgagcctgcaaccaccactacaccccatgcctactgcctgctggactcagatgtcacatggcacaaaaaccatagaattgaactgaattattaacctcacatgtttcccttttcacacacttgtcaattgtgagctttgtatgtatgttcaaacatgagtaaataacatggttgtgctgaagatgaagctagggggtcaaatgttgcattgtgtctcaagatcccaaaacaagaattgttatagttatcctttatggcagtaagtactactagtaagtactagtaactaagcttagatttggtctgaagagatgtgccaaggaccaacaaggagagggagtaaagcatccaatggaacagttaaattggatgctattggctcacttaacacccccacaattaaatcttggcatgtgcagtaaaaattgtttgaccgtactgctgtttgtggcaatggtaacttggcaggataggagaagataaaaaggagattagactggatagatcttgcttaggactagtagtagtactggctagtccaggaagagtgattggtctatgttagatcgggattcagtagttattgattgggaattatatattgtcctcatggaccaagccagccagagtaatattttttttccttcctttttttgttcagagtccttgccctaggatatggttggtttgtagtaggatgcaagcaatgtaggtcagttcaaatttaagaaaatggatgaggctatctctttaggtgtcctttgggtgtcagatttcctgaagtttttgcgggaatttaaataattcatctgaaaattctgtaaaatttaactactccgtagtgtccaatccccaagcagtcaagcaacagcttactgtatttatttgtggatatttatgtatttgattatgtaaccttctttttgctaatcctaagtagtattaaccaattacaaaccttctgaaatagaatatttgattacttggattgtgtataaagaaatattatgttgaatcctttaattgcagaccttgtgtttgtgaagtcaagtatttttaagaagtccagtgtcatgaaaagaagttcagatcacactgttctggttcaattttgttctatgttgagggcttcttctttctttgtggtgttatgagatgcaggcaagcaaagctttaatgctgtcagagtgaaaactgaaactactaaagcatagtaggaacaaaaggattataacaagcataagatgacacagcattaggtgaggccagggtacataattttcattgtaccatgatccaaattcatagtgcttttattgtctcctctccttcgatctgaagccttgtaagtacacaattatatgcacagggagatagaaaacatacatgcatgttgcattagtccgcagacagctacaattacttcacttccctgacccaatctaaccatccttgcattgacaccccccgttgtgcaggtgcagcatctatttgctcttgatgatagttgccactaaactgtactataatgtgctcagggcaaagaaaaagaaaaaaaggctgcagccttttcattaaaaagacacaccccaattgcaaccttttcaggtagctagagagcatctcacagatccatgatggcaagcaaaatatggctttctgcataggttgttctcctgtggtttttgaggcagaaaaaaaaaagagagaaggagagatgcatccatccaatccacatgagccccaaccaccaagagttaaaggctttgctcatggcaactactgccttgatctcttctccttgacatgtactaccatgtaatggggtttgtgacaaagttgggagtagcctcaaaccagtcacaggcaccctgggttggctgggttctcaacatctgattgaaggtggtcacacagcagaaccgggcctgacaagtccttttcccttctaccatatgcatcctctttgtactctcaagactgtccccaagaaatattctcttcatcttgagattttatcccccactttaagccctcaacaaggtagttcccgttttttatatttctagaatttttttaaagaaagttttgttgataatttatagtatttgttacaaaattcaagtgctacattattttggaacatttacaagggcgtattggcattttctatttgattagctaagttagccgaggctaatgaccaaattaatttcagttagtaagaataatcgacgaatttctgaacgaaatattcattatcgattatttcggtatcagttagttcggttaggtttttcggtttcggccatttttctcatgcatagttggattggatggtgaattagtgagtgttgtttttctttttctttgagccgatggtgactggtgagtgagtggtgttggcaacagcagaggcatttgcctgcctcaaaccagagatgccaacgttttgcagcggaagggaacaaaaaagcccacgaaaagcccatgtgtactcgtctcgccaaaagcccacagagtggggcctacttgcaaaatcgttccttttatgccctctctacctggctccgtgcttcaaacaaaagcaggtaatagctctgaattattcatgtgcggcaattgagaaataaatgtatactgtaccggtgcattggacatggttagctgatctctccgtaccaagcgtaataaaaacacacaagcacttccctgcatctataatttgacctaccacacaatttgttacacttagcatccatgcaattctctttttgtccgactcttaacaaaaaagataaacactacgcgagatgttatgttacttgtgtggttctagtggctaacaaaaggtaatcacatatgacaaaaagatcgatgagctagagttcaccatatcgaacaggtgtaattaatcttctcccccgcgcgctaacacgtacgggtgaaaaagaggaggccgggtaagtagctatagacagcagacacaggtgagtcccacatgttccgtagccgccgcacaatatctggcctcctacctctgcctccgcctccatacgcacggccgccgcgcgcacaggggattttcgcggatcgcgcgcggcgcgtagcggcgtgcgtgttagcgtacgtaggtgaggccgtgagagagtgagctgtgagcggccgcgcgacgcgacgctttggcgcgcgcgggcgcggcggcggacgtacgtgcgacgtcgcgtacgtcgtcgtgactcacacagaccaccatgcgcgcgcgcgcgcgcgcggggcttcgctcgacgaccagccggggccggtcggcaggcggcggagacccccaccgtgcgcgtgagctggctgcacacgccgtttatgcatggtgttttatagtatttggttggagagatgtgatagatcggattggaatgaatctatcttttgaaagtttggtttcggaatatggttagaatggcattatttttgaaaataaatgttatctctagatctgagtcaattccataaaaaaaattaaacgactaatccaactcacctcctttatctcactgatatatgggctacacataattctcatttattaaagaaaaaattaagactatacaatccctctcattttaaaaaagaaaggatcatttcgtctcaaatatcaaatagaagtaagtagatagaatcattccaactgatggacctaatccattttatttcatttctaaacctaacacatattacgttctcatcctctatctttcagactttcactagtctgtcgtcacccatgatgagaactaatcccaggagagtgggaagagagagagagatggctggagagatcgatgagcagaagcgatgcaaatgcaagcagagcatccaatagatttgaacagaggagagggggacctgtctctcctcattggattccccctctctctctgcagccacacacaatgtcacaatgccactatccatttcttcctcgcatcgatattccattgttcccatctctgccgtcgttgatcgtctgctcgatcgctacttcatcatgtacacatccaacattacgtgcatatacacacatggtaataaatcctcggatcagattttgccatggatgaatttaatctgtccccctcagcaaatcaataccgtagcatagtatgcagtgatcactatctcaaaacgatatagagggatcactatgctgcgttcgttcgtgagatagggtgagaaaacacctcgttttccttgcgcacgctttctaaactactaaaacggtgtgtgttttacaaaaaattttctataggaaagttgttttaaaaaatcatattaatttttttaaaaatttaaaatagttaatactcaattaattatatgctaatgacttatattattttgcgtatctttccaatcttcctcattagatagattatgcatgacgcggcgtgagggagctatagctcgtggtccagatgttgggagccagcctgctgttattacggtcatacgacgccaccactatgtgtccaaaatctataggccggcgcgccttcccaggtaggtacgttcgcgtacgtacgcgatttactcactcacgtactgcgcgcagcagtgtgcatactgcgtacctctcgatcgatcgatcgatcgatacatcggtcggaccacacaaatatgtacagcatccgggaatgattaaagactagtagtaggctaaggctgtctttagatctttccaaaagttttgacgtatcccatcggatatacggacaaacatttgaagtattaaatatagactaataacaaaacaaattacagattccacctataaattgcaagacgaatttattaagcctaattaatccgtcattagtaaagttttactatagcacaacactgtcagatcatgcagcaattagacgttaaagattcgtctcgcatttacacacaatctgtgtaattagttttttttcctatatttaatatttcatgcatgtgtccaaacattagatgcgacagggtgaaaaatattgccaggggatctaaacatgccctaaatcagttttactttatccgtcccatgaaagacgaacctaataccaaatacaacatatctcagtactatcaatctgaacagttagttatattatattatgaacaatgtttcttgttagtttttatgttatattatgaataatgtttctttttagtttttatgggactcacggagtgttctatttgttccaaaatactgtacgaatctagaattggatgagacatttcaactttttcggatttgtagtataaaaaatatcacatctgattctaggttcttactacctccgtcccaaaataagtgcagccatggttttcagcgctcaactttgaccattcgtcttattttaattttttttgaaaaaaattaaagacataagtcacgagtaaagtactatccatgttttatcatcttataacaacaaaaatgctaattataaaaattttttaaataaaacaaacgatcaaagttgggcgcggaaactcatggctgcacttattttgggacgaaagtagtatattgttgtagcaggtacttataacagtttcaacgtctcgtcgtgcagttggatcgatcgatcgatcgcatcatggtccggcagccagtgaaggagtagctaaaagtagagtaggcgaatggtggcgcaacaacaatgcgctacagtggctaagccgttgaagtccgaacgttgcacagtgtttctctgtacccggggatcgatcccatgtatgattggcaagtagtactagtacatattggaccaaccatggtggctagctctgtaggtacgtgccaacttatacacatatacatgtatgtatatagaggtcggatcaataaaaaaaatattatctaaaagacttgtatgtgtatacgtatacatatacatgtagcgcattggttctcaccgagaagaagtagaagaaagatgatgattctaaaattcattgttctcgaccgacaactgcagcgtgatcgctcaatcatgcgtgcactgcgagtaactttcttgtgacgagcgagctggtactgatggattgatgagccacctccactgttccgctgcccaatcatggccaggccaaagatcacggcgagacagccagtataaaatatgcatgcacacctctttttttcaagaagagaaatcttcttgcgaatggaaatagacagtactacctagacacggtggcataataatatgggccttgtagtttgctgcccaaaccaaagttctctttttaagattatggttcagatgagggattgtggtcaatggttgagattaggaagcagatgaggaaaaattaaataagaaatagctggttgaagggcctatccattttagaggaacttcagcacataggaatagaaatacatgcacacttcaattcataggaatttttccataaagtttgtgtagatggaaaatttccttttgttttctctttgtaacttgtagggaagaaaatttttttttggttttcctatatctacattcgtatgaaccaaatgacattcatacgaattattccttaggaatctaaattctttgaaattcctctaaaacaaataggcctcaaatgagaaagtaggcggtgatactcttatatctctactacttaaaaaatttaacatgtttccgtcgtccgtcaacataaaaaaaacagcgaaaaaacaactaaaaaaatccgattccctagcgaaaaaaaaagatccgattcccacctaaaacaggaaaaaaagtccgatacctggcgaaaaaaaagaaacgtagatggaaaaaatatatctgattcccacctaaacggaaaaaaaatccgtttcctggcaaaaaaaaaagagaaaacaaatgtagatccgattcccacaacgggaaaaaaaagtccgattcctacaaagcgaaaaacaaaaaaaatccgcaaaaaataaaaaaaaccaaaaaacatatagaaaggtcagactctataagagagtggcaaaaaaaacgttcgtaaaaaaacgcacgaggaaaaaataaaaagggcggaaaaaagcgcggcaaaaaaaagtctaatttctattcgcagttttagtagtccatatatatctcttatctatctctaatttaatctaatctaactatttaaaagaagtttccatcatatattaaaaaagaaaaatgtacgagaaaataaaaatggtttaaaaaatgaaatgttagaaaaaagcgcaaaagaaaacgcgctagagaaaaaggtttccgtagtcaaaaaaacatatgagaaaatatttccatcgtctgaaaaaaaagaaaaaaaacatacgaggaaaaaactgtcagaaaaaaagctaaattgatggatgcttggtcatataggatcatcgattttttccatctcctacactgctttttgtttcgtcatctattctcctgtattggagaccctgcacatctctgtaggcaattatcagactatttttatgaagaatagctactattcttgataacatattatataaaaataatattagaaaataaacataatttaattgttatttagagaatagtgcacagtttatgactctattttatgtagacttgaccatgcgaggcagtctagaatttgattggttgcaagaatgagtttaaaagaatattttagattatatgcatgttgtcatatgaacaatccaattactttaagtaaagcaaatatgaataatccaattattttagataaagcagacatcggtaaggttgccatcatcgaggttgggccattacatttaagatgttctaattttttgtttgtcatcgacatggttatacatgtaaaacgtatgttatcattagttttttcacccgttacaacacacggacatgtttgctagttcttaaagaaattttaagctctagatgttcatacatttatgtggagtaccaaattttggcagtgttgtgatcaatgcgcttgatttgaagtcttgccatatttctataatatttgagtgaaaacttccggaactacttttttttagagcagcaatatttatatatgtatattcaggttgtcacttaccaaattttttcgtttcaaataattttatagggttcaaaatgatagcaaaccaaacaagatattcatccgttctcaaactacgcaatattagtattcttgggaaactaattccaagtaaatcaatgtgtttttggcccagcaagtgcttattaggagacgaatccaaacaattcaaagtttagaatttgaccaatgacatgacaaaaaggaatctttcatccctacctaaacaaacttatatatatttatctaatgatgaggtggttaattacaaagtactaccacatcgtttagagatcagcagaaaaccattaaccgagattcgttgtactgcacaaggaaacactacacctatagtcctatccataggtactccctttatctcacaaaaataaatctacgtgaggatatgataaaagattgtccagattcattgtcttacataaaatcacatttgcactagactttttttttatagagaaaatccatgcatatgcatgcgtgtgcgttgcctttacttttttcatccgttaccccccaccatgaatgtgatcacatgcacggcacgccatgatccatccatccatccgctttgcaccctatctcgcagtattcccccgatcaggaggctacccatgccggttgctcgcggcctatcccgccgcgccttgccctccccggctacaagagccaccatatcacaatcaatgcgtagtcgccttcgccttgcagtttggaggggtcgcacgggctcgtgtgtagcaaacgatgcgcccatcttttagccacccccaggctaccgatcgagcaagagggtagtgaaagcaagtttaataatagtatagtcaactactagctccaattcatctatagctaatctaataactcattcatactatagttacatactacactattaatatatggtctcatctgtcatacacactgcgctttaaagtccgtgctatagctggctacaaatttgtagcccgctgcttttatctcttctcacttatctctttaaaatatgtctgcagctggcttatagcctgctattgtacctgctctgagggtgaggccatcatgggatgggaggacacagggctgcaggaat

SEQ ID NO: 56661 - DNA, 9636 bp, Oryza sativa
aatgtttcacatggttcatcgatggacggatgctccgtgatatcaagtccatggaccaagtaaaaacataatggttggctacagtcgggtatagctcctgtttggggatcttctacttctggtagatgcaacaactcaaaatctcaggctctcccaaacaattcagatcataactcttgattctccaactcaatagttattacaggaactatggcttgttcgatttggaggaaaaccaaaggatttgaattcataaggattaatctctatgtgtagaaaaccaaagaaaatcctcccctttgtcccttgaaaaaaaaggagaaaatatccccttccaacaagttgtaaaagagagaacaaaattttccatccattcaaatctcttggaaaattcctatggattaaagtgtacatgcatttctattcctccatttatcatgttcctatgagttaaaattccaccaaaccgaataagcccttagaaaataaactagtacccagaattctaaattctcatctagttgtatatttattaactacttaaaatctctagcttccaaaacaaagctagtctgtctacacgagaagagtgttttagcactaacatgggcacttgacaccaagaagaataagctatggaaaactaatggtcaaggtggtgacctgacccaaaaaaaagaaatgcacgttcaccctcaacaactttaatcacaattcacagaagacacgggtttctatcgacaacggttactgttgtgttgatgggcctatacttctggactacacaacatggggccttcacagaataaatgaattacatgtaggggaggggagtatctgagtaaatcgccttgggtccatttgcacgaggcccattaaacctggtggagtggtggcacattctgggcattcaaaacatcccaacaaacatgttgactgtattcatgaactctacaatctacagccgtctgaacaaatatattatacacaaatagaatttctcctgtttcgcctgtccaactaggaccaagtgtggaagaagacatcctgactcctgagaaagggaacattctgtaacctctggaaggctctgaagcagcttcatttgggggcctcagtctcagaccatccagtttgcaaaactgacatgtaaatacactactgccgcaagcaggttgggaagaaaaaaggcatgatgctcaccatataggaacttcaacatttgcaaaacgaagatagagggccctcaattgctacagtaaatctagaataggtggctgctctgatgaaacattggaatgaggagtacgtgatgctcgtgaaagtgccgattgcccttgatttctaccacgccctcttccaacagaagcagatggaggaggagcaagcctgggtggaccctgtgttgtgctgcttgacaatgaccctgtactccgtcctccaattggatttccaaatccaagagctgagttgccctgattcaagtaattgcctgttgagttcacggccattaaattagtagtgttcggtttcgctgaccagctcatttggttggttttcatttgtcccagagaaccactgttgccactgaacccaatatttcctgtacttagtccagaaatactttggcttgtgcttgacaggtgtccaacagctaaaatgctggcaccactgcttgcttttgggggccagtcggcaaaaggatcaatatcagcaagaccatcactagatagccctccagatttactttgctcactaacagataatggtgcattaaagtcagacgatgtgttttttctaggaggccactcaatgtcaacaggaacacatgaaccagaagtttggggtccagagcttggtgcaagagattgcagtgatggaagtgatggtgcaggcgaaattgtagctggtgtcacttgcgggattgcagatgatggcttaggttgttgagtactgaaatcaaaaggaagtgccgagggttgctttgtttgagtgctgaaatcaaaagggtctgatggttgcttcatccgtgcattggaatcagatgactgtgatggagtgcttgctttcttagtagggccccagtcctcatcccatgcagcaccctttgcagtttgtatctgttcagtttgtcccacacctcgtgacaatggctcagaatgaatcccattagccaatgagggtgatacttttacctctgtattcccattatctgtaacagtcacaccacgcttctcctcaatcttgctgtagaagtaggcactaatttagttggcatattgattaacgcatcgcaagtgtggtgggacaaaaggtaccttgtgatatccttgacaaatagtatgtacttagcaaattgctgtacattcagttgatgtgctgtgagcagtgggaagacgagaggaatcacgtactccgcagcaaactcaacaccacactggatcattggcaaatgagtaaaataagatatcttttacaaggaaaaatcaattggcataaaaaataattgttcatgatttagcaatactgaaacaaactatatcaagaacaaacctgtttaaaaattgcattagccactccaagggtgcacataagtgttggtgcggtgtggtcaacagctgtacaacgccgaagagtttgcaagatctccagtatgccttctttatccaaagatggaacaagatcccctaaacagcgcaaggcatttacacgcacctatattttcaagtcacaattcaaaatcaagatcagaacaaagaaacataaaacacaaaataatataaggtacagaaggctgccttcctggtaattaggcgggattataatagggggtgataaaatacagaagaattatataatagcactatagtgacactaacatctaagatcttaacactcttgatcaataacaagctataggatggagtagctacatagaaaaaccatacactcaacatctcatggctcttatatttctgtttatttattttatgtgcaaacgagacaggagttttcccttttaattattcttttttaaaaaaaaagttgtttcatcatacatgctatttgtgtgttttaatgtgtattaatatggtacaatctgacacataaagtacccaaattataaaactaaaacatgtattatgcataccgcagcaactgtagtctttaaggctaatccatgtacgcgtggcagaacagactgtttcagtagctgcaagaagaaatcactgagtgagtacaaaaatggttcatgtggaattgttgattcttttgtcattgtgaagttaatttgtcaagtgagcccttactcaacgagaggcaaagatagtggctttctcaattgtgatggagaaaatgaagctacagtatatagtttatcctcattttaagaatatatttcaatgctaaccttcacgtcaagctgacgagacaatggcactgtccgtcgcagtacttcttcctgtagtcggggatcagtgtcatcataagcccgtaccagcataggaaggacatgtgatatcaaatgctcttgtgtggcctgaaaagagaagcatggtaaagaaattgattaggtcatctggccatggaaaattccagtaattacaactattgtgttggtaccattgtgaatttagattataattgcatttactatagagataaaaagagcaaaaacaaaaacaatgaatcagtgcagtatttataaaagtaacttagttaccttgtgaataataagatccgcatgcttcacgagcaaaagaagtgtttcacctgacgctgaagtaaataccggaacaagggccggcagtgttgaaagctcaaaatcacctttgtcctgccagagagcagagaacaaattttcagaaaaaaaaattatagcatttgcatcataaagaaacattaccatataacatagctttaaatgtatttcactttacaaactctatgaactcacgaaattgaagcataacaaacaaataacaatgttcgagtgttagtactgtggatgactctgtgttgcagcaagaatgatacaaccacattaaattggacttactccagtcaaaagcaagttcagatgaaaaacagtcaaataaaatatgatacttcacattatgcaaagtggtattacagaaccatggtatcatcccattagttaacaatcagtgagataagttcttactatcattgaacaaagaatataattcataaaatatttaagaaaaaggtattcgtaaaacacaaggaacatgacctgagattccgctattgttagaaccatgggcaaaatcattggctgcatgaccatgttgcgtaactcagcacagagaggtggaagaacctggttgcaaacagagtcagcttacagatagtcaatatattaagtaacattgtgaatcagcattttttttccttccgatagaaagaattcgcatgcacacatatgcaaacataagtaagttgcgcaaattcaatacattaatagaaaatccaagaaatgccattgacaagcactcaatttcaagaaatgtcatcaagtacaagttccatgaaatgccatcatacaagcaactttgtcccaaaaatgccattgccgttagggttccattagcagccctccgttaagtgctaaggatgaacagtgcacttaacggcgcgggattgggggaaccctaacagcgatggtatttctgagataaaatcgtttgtacgatggcattttatggaactcgcactcattgatggaatttcttggatttgggtgtttgtcaatggcatttcttggatttttctcattgattcattgaatcaaaactgtagataaggacaaaaaaggaaagtgataatgctaatagaaggatcaacaaaagtgattcctctctaaaagcaaacaggaggcgtgattcacctatgtaataaaggaatggaagttagaacattgaggtgtgtatatgttatctttttattttcaatattacaaccaatagttctcagtgtctcaacatttttttttttggcaaaataactagaacacactgaaattttgctatgtgatcttgataagctcaatagcacaaagaattgggcaatgatattgaattgaaaatttaagatggacttcctgttaattttatgagtatagtatagctgtcgatgcaaaaatacttatcagacaactgggaataagtaacatggaataattagataattagcaggttctaacatcttctatgaagcagcacacaaaccaagaaaatgtggccataatttcataagaccacacttgatatgaaaagtggagataatggattgctcatactttataccgaagaactcgggaatcgaagtccttccacatatccgataatgccttcagaaactccgtcttctgcatattgtctctctcctgaagacgatattggatcaagattataaccatttctaggtaacaaattagtatgttgtctgtttagacaaacaacagtcaagcagataaagctcctagttctgtcttcccacgtacaattgaaacttaagccaggcaaacgagattctcagatagaaaataagcaagctatgatatgcatatatatgaaacaagcaactaacttatctgtgaaaagaaactggagtaatagacacatacaagcaaatggtcaaggaaacgaagagcacgcaaccgcgtatcattccggaagaaggaagagcctatcagacagaaggtgcaacatttcaaaagaatttcatgtaagtataggtaacctggtgatctccaatcaaatagaacatccaaaaactccattctggaagatcttatgcccaagataaagaaatgataagtgataatttacctgtgaacgccatagcactagggcgtgatgctacatcaactgatagcatcctttgcaaatccaccactaaatcagcaggaatattagaaaaggcttcacttgttaaatacgtcaaggaattcatatactgcaaaacaaaatgaaacatcaacacatctttaaaaatgctaacattgcagcagatgcaaccttaattccttaacagatggtttgtttgcataccaaagggaaactacatacatgtaccaacagcagttcagagatcaggtaattaaaattcaaaaaaaaaagcattaagaataggtaaaatgtcaaaatccagattcaagacataccattttcacattgttatggcaatccagaagtggtctacgagcaaccaggtgataagctagacatccaaaactaaatatgtcacaagccgagccaactttagaatctccacttcggaccaattctggtgcagtataattcagagatggttgaagaggtaaagctgtatcctcaacatcatagtcctttagagggaccaaacagacaaatagattatgattcaaattgtgaaaatgacacaatgatgggtattagaaagcaggttccacaaacagctaattacattgacaaacagtgttagcaaaaataattacaggggaagccaagttgtaaataatgtttacttgttcactgctaagtacttaagtaggaaatgatttgtgccattataaagaaaagcacttccattgaatgtggaaataactcagataacagtagctgtacatgcttgatgagttaaacaaaaaagagcaagaagaattatgtgctttatcatggagtgcaatcaggtcagctaagagaatctttatcaattatagtagaaatatttatgctattgctccaattagttagtgtatccaaaatggtaaaacaaatacacagcttaaaagctatcacataatgcacaactaagcataaattacttactaaccgaatagtggaattgctgtgttgatgtcaaactgcctgtggcttggtcaacagaaagagcaaaaccaaacccaccaagtttccaagatccattcaaagttataaagaccgtctgcaaaagaaatcaaattattacaacgacagaacataagacttgcagatgaagaccaaataggctaaatgcattatgcaagagcaggggaaatcacagattcaaaaattaactagtatatgcatgatcattggcaggcagtgttagattatgtgttcccgcaacaccagttcgtgcagcagattcttttgaactcatttcatgcatagttaagtgcgcaaaaaacagcatgataaaattgagcggctagcctagatcacagcatgatatgaatggacttggctaagcattcatcagagacaactccaaggcaaagaacattatattgttgtactagaaaacttgagaaactaactaaagtaaataaaacaggtaaaatgaaaaaggattctaacagatttatgacaaagcacatccataacatgaaacattcgtgcagaaactatgagttgaagaatgtgctgcattcaacctcgggtgatatagctcgatgggcaagatgggcattgttatgaagaaagtctagtgtctctgagacttgtagcaacccgtgtttaacctccagtagccccatttcctgaaacataacaataaacaagcaaatctcagtacagctgaaacacatcgtcatgctttatagaacccacggcactttttgtaaatgaatgtattctaagtaccacgtaacaatttatatgccttcccaggaaacttggcagatttcagacagattgattgcattagaaagttaactgcaaagaaagctcgctgcaaatgtttataagtaccaatgatcccatttaatgaattttctggatatggcactgcaaagtgttgcatacaaaagacaaagccttatgtcaattttcagctcaaattatgttctaacgcacaaatctagataatgttactaaatatatcccaactcacaaatggtacagttgccagtttaccactgtcagtaacactaatcacttcaacatgttaattagaaggaacttttgagctagcaaacatcccatgcccaaaataaaccaaatcacagatcttgtggactctagagcggctaattactagcaatcgccaaagtggacatctaggcacacggaaacctaacaaaaaataagcgaggcagcatcgctccgtaccatgcccttgagctccttgggcaccttgccgacgttgtcgaggcagccgagcgcgttggcgacggacgcgaacaccggctcggtggccatggccatggcggccttggtctcgtccagcgcctggacgacgtggagcaccccggggtgccggaggcgcacgagccgcgcggcgtcggcgcgggcgaggtcgaggaaggcgtcctcggcggccttggtgagccccgcccgcgcccgcgcctcggcgagcgcccgcttgtcgagcacccagacggagaccaccgggtagggcgcggacggcgccccctcccgcggccgcgccgtgtagatccgccatgcgaggccggggccccccgacccggcctgctcgagcagctcgaagtcctgcagcggccgcggccccgtcacctcctgcaccgtcgtcgtcaccgtcttctcgatcaccgccgacgccttcgccagcgcctgcgtcagcgtcttcatgttcagcgccatctccccccttccccctccgcctccgcctccgccgccgccgcagccgccgccggcgagatctgggagccccccgctgcttacgtcggcggaggaggggtccttcgatcggtcggtcggtggctgcgtgtgtttggtgatttttacgggtttttgtttcttaatttttccacctaattttcatgattttttttctctcattctcgcgtgactccgagacagcgaggaggatgcttcgtggcgaaagggttggattggggaaattttggttcgatctgggccgtccgttctgtctggcggatgggatggacgggtaggattcgtcgattcggtggggaacgggaggaagttggtggggtgcgttaacgctttcgctaatcacgttccgattcagtcaacggatttttttaagggggtaattgcgaaattaacaacacggtttttgtgctgtataacctgtgttaccttcaggtatacggttgccagtacagcgagaaggcggataatggtagtacggacctgtttggtataggagttaggtctaatgtggagttgtggagctgcctaaatccagctccacaactctagtttatttcgtgagatagctcaacccagctccactcccagttttggtggagttgaaactatttggctgagctccaactccaggagggttggagctgaagctgtgtcaaacaggtcctacgtaaaccttttctgaaggcgtaaaacactagctcagcttagacgtttagaacttgattcgcggagtggtggtgtttttaaaagccttgttagagggtgtaattaactcattaaacacccaagtttaaggaatgggtgaaggttaaacacctaaactatcagtcaaagtagggcgtcttctttattgctcgaaggtgtttttttcatttggatctgttatgaaacaacagggtgatatcatccatataaaaggatggatcacaaccgaaggcaaccgcgccttccttaggcgctccttggcaacagacgcgatggttcccaaccatcgtgtctccggttgcca

SEQ ID NO: 56662 - DNA, 8461 bp, Oryza sativa
gccacccaatttatcatttaattttagttttaattactaatttagcagcaatttcgttttagtcccttgtgttttatataatttagtcgaaatagttcattagttgtacaagtaattatgtaatggtcctacagaccgctgatgttatgtgttaattaacataggtgtttattcaaataccctgtttcactaaatttattgtcttaataacatgtcttttgcattttatttcaagacatgctctactttctcgctttattaatttacaaaattctataaattttgtactttgatttagtaaattctcttaattatgtacaacatgattaatggaggatttaatgcatgttccacttcacattttgactcggaaattaatcacatgtcgatggagccctatactttggtcatatcgaccataacttaggcagcgagtatctcgcccatcatcaagtggtctacattttgagatgattacccgatggagtcctacaaattggccgcactggtcataacctaggcaacgagcaccttgcccatctcacagaggtctacatctcatgatgattacccacatgtgttattttccaagaataagttttgaaaaatgagattatttgaattttggttgagcacaaggtagtggagtcctaaacattggttgtggtatattcaacagaatatatttgcctggagaccgtgttttaggcagcaagtataacttgcccactattaagagatctactccactgtttaattacttggagattatccacattgtgccacctaatttcgaattctaactcaaattgtcaggtccattacctgcattttttttcgaaacattacaaaatatgaagtcttacatttcgcattgagattacaaccttaatatcatgtttttattaatttacctctgtaaattgataatgttaaccatgattgtagggacatggcaacaaaagagttcgacgaactcgccctcgatgggactaactatcccatatggtcttctgatatcaaaatcaattttgcctctcgggggattttaaatacaattgaggaacccaatgatggggacccggaaattgagcctaggaagctcaatacatccctttttcttttgagactctacattcacaaggatcttaaacattaatacatgttagagacgagccctctcaacctttggaaagctctaaaagagcgctatgatcagcaaaaggaactcatttggcttgaggctaattatgagtgggttcatttacgcctacaggactttaaaactgtggcataatacaaccatgttgttcataacatttgttccaggttgaagttttgcgaacaagagccaactgaggcagagaagatagagaaaactctatcaactatgcttccggaggacaggataccgactcaacagtatcacgctaacaatttccagaaacgttctctgcttatacatacattgactcaggcagaaagacaccatgagctttctttaaagaatgcccaacagcgcccaccgggctctgctccactacctgaggtgcacttcaatgtacagaataatgctgagaataagaaaggattcaagggaaattcttcaaataatcctaagaatctgactggaaagcgcaaacgcaacaacaacaggcgcaaattcaagggttgaaagaaaggaaaagggaagggtaaggcaccacaacctcgtagcaatggcaacaagcattgcaacaggtgtggatctgacactcatgtcgctaaagactgccgcatcccgaaatatcttgtttctcttgtaccaaaaatccctcaaggacaaaaaatcttctgagaacccaagatttgaagcccacttcaatcttacacataaagagcgccctgaggttgcaagttctcaccaggctcctgttcaaccagagagcaacctcaatgttgtcccagaagatgtcgctccactctctgcgatggacgatatgttcatcgaatactgctcaacggacccacttggagatttgcaatgatctcggtgcgtcccacttggagatgaagctgctcttatctcaatgtgcttgaaatagtatattgatatcctataagtttgccaaacaatattggttgtaataagtagataagtatgaactcccttatattgtaaggttgtatggcttgctagtcattagagtatgtactattaacatatgtaaacatcatactatgtatctgatgttttaattattgtatgtatgtatatatattggataaagaattcttaatcaagtaattcttctttcattatagatgtctaaggatatcgctccgattggagaggaattatgtcttttggacagtgataccacaaactctatacttagggagatcaaatactttcaaactctcaaaaagagagaaggcaacgttttgactatcgctgggcgcgatactgtgatagttggctcaggacgagcaattattacacttccaatgggtacacaaattacaatcgaggatgctttattgtatcccgattcaactcgtaccctactaagttatagatatatccgtcaaaatgggtttcacattgaaacccatatggataatcgagaagaatttcttctcttaaccaaacaacacggatatggcaaacgcatttgcgagaaaattccatctctcacatcgggattgtactatacatacattaagcccattgcacatgttgcgtataaagtaatttttcaaaatgttgatgcattccacacttggcatgatcgacttgggcatcctcggtatcgggatgatgagaaaaattattggcaactctgttggtcatcatttgatcactgacaaatttcccaaatcctctgatttcgtatgcactgcatgtgctactgggaaactaattttgagaccatcttatctcaaaattagagccgaaccacttaaattccttgaacgcattcaaggagatatctgtggccctattgtgccaagatctggaccgttcaggtactttatggttttgattgacgcatctacaagatggtctcatgtgtgtcttctatcgacacgataccatgcctttgccaaattaatgtctcaaattataaggctgaaggcaaattaccctgaacataggattcaatcaatccgtatgaacaatgctgccgaatttacatcccatgctttcgatgattattgtatggcattgggaattcaggttcagcactctgttccatatgtccacacacaaaatggtttggctgaatcattgatcaaaagaattaagcttattgctcaaccattattgatgaattgcaaattaccttcgtcgtgttggggtcatgcagttctgcacgctgctgaccttgtccaactacgaccaactgcatatcatgaaactttcccaatgcagttagtacgtgaaaatcctccaagtatttcccatttgcgtaagttcggttgtgctgtatacataccgatctcaccaccacagcgtaccgctatgggcccacacaggaaagtagggatctatgtgggattcaaatctctgtcgatcataaagtatttagaacccttaacaggtgatctatttactgcccggttcgctgactctatcattgatgaggaacatttcccggcattagggggagacttcaagtaccagaaagaatgccaggaaattgattgggatgcccagggtgttccagcctcagacccacgtactactgaaattgaacttcaagttcagaaaattatacatttgcaaagacttgcaaataacctgccagatgcatttaccaattataaatgtgtgactaaatctttcattcctgctcagaatgcaccagaaagagtagaggtaccaaataaaaccactcaacttccactcactaaaaagagaggaagaagtatggccacccagcgagaaacaattgctaataagcaaagaaagacggtaaatgcaaaccaacctttagttgttacacaccaaattgatactatatatcaagcagatcgtgatagtctgcaacctagcttggtggtgcacaatgctgagactaggaatttggaagaccatatacacattgtttcgggagatcacgatgagtctataagggttgatgaaattgccatcaactactctgaaactggagaatcttttgatagaagagctacaattgtcgacattaatttttctgaacaaattgctgattgtctccaagttgatccagaacctaggtctataaaagagtgccaaaagcgctctgactggaacaaatggaaggacgcaattgacgcagaattagcctcgctttacaaaagagatgtattctcggctgtaatgcctactcctcgtggtatctttcctgtgggatacaaatgggttttcgtccggaaacggaatgaaaacaacgaggtggtgagatataaagcaaggcttgtagcacaaggttttacgcaaaaacctggcgttgatttcaacgaaagttactctccagttatgagtggtataactttccgatatttaatatcattggcagtacaaaatcgtctatttatgcagttgatggacgtagtgacagcatatctttatgggtcacttgattatgatatttacatgaaggttcctaatggaatcgacatcccgaatcagaaggtaaatcataacatgtattgtgttaagttgcagaattcactttatggcttaaaacaatcaagcaggatgtggtacaactgattaagtgaattcctttcgctaaagggatacactaaaaatgatgattgcccgtgcgtctttatcaaaaagtcccccacaggattttgtattatctcggtatatgtcgatgatctcaacatcataggcaatacacaagatattaatgaagcacgtcatcatttaaagacggaatttgagatgaaggatttaggtcaaaccaaattttgcttaggtctacaacttgagcatttaccttctggaatccttatgcaccaaagtgcatatacccagaaaattttggagaaatttaatatggacaagtcatatccttctaaaacccctatggtggttcgatctctagacgtggagaaagatccatttagaccaaaggaagatggagaggatgtacttggtcctgattttccatatcttagtgctattggcgcactgatgtaccttgcaaatagtacgaggccagatattgctttccaggtaaatctattagcaagatacagcgctgctcataccaaacgccattggactggagttaagaatgtctttcgatatcttaatggcataagagatcttggacttttctttaaaaagaaccaggattcaactttaattgggtatactaatgctggctatctatctgatccccacaatgctggatcacaaacataattcgtatttttacaaggtggaactgctatttcatggaagtcttctaaacagactctggtagccacttccacaaatcattctgaaataattgcattatatgaggcatcacgtgaatgtatatagcttcgcagaatggttaaccacatattaacatcttgtggtattggttcattggaatcacctaccattatctatgaagataatgccgcttgtgttgttcagatggaaactagttatattaagagcaacatcactaagcatattgctcctaaattattttatcctcatgagcttcagcaacatggagagataaacatcttgcaaactaagtcatgtgataatcttgttgatttattcacaaaatctctaccatactccacattctttaaatgtgtcgaaggaattggtatgatacgacataaaaatttgcaggattcagggggagtatcttcctctggaaaataacctattttcgttatattatactctttttcctttgtatgagttttaccctttaggttttctcatccaaagtttttaacgaggtaatatcaacataagttatatttcttatcatttggcttttccccactagggtttttactaaatgataaccgtagacattatactattttggatcatactatgagctttactcatagatctaaaatagtcaataatatatatcacggttctctccttatttttcccactgggttttcgatgagttttacgtgatgtatttaactataattatttctaagattatctttacagatatctggaacagtgaaagagcaatgattaaagctggattcgatcaagggggagtgttatgaaacaacaggtgatctcatccatataaaaggatggatcgcaaccgaaggcaaccgcgccttccctaggcgctccttgggaacggacgtgatggttcccaaccatcgtgtctccggttgccaccccttccccatctatatattgtaccgcattgatcaataaagaattccgttcattcattctctacattcttggtgcaattctctctcgctcaatccctcccgctcaatcaatcttattcaccattttttacaggatccatgccattataatttgtgtagtatacgttttttttcactacctatcccttcaaccattttctaaaattttaggataaaattgcccacgtcttcttcctggtcttctccccatctcacatattcatcttccctctccttcttcgaagcagtaggtggaagttggaactgacggcgatgggctcccaggggaggagcggcggtggcggggcaggggccgccaaatccgcgagaacgtggcgagcccaagacccaccaccaccgtcaccgtagctgcactgtgcgcgctgctgcactccagcatctagcttggcctcggtggggggatggcatcaatgggagtaatgccgacgagtctgggttgggataaatccttgggtcgccggcgggggatggattgatgatacatcctgacaagcttgttcttcttgtagtcgagcagaataatggcagcaagttgatagagcatcgaaaggattggcctttgggtagaacacgtgtatctaatgttagctggtatgaacgtggttgccgtctgtatgaatgaggaaggggggaggagagaaagagcccgcgcctccccaactacggatctggaagcgccgccgcgctggagctgcaccattgtccacctgtcgcactcgagctccatcatcttgatctgctcgagagagcttcgccgccggtccacctgtcccgctcgaccaccagagggtgaggacatttttatcaaatacaggtaaaatacatatcttaatggtacaactgaaattataaacaagtgatcgtggcattgttacaaatacgtaaattataatggtatattttaaaacctcaatatttacagtggcataaatctaattaatcattttcattttggagttgatacgtctgctgtagttacacgccatgacttatgttgttatgttagtcaaatctcttaattgtactgtgactagggatgtaagcgggccaacccgagaacccgtttatagacaaaattagtgagtgacccgcgggttaactcgtggattacctactaatttgacttataaatgggtttatatattaacccacttgcttttctataaacgcagcaagctgagccatgacgtgaaaacccgcggattaccctttatttaacatataaataggttcataggtcgtcccgcttacatccctaggcatgtccattcctcagaaaaactagtttttgctgaggtgatgagtaagagatctgcttccattgcgtgtttccaaaatcactttatttaaaatttccatttcccagcttatatcacccactcctggttattttttgattgagacactgtggagctttcattttcttttctgtagatctaaaatatgactgcatggttatatgtttacgtatttgaaaaagaaccgagtaacttgagagtacttttttggcgcatgacggcatgtcggcatgcaccatctcaaaagcatggtaaaaataatacagtaatgaaaacatgaaatatatagtttggctagatggatatgtatgtgtttggtcaatagagttaagtatttgaaaaggaaccgggtaacttgagagtatattatttttggcgcatgacggcatgcaccatctcaaaagcatgattcagatagtaatgaaaacatgagatgatttgaaaaccattgacacgacacggatgtacatgtccaaatactatcaactttacatccgtttcgcacgcggataaacaaaggaaaattaagctgctagtgtcattgtcccttttccaaaattctttccattataatttgttcttctgtaaaggcgatatgtttttctaataatggattctaaattcattaatccggcatctataaacacgagggatatacacagtcaaaatgatagaagagcacttagactcacacctcattaaaaaggagaacacacaacaaaaaggaaaaacctacgatc

SEQ ID NO: 56663 - DNA, 2644 bp, Oryza sativa
gcatccgccgccaccatcctccgtcgcacctgccgccaacgtcctccgcagcgcccaccgcctcccaaagaaacaccgccatggcgtcgtcgacagctcgctgctacctgccgcggcgctgttctcctgaccacctctgctaccatgcgcaaccaggtattggcctgccaccgccgcccatggccctgccgtctctcgcactagcgcgccgccagatctgggggcaaaccccagacccaatcccactgtccgtcgcaggtcccgccgaagccctgccgccgccttcctcgcagccgcacggcactccggcggcctgctagggtggcggcatggcagcagcgaggagacaagaggtcgaggcgatgagacgaagagacgaggagtcctgtgaaggagatatataaggctttgaaagaagtccagtctagagcatctccatcaatatttcatattttaaagttgttaaaatgtatatatgggttaccccatttgtgagaaccctaagatcaccttttaagtccggtaacagctctcatttctcagtcttcattttattttttcttctatttcgacatatgccggtttactcaaaacaagaaagtatacatcgatgaatatttcagagcagactgatctcatagcaaacctagctatctgattctgcatctcctgtccctctaaaccctgacgatgcgctgatcgttgtgccggagttcgtgatgatgccagtgctagctacagaaattgcaaagactaggttgatttgagctccttgatcaagtacatggttgattgtgtgtgttcgtcacacctatacttgcaatttcacttgagaaaatacatgacctgacaaaaatgaaaaccaaaagaagatagagtccatatagagaacgcctatgcttcatcgatgatcaggccaatgctccaagcacgatgctgatcgactagggatcaggcttctctaccttcagagctaggtgcctttgtcactaacatgtgagttcaatgaatcatggatacacctgtcctgtcagtgacaaaggaatggtgtctttgaaggtagaggatctcaatccatcaactaggctccatcctcgctggagcaggtcggagaggcgcggcggctagagtggggcaaaggatccggagttgcgcaagatccatccacagtcgccagccccttaagactgaggggcttggcatgaaataatttcgagatgatttacgggctgcagtagggatggatctagtttttaaaccttaaccctcaatttttgttttgtttgagacctgtgtttaggggtcctgctaaagacgctcaatgagagcgtatttgtaactgaaattcagaataggaaaaaaatagaatcgagactataatcaatattttgcggttaggtatgtgaacgttctctccaaaaagacatcctacaactgattataagacacttaacgtttattggaggaaaaataataattatagataaaaattttatatgtgtcgttatggacttaaaagtcaatgctagaataaattataacaaataacatcaaaattaagtatgaaattaagcttgaaaaaaattaaatttagttttttaacacttatataactaacatactccctccgtcccaaaataagtgtagttttgcactattcatgtccaacgtttgaccgttcgtcttatttgaaaattttttgtgattaatatttttattgttattagatgataaaacatgaataatactttatgggtgactatttatttttagtttttttcataagtttttcaaataagacaaacggtcaaacgttagacacggatctccacgactgcacttattttgggacggaggtagtaaataatagtagatgcataagtccaaaattaagcttgtgtgaatgataagctgaaatgcaaacgataaccaattaaaccatacatttgccacctgtcctaaactttgacacggataattgtatttacagctaactaattattctttcagtgataggtgatatacacgtcaaagcgagcgcttgtgtttgtaccgtgcaccatatattcttccatgcatggtttcaaaacattttccgaacaaatacgacagataggtgagaatcgatccgtgccttttcaccaatagcaatcacagagtcctctggtcatttcgagttcttagaccatctacacgcaacaaaacctgctcaagtctttaaatagttctatacttcctatgtaaaaaaaaaaaaccttatacagatgaatctaaatgaatatatttcagatacactcttagaaattgttttttttaacggagagtacttaatttcgggctgcatgcctgcatccaccgtgcatgcccatatggcattacggcaaaatcctccaatttttttaaggcaagggcgacctcatctctcccaatcactccacgccaagtccacccacaaatccagacatgtaaccgcaggcaataaacacacagagcagtacaggtactggagtgagagtgagagcatgcccggcctgcactgcacgtcgcccctcaatttcctcggactgtttgtttgggtgcacgccaatcactcatcaccagcaaggattataccccccccccccccccctgcacgctgatcgga

SEQ ID NO: 56664 - DNA, 3503 bp, Oryza sativa
ccgcccagtcaatggtgcagctcatcagaaaaaaaaaacaagaaaaagaaattggccaaacattttcttgcctcgcgcagctgcgccgttgccccgcgcgcgcgtcgcacaagcaagtaagcaacagccacagggcgccgcaccaacccggagcagtcaccggtgatcgatccgaccctgcagagtccgggctccagtgctctctccacggtactccctccgtaaaaaaaaaaaaaaatggctacgtgattttacctacgataaaaaatctagacatagttatccagattagcctttttaagaaaaaaaaagtatacgtggaacacagtctagacatagttatccagattagtctttttaagacaaagaaagtatacgtgaaaaaaatgttttttaaatactttttatattgaacttttttaaaaaaataaatagatcctgtttttctataagatataacaattaatattcaaataattatatgttaattaatgatttgtctcattttagatgcaagtgagaaaggtaataactaccccactgaaactgtggtcagatcatgggttggttttcagaatatgggtagtaaactactcctggagtagtgattggctgcaggttgacgatgacatgatcaaaacgaaagggccaattttcctggagatgactacagtacaaatacggacgacaataagaaagggaaatctccccaggaaattttaaaaaaggaacatggaggaggagaaagtagaaacctgagtaatgccttgtttatgtaatataatgtatggggatgagtaacaggtacaactaataaattcatggtccacacaagcttaattttggacttatgcatctactattatttatgttagttatataagtgttaaaaaacagtccacataataatatctacgagttgctctgttgacttttagaggacgttttttttttttgaaattgttcttcaagaatgaagtttgataattaatttcccataaaatgtatttttaatggatatagactacattgtgcgaaagcactttgaagtataaatctatcggtgcaggtctatgcactaaacacatttgtaattgagctatttgtcgatcaaaatccacagagtttgacttttcaaaattaaaatgtcttaacaaaattcaatacagggagaatatatattagaaaaatattgagagcattatatatcgtattgaagcacagtggcagtcgttttacttttatagagaaaaaccgacacatggatatataccacggccattggtaagtgtaggctaatctcacacgttatttttgttctatgatagtgtatatccattcccgggtacttgtcaccacatactatttatactcaaattttgaccacaactattctagcagctaaattgtaaatatttgaaattataccatagtattgaagcatgttgcatgctaaatatataatcatctaacttccacgcataaaatttgacatttgagaaatatttgagaacgaagcgaacattagagtgcggtgaaaacgacttgtaagaaaaagtatggtaaaaagacctggttcaatcctatgtcctaagtaccatgttaatgagagaagaatatacggtttgacacatgtggaaattttaaaagtatggcgggggattaaattataatggtgtaaattaaaacaaaagacacatgtggaaatacaatttagaaaaaaaaggtgatactgtttaaaaaataatcttgactatacacctagacaatataattaataaatataccatagaggagttcatgtcaaaacaacgcatcaacaatggaatttttgtttggattattggaagataaagatagaactagtagtttgctcactggataaattccaaagtaaataaaatacttttgattcttgaaatacaaatatactttaaatcaaaaccagctgcccaaaagttggccactaaaagctgaagcaaatagcatacccttccatttggcaaacgtccagatcatgatctgattattagcctataggcaaccaattgaaccaaagatgccccgtaatatcaccccctaattctcagatcgagcaccgggacgacacttaactgacgtaatcggtagaaaaataaactattacaactatagcaacccaactaactacaaacacaggtgaggtgatcaccggcatgagaaatttgaaatggaaaataaaaatagtgccatgcgttgatccgtcccagtacaccaatttcagaagcttgggtgttatgcccccaaatcgtcacttccccctgattcacaagcaagccccaaatcatcagtgtgtgacagaaaaaccccccttaaaaacgtccgtgcggtgggcgtaggttaagagagaccgtgcgcgcgcgaaatctctcacacgcccacagctcaaacgcgcgcgcgagaggaggggaggggtttggtttgcttggacactttggtttggtcgggtagctcacctcactctcatccgaccagcgactctctccctcctcctcgcttgcacacttcgtactctctctagtcccccgcatacatgtcgtccgcggccgtggcgtctccgagggagacggtgtcgccgcccatgtcgctggggaaggttggtgtcgccgtcgtcggcggcgggaggaggaggtcgaggtaccgcctcgagacgagggggttgtcgtacgtgctcccggcgaggggggcggcggcgaggttgtttcttggaggcggtggggaggagaggttgctcctgaggggcgtgacgtgcgaggcgccgcccggggaggtggtggcgatcgtcgggccgagcggggccgggaagacgacgctgctgtccgtgctggccgggtcggccgacccggcgagggtggtcgccggcgaggtgctggtgaacgggcgcgccatggacgctgcgaggttccggcgggtgtccgggcacgtcccgcaggacgacgcgctgttcccgatgctcaccgtggaggagtcgctggtgtacagcgcgcggctgaggctgcgcggggcgggcggcgggaatggcggggcggcggtggcgagggcgagggagctgatggcggagctcgggctgcggcacgtggccgggtcgagggtggggagggtgtccggcggcgagcggcggcgggtgtcgatcggcgtcgacctcgtgcacgacccggccgtgctgctgctcgacgagcccacctcgggcctcgactccggctccgcgctccacattgtcaagatgctcagggacatggccgccgcgcacggcaagaccgtcgtgctcaccatccaccagcccgggttccgcatcctcgagctgctcgaccgcgtcgtcctcctcgccgacggcgccgtccgccaccacggctccctcggcttcctcgaggctcgcctcgccgcctccggccacggcatccctccccacgtcaacgtcctcgagtacgccatggagtgcatcgactccctcaagcccgaggtca

SEQ ID NO: 56665 - DNA, 9397 bp, Oryza sativa
  unsure (1)..(9397): unsure at all n locations
gtactgggtgttcatgcactacgccagcctgttcaagtacccgttcgaggcgttcctcgtcaacgagtacggcggcgcgcgcggcggcgccgagtgcctcgccgaggtcggcggggggctctgcgtgctcgacggcgccacgctgctgcggcagcaggggatgcgggcgagcatgcggtggagcaacgtcgccgtcatgctcggcttcgtcgtcggctacaggctgctctgcttcgtcttcctctggttcagatgccaccgcatgaggaggtgaagcgcgccaaaaaaaatgcaaatagtaattgctcaatctgaattcgacattttttttcttctctttttttgctgtgcttttttttctctgagacattttcatcttgggttcgagtaggataatacgaatatatatatatatatatatatatatatatatatatatatatatatatatatatatatatgtaattaaattgtatgtatgggagatattgatcaaattctggtggaattggatgttcttatgtatgaaaaattgggagaaataatttgatggtcaggtggttttttgtttgcttgttactttgtgattgtgtttttcaagtattattaatttatttatcattgccctttttgtttgtgtccttttccaagtatagggaagaaactgtcgcattcgtgttagatttgccattttgatggtctcttctagaggtagatgggaaaagcaagattaagatgctaatcatatgaggtgagacagtgatgacaaaggtcaaagtacatgcagcaggttggaggcatgcctaatttgcacctgttttattgaaacaaaaagggtagctctgctagaaaatcaagtgctaatcaattgtcaggacgcagccattttcctgtttcttacccaaaaatcttccatttctgcattcaaaacaaaataagctaatcatattgtattcgttaagtggaggaaatgaataatgtactcctatcaaggtttgagattcttgatgtcttgagatgttcttttttttttcagctgacgaattcttttcaactgggtttagttttgtgaagttgaattttgctcggtacaatgaagaacaaggtggtggaagctaaaagcgatgtatgcataatacgcaactccacattttatgatagagcaaccttttaacatagtacagctttacaagttttaccaaacctttgttaacttgcacactcgaatttaattaccttttgtccctaccgttccaccaactacttttctcccccacaatctaaaacctcatagctggcaatctagcattttttttaacattatggatgtaagccaacaatttgacttaaattagatccatctactcctcccgatcatggtaatatgtcatttaaatatgaaacattggtacaatcttcgaaattaattgtaaccatcaatttcctataaaatgtatttcaaaaatccataaaattacaatattgtaagagtgtatattttgagaaatatatgaccgtatgagcttcatgtatcaaatcaaaatattttaagagaaatataagaaatgtcattgataaacgtccaattctaaaaaatgctatccataagtacgagtttcatgaaatgccatcattcaagcaactatgatatagaaatatcatcgttaagtgctatagaatgaacagtgtatttaacaatgtggaatagatggaactctaacgatgatgatatcttcgggacaaaatcgattgtactataacattttatgaaactcacactcgttgatacaactcttggatttgggtgtttgtcaatggcaatttttagatttttctcatgttttaaacgataattgctgtcaaattttaaagtttaactaaaaacatacaaacgacacgttctcaaggctagtgaaagtagctcttgtgaatctcaaagaattttcattccgagatacatacgagggccaacagcccaatattaaccaaataaaaaggaggtgtcactgacgtggtgataaagttgtatgtaggtgattatagcttcgcttattattgtttaaatctggatgctcataaatattacgcacataccggtgaagttttattagaattttagtaatactaggtagttgccataggtctccatctctataagcgtgtattactatattatgaatgtattcgtgggtgcatgagtatggtgttacgtctagtggcgtgtacgtgcatatgtttcttttgcgcgatctatgtattctatatcgttgaaataaaaaactaaatatgcattaagccacaccacctaaaaaaatcttgacctttggatcatcaattagagagctaggaggaataagatgatgtgaaactaaagagttataaagacatttagttctcttcggttaacattcattttattgttgtaattacggtacgttcgtgtagcttcaactttcaattgaaaaactattgggcatataagtgaagagctttaagccatttatggtgctattcattggtagtagaaagaaatattaactattgatcttatttgatcgaagagtttagatctatatatatcaccttagttagaagtaatagaaacataaagaaacatcattgttaaaaaaagtgtggagaggcataatcatcatttagcagtgactaaacatttttccacatttttttgggctttttcgatggaatatgagcgatgctagggtaatggattaccacatatcgatctagctgaaaaaataaacataaataacaaacttatccttaatcattgaactaataaattactgatttataaagtatattaccagtagagagcaccgtagcatcgctcatatttctgttcttttgtatattttctatggctcgtgtatcttcaaaaatcatttatctttacatagtagcaaagcacaacataccatctatcgaaaaggaaaaaataaaacatcaaccagctgggaggcttttgattgacgctggccaaaagcacaatctttttttttcctctctgaagcagcagaaagtgaaaggattcagaaaacacaccttattgtgtcgtgggcatggtggggtgtaccgcacatgtcacaccgtcaccgcaaatggcatgaccatgttgagcttaaaattttgctacaccaaacatgtctgcatatagctttccaaaacaaattttattccaaacagtaattcatggagctaaattcatacattttgacttttgagtatcccgttccagtatttacaaactatactgcatgggtggcatgcactgacatcgatctcactctcgtattcccatccatcccgagaaaatggaagcataaacttcacgtgtaacgtaaaactagaaactactgttgaataaagagtactacctccgccccaaaataagtgcagccgtggatatccgtgcccaacgtttgaccgaacgtgaatagtataaaactgtatttattttgggacgaagggaatagatgtttaagatttatctacatcatgttatatcacgagtaaaaattttatttattatgatgtggataatttttagatgtcttttttttaattcaatggtcctttacatgtttgcgctagctacttaagctatacatatttctccatgcatctcgaccatccggtgcaccgtgcacagcgtacgtcccaaacataagcagcagcatctcttttttttttttttgaagcagatcaaattttcaagcagcatctcatcagtgcgcggcagcagagagaacgcggggtgctgctaactcgccggctaaaatgtgaccccgggtctcctaatatactttatttgttttaaaatggttgacgccgttaattttttaagtacgtgtttgatcattcgtcttattaaaaaaaaattaagtaattatttattctttttatattatttgattcattgttaaatatactttcatgtgcacatatagttttacatatttcacaaatttttttaataagatgaacggttaaacatgtgctaaaaagttaacggtgtcaaaccattttaaaacggaggccgtcgcccgtcgccatcgtcgtcgcgatgaagaatgcggcgccgttggctttgcggcggttgcccgccactacggcgtgcaagcatgcatgcaggctggtcgatcgatcgcccggcacgcgcggcggcggtgcgcaacagaagtaatgctccatgccatgcatgatgcatcgatcctctgtacatcatcatccagcagctaggattgcattcagcgcgtggatgagtggatcgaatctccgaaatggaacgggcaggaggggtccgatgaggtcggcgacgatgcatgttgctgtcgatcgagctaattctagccgataattccattggccaaactctttgtctgcacaaccaatgagcgatcagtcatcagttggctgtgttcgttttggtgtatggctctatatcgttgcgatcagatcgatcaaatgatggatgatgtgaggaggagggaaaaaaaaggaaaagggacccgagtcgctgtcgatatacaccattatcgatctatatctatatccatagatcggcgatggtatcgatccaccattggctagctagctcctttaaacttgcattgcgttgtacgcttaaattacccgtttggtttccaacccaattatgatgggagccgaatagccgatctgcctccctctgctggtgcgttgcacacacgaaggtcaaaagttttgagccagataaattgacggagattacgctgcgtgcgcactggcgcgaaaaaaagaacagattggccagagtgccagccccagataaataatggcgcgctttttgcgctttttgttgtgaatgtgatctatcgagagcgagaagaaaaggcgcttcgccattgtagtcggctgagtggtgtctcacacacaatgctttcatgtttcatcaacaactcggaggacatccgtgtgtgatgagcaagatatattgatattcctttttttctaattaaagtatgttgatcaactgtagacttaacctgctattattgcaccgttccacctttactgtacatccacctcagcattagtcacgctccatatgataaattaaatatttataaatatgaaattaacaaatattagctccgaatggttcaagcaacacaatacgaaaataatttttttaaaaaaataatttaagagacttgaagcaaataatccgtgatgataattttgtgtggtagctaaaaagaatgaggtcgacgagtgaaatgagcaactataatgttgtactcggtgggtgtcaatgggtgtaaaatgaggatgtgccatcggggaaaattaattatttgtcactattggatttaacaaatcttcaaatattcctctcttaattttgtcataacaaaactgccaataggtagagttgattttttttaactatttgcgaattttgcatgtgcggcttaccaacgtgaaaaatcaatgtgggatccacaagttagctctctcctccccttcatcacccccaccagccagacaaggtagagagggcagcagtggtggaggctcgacccaaaaacagttgctagctcagtaggcgtaggtagtggtgcggcaagggagataagggtggtggttgttggggggggggggggggggtatttactcgggccatcttagagatgggagcaatgaagcgagggagcccatgatgctggcgacctccacatcccagccagggacccgttgtagcagtctctagatgacggggcaatagggagcaggttagggggtcagcttcgtgcaaaggaggcccgacgtggaggtaggggcctcccattccgcgatctggcagatgacaatgcaaggccacccttgagcagcgagcttgggaggccttttcatgtcccaacagagatgattagggctttgagtgaagatctatgtggcacgtcgtgaatagcagaggaagccagaggcagagcatgagaggctacaacggtggtcagggaatgtgggatggagcgggtgacgttgacccagatccaaggacggtaagacattatctttctattggtaatttcataagtttaaaattgagggtcacttagaaagttgctaaattttgatagtgacatatagttaaatttcccttgtcagcaaagctaagttgcccatcgtcaacatcagaaaatttgtaaatggattaattataaataactacagaaagataaagttttgaaaaaaaaaagaaagaggaaggtatacttttttttttagaaaattataaatttaccactggtttgaatcggtattataaaactgatataaaaaattaaaaaatattactaaaactgtcattcgagtggcaatgccctttttttaagagaaaaggaggaataagggatcgagacaaattacatttcttggcctcttgggccttttcggctttcccctcccatggtcttgagacttgagaggagagggcaagcgaggttgggccggaagtattcacaccagttttggcccgttccagctaggaaaaaaacgaaaaagtacaccgaaggtccctcaacttgtcatcgggataaaaaacgtccttgaaccgcaaaaccagatatacggggtcccttaaatatataaaaccggtcacccgaggtccttcggtggttttgactccggttttggtctacatggcggctgagtcagcgtgggacccacgtgggtcccacatgtcaggtgtccacatcatctctctttactctcttatctttcccttcctcccctctatctctctctctcgggcagggccgatggtgagcaggttgagcagcggcactgcgacggtggtcggcggcgacagcgactgccgccgcgcacaccacgcctacctcgccgctgccgccacgaggcccgaggcccccattgcgtcgtcccccaatgccaggctctgccgcctcatcgcccgcgacgacctcgccgaggccacgcgcctcgtcgaccgctcacgcggggagacacccgacgccgccgtcgtgaagaccaacgccggcgaagtccatgagccgaagcaccaggcacacacagccatggacggcgttgaagtggtgagtgcacttatcggctagtactatgactggctggtgctggtgctgcggagaggcggcgttggcgggcgagagcggtgtaccacgagctctagcaccagcccgttgtagtactggccgataagtacgctcaccacttcaacgtcgtccatggctgtgtgcgcggcaccgccgccgttgcagtgccgctgctcaacccgttcaccatcggccctgcctgcgagagagagagagcagagaggggaggaagggaaagagaagagaggaaagagagatgacgtggacacctgacatgtgggacccacgtgggtcccacgctgactcagccgccccgtagaccaaaactggagtcaaaaccaccgaaggatctcgggtgatcggttttgtatagttaagggaccccatatatctggttttgcggttcgaggacgcttttttatcccgatgacaagttgagggaccttcggtgtactttttccggaaaaaaattctgctagatgggccacattttcccaacaaatatcgggttcggcctctaggcttccatccacgaacgggggctctcaccggcccagccgccgccgacgcgctctgctccgctcactctctccccaccgcccaccgcatccgaagcacgcccctccctctcggtctcgtcgccgccggtgcgaccgcggtttcctcctccccgctccacctccgcaacacaaccgtcttcgagcctcgggcttcacgtcgacctcatcggcaattgggcaccgcaccctcccctccccatcgccgggttcgccttctccgcgcgcaactcgtcgcgtcctcgagctcggctaattaacgatacttttactgattactgagcggttaacgacaagtccaactaacaaagtcgtcgggttggtgtcagtggcccagtgtgccacctactcctcctactcaaagcctcaccgcctcagcatcgcacgacgcctaattaatcaattcctttcccgcgacacgcgcgcgagctcaantgcctcgcttcctccctcctcccgatcgaccgcgccatggctgccgccgccgtcaccaagtcgccgccggcgctggtgcccccggcggggcccaccccgggcggctccctcccgctctcctccatcgacaagaccgccgccgtccgcgtctccgtcgacttcatccaggtcttcccctcctccgccgaagccgccaaggaccaggccgcatcggtcgccgccatgcgggagggtttcgccagggcgctcgtccactactaccccgtcgccggccgcatcgcggagccggtccccggggagcccgagatcgactgcaccggggaaggggtgtggttcatcgaggccgaggcgagctgctcgctcgaggaggcgcgcaacctcgagcgccccctgtgcatccccaaggaggagctgctccctcgcccgccgcccgaggtccgcgtcgaggacaccgtgctcctcgcgcaggtacggattccatcacccattgttacttgagctaaattttccactgcaaatttggtctggatctgactcctgagaggttgggggttgtggatctgtgggggtgaggagggttggtcaccattgctatcgttgactcggtaatgtggggatgtcaatggcggcaatggtgtgaaaggaaaaggtctagctgaatttctagattgaacttgctgcaactgctcaattgtgtgactgactccactctgcagacagtgtgactgaccaatctgaacttgctgatgacttctgacttgctttaagacgtagtactactagcataaacttctgacttggtgtatgtatacagtatcacgcactactgatcccaagtgaaagtgatctatagctccggtggcgcggtgaggtgaactggaccgcgcggtgtgtgtccttccctcaatcctcatcctggtggcacttctctcctcgccttctaaccgttggatggatggaccaaccgactggatcatccgacactctcgtagtcttatgccctgcttgagttgcattacccgactttgaaccgcacacgctcctgagtcctgaagtgtttctgggagatatattaaggccctcaacgaaatttaacaaaacctttgacacaaactgctcaattcctgagtcctgaagtgtttctgggagatatattaaggccctcaacgaaatttaacaaggccaatcacactgtctgctcaatttctagattgaacatacacatatttgacacaaactctaacagctagacaataagccttggaaaat

SEQ ID NO: 56666 - DNA, 1711 bp, Oryza sativa
tttgagaaatccgtcattgagatctcgttggatagcatcaagcgtgtcaaggaccaggtcgcaagtgagaccaaccagaaatgctccaccttcgatgtggtcactgccatgatgttcaaatcccgtactttggctattgactttgcacctgatgccgatgttcgtctgggttttgctgctagcacacgtcacctgctgaacaatgtgctgccttcagtcgacggctactacggtaactgtgtctaccctggtggcctcgccaaaaccagccaggaggtcaaggatgcgtcgctcgtagagattgtgacagcgatcagggaagccaaggatgtgctctcgacacggttcctcgattggatgagcggtggtgccaaggagaaccattacaatgtgtcgctggattacggcacactagtcgtcacagattggagccatgtcgggttcaacgaggtggactacgggtttggcgagccgagctatgtgttcaccctgaatgatgatgtgaacattgtgccgtccgtcgtctacctgaagccgcccaagccgaagcagggaatcaggttggtgctgcagtgcgtggaggctcagcactccaaggttttcggtgaggagttgcagaagcttgcatagaggtaacttcgtgtttatacgcctacacttcgcagcgttgagagctgttgtattctggtgtgttgaatagccgcttcttgaacttggttacaaataaaacaaggtggatcgtgtttgtattctgtattgttgttaccatactacattatacattgattgacattgttgaggcagtactgttacagttgagaacaaatgattccattgatttcaagaatttgtacaatatagtcctacatgaacattatctttcattttccacctatatggtcaagcctgagacggcctatttgtcattctgtggatatacgcaggaagatatttcacatgtcgtagtaacatcatatgcctatttaccaccaatctgtgaaacctattcataactctgtgtgatgaaacattctcagtacagtgcagtcagactagcatcatggctttgtcttttggcttattagccacaacaaaaatattaaaattttaaaacttaattttaaagtctacctttaggcttttcgattgttgtttattttccagcattagtttttaaatcactaaggacagtttaaagatacacaagtttttttttttgggtaacgatgaaatcattagagtttagaagactagcccttgatcatccagcttcagtagtgttccaagttcgtcagggcccgatggagctcagcacctgagcagattcagaaatgaatcttaggggggagaacagtaagaacacatgtatggtcatgtgaagtccactaatcttccaaccacgaggagctaccaacccactgaaacactgtcctcagtttgtcacagatcagatctaatcatctatacctaacaaaaatgcctgaaaattccacacgagaaaaagaaaggcaaaaaagaagtcaaccactctcactgagcattgagagctcgtgctcgccacttagcaacaaccacttccattcattggggagggaaagcggcaaagcaccagcccagccagcgcggcgccaaactccacctaccgacgagagagagagagagagagagggggagggcatggccgccgccgccgccgtcgccgccgtcgccg

SEQ ID NO: 56667 - DNA, 1393 bp, Oryza sativa
tttgtgcatgtaaaattcgatcaacgttggaattcgtgacgtttattcgtgtcttaacgagacgttatgtcgtaactttggcgcgagagggaataaaatccagtgaagtctctggtttacatctagtcggactatcaccgtttggtataaccgatttgagatattttggtgtgtgattatgatcgttcggacagcctattctgcgaaaatgctcaaaatgggacgctccccccccccctcccgcccccgcgcgcgcccctcccactcgcctccaccattcgcgtctcgttgcaacaaatctcccacatattacagaaacaccctattaagagaaatccggttttttttcaccaacaatgttttagctaacgtactcatgatattttattgtgtatggatgaaatgatgttttattgtgtatggatgaaatgttacagtggattttgttatagtttcatattttcatcttaatgtacacgtggtttgttgatgtacacggggtttaagtattgcagtggcttttaattgtttgttgcatacgttgaaccaaattcttttatccagtgatcttactgtgtttcactacttttttttaagaattaaaatatttttttcgctatttactgaaacattatttttatatagggtgaaacaacggtcgattttttagaaacggttgtttcatacgttgttggtaatgtttcagctttttacaaaattgaaacattttcgacctacttagtaaaacatgttcgatctacttggtgaaacagcgaccaattttttttttaaaaaaatcgggcgcctaatttgtaggcgcctcgcctattctgcaatcgcttgcaattttgggtggttgtcagtcgattctgtgcgccgtgaattatgcatccaacggcatgctgaaacacaaaaaggaaaaaagagcttgcgcaaaaaaaaaaacgaatgaaggttttgggcccatagtctttttgttttggactactttgggctttgggctttgtgtagtgttttgggctaatatctgggccatgtgagagagatgcactgtgatcttctctttgactggtttgcatgcatgtgcctttgggattttgtcaaaatattttgggcttataatcgtcggcaggctgccgtgacttccgctctgagtgaacaatataaatctttggctgaaaagaacttttaatccataaaatcgaattagttttgtttcatgcatctgggctttgggctttatgacattatgtgttgcctctcaagacaaagcaagacacgtgaagggtgaagagaggcaggaccaaaactcataccaagagacacacccatatattccagatcaaatgcactatattggattagaggaagcaagaggatcaggtcgatcgaa

SEQ ID NO: 56668 - DNA, 1671 bp, Oryza sativa
aatcttgggaatctcggccacagtgtcgacccagaggatgacacggttcgggacgaccactcccaggatgatggttcctactgggagcacctcaacttggaggtctggacggtcagccttgattttcgccttggcctgctcgatggtgaggccaactagctccggccactccgtcttaagaccaccacatggcttgctgtctgatgaactcattctggtcacagcaaattaatgaagcaaaattcctgcaaatatagctaggattaatttgttgttgtgtacacgcaaggcacttaattcgaaacactctttcatcaaattaagatcagaacaggtacttacaaccaattgaaactgcttgctatcgagactgaaacgggtgttattgtccagcagaatgatagatgctctattgatcgattcttaagttgtgtgtgcgtttggtgtatgagggatggagttgtgtggtgtatttataagatgagaaaagaagcaaaacgtgcaatttttcggtgccgttaatggataggcttcccagtttgctgagatgagatatacttgtagacttattaatccttctggactcagaaaattcacggatgtaaagggtggcacgtgtgtgtggtggagactctactagtcagagaaagaaagtgtcaatttgttaaggtagtactcttctgcatataccacttggtgcccagatttgcagaaaacgatatgattaataaacattttacaggtcaaatttacaatgtgcaacgtggatataaatatgattcattggatcatgccattgtaacttcttcaatactaaaatataccactacaatttatggaattttagacatgcttaatttaataggtatttcaaatatgccactacatgtgtatttcttcgatgaaccaacttgtccatgtcttcttttttttttttcatcccctcctcctgttcatcttctgcaccattaccatcagagatggactcggccagttatcagcatggagctatagcttagagcagcactgcagcaggcagccaaatccatccaagcttgttgccgctgcctgttaaatgcatcgaatagctaagcactgacatatcactaatgcttatttttggttctaccatgattatggtttcatttcctctctgcgccacatagctactactattatttagctcgaaattaattaaatcttcctagctccaaatgcgtttagaagaattaattatactcagctctatatgtgcaaggttcatcgtcaaaattcaaatctgcaacccacaagtagccacgcaccatatggccaaatgtccccatgtccaaatcgttgaatatgcatccaacaacccctctacacgtgggtgcacatgcatgaagattgaagcctatccactaatgactagtccacgtaccggcccgctttgaaacttcgttatttacacacgttgctcgatgtattggtgtgctgtgtttttttttagaccaaattgctccgttcatatggtcctataaatgcacgcatatacgttacacaaatccaaatccatatccacacatcgcggtgcaaaaccaaaacccactgcagagaagaagcatcgatcaattcaagttaccaagtacgtactcctgtctctaccgtatgtgtctacctgtttaggttctt

SEQ ID NO: 56669 - DNA, 1662 bp, Oryza sativa
gatcggcgtctgcgcggagacgggcttctgggacgcgctccgccgcctcaagctggacgtcctcggcaccgacgactcccccatccccatcaccggtgcgaacccctcctcctcctcccctacctttgcttttgttgttcttagttccgatgttttcttccccccgaaaacctgccgtctcgagcggggaacgggaagcgtgcgtatccccgcgtctcccaggcttcccccatggaattcggacgcggtggtggttcgtcggagcgattgttaagagccgtattgtttgcttatgggtggcgatgccgagtgtggatgcttgtagattaggggtttcgctcgcctgagttggtggtttgtgagcggaatattgtttagggagaggttgcggcgatacgaggttttcctgaatgccacattgagttggtctccgtgcgggagttcatgattttgtcgtcgtaatgggtgtatagtaatttggattttagaacttcttctgttgtttaatgatcaatttctagcccgaagccctactgtttgttgtcattactgattgctctttctgcaatattgctgttagcacccaaacagtgatgtatttcagattgtctgttgagaatcctaagagaagtactagcaattagcaaatataattcaaattttgctaggtcattttggttttttagtttggtcgtccatgtgttgccgtgtgaatggttttttcatggtttgatttctcaatcaactgaacaagtttgctgaactttattgctaggttattatactccacgccaatatgagaaaattgcaagcctctttaggatatgcccagaatcgatactgccaccttctgccaattcctttggcgataggaacaattgtccagtcccagggaccctactaaacactaataacatgagaggattccaaaacttggacagagcacttctactgaaagctgaagcaaagaaggtacatgcttgacatggaattttgctagcattaccactaacactactagtttcttaaaaaaaaattaaagcatgtaatatgtgttgcagatcttgcatgatattaaatctggcaaagtagaagagaatcctgctttgctactaaggttccttgtgatatcatttgctgatctgaagaattggaaagtatattacaatgtcgcattcccctcgttgatttttgactccaagataactttgctcagcttgaaacttgcctcacaagtgcttaagcaagaagaggtcatgttcctttgaaccttatagaattacagttgacaaaagatttttcttgttttaccatttccttgttggcactaaagattgttctatttctgcaggcaacatccttgtctaatgcatttactgagtggcgtaaatcaagtgaaacaacaggtttgagatgaatacctaattgggattgttttacttggttatgtcacttgatgcctaaactgtattatattgaaatttctgcagttgttccattctttctgatcaatatatccccagattcatctgctactataagacagctgaaggattggaaagcttgccagggcaatggccagaaggtctgttttgtgcaatacattttgtcatttcatgttttttaccagatgagttctgacaagtgatttagaagactcct

SEQ ID NO: 56670 - DNA, 1999 bp, Oryza sativa
agtgggggacgtggtggggcgagggcggctacatgcgcgtcgcgcgcggcggcgccgccggcggcaactgcggcatcgccacctacgccttctacccgaccatggacagctagctcaactgagcactggacagtgaacactagactgatgcaaatatgtactaatattgataagaatgttacgcctaatgcaaatatgtaatatgtgtgggcgtctggcttctaagtgataagctattaagccatagttaaggagtatatagtagataaaatgattatgaaaccagaactgtatcgacatatgcagttaaagaaactgatgtcggtaatggatggagcaaataagcacttgtacacattaagaaaagatgattcagaaaattcaggacatgcttattgcgcacaacatttttctgtctttttactgttccaacgaagaggaactattcatcgagataatattagtaaccaacataaactgctgcgttcactatatagcaatcatcgtttttatctcccattgcttctaggcatacgccacttgaacagatcatcccaccgtccacaacctcaaagctgataattttaccactgcaaacaatgagaaaatagcataaggcggcgcttttgctacgtcatatgtaaaccaaatcaagatgcacactatcagtatcatcagattaaggctataaacacgctgctaatgatcattctggacaaatgagatccattgagtatctcagacattgtttgattacgagttgttgttagcaaagaaatgctttacatccaagcagctgagtccaggccattaataattctggtgtgttcttccttttatatatttgatcatgcttactgccacatctaaatatctaatattactgtaaaatgcaaccatgaatacgagttcatggaaactgtctgcgcactctaaatatttctcttgctgatctttcattttcagtaagtcgtgaaaatcgtatgagtccatatggctttcttttgtatggctgctttctatctcagcaaacatcacacagcacagtattgcaactattaaacattcctacaacgctaatgtgaatcaatttgtcatggcaacatggatttacctgcttgttatgcacactagttagcacaaaatgttatagtttgccactttggcttttgtctgagatactgtaagctgtaaccatgtaatactttcacatctgaaggacattctggagcactggtgttgaacattcaaaaccctcttatgtagtaagtatagtgctgaccacactgtcttgtgtacttgataaaagatggtatttatttgcctaagacgctgtgatgactttaaggatgaagtttttatagaaatatgatcaaaaggaaaagcaggtggtgatagaaaaaataatcaaatatgctaaaaggtgagactgtattgatcgagggtcactgaactacccggttctactttattatatacataaaaaatcttagttagagatcacagctacactcaataagcattcaatttgaaggtaaacacattggataaccacatctatcttttgtagttatgggaaactggttacaattttgaaagaactagaacacattaaactttttttttttcaaatctaagcccttgactgcctcagattttgttattaaagagctaagggctcttttcaatacagttagcttatgaaaatcattagtgttggaaatagtgagcaactgagcaatgttgggtaatgaagaggatccgtacttgatcttgccatatggttatgaacataatcacaaggaacaattgtactgaacaaataaacatgatagctcatgttcctctacaccacatttgttcaccatgtccatgagttacctaacctagatattgccaatcataccaaggttcaaacttactactataatgcgagctagtatggtacacaaccgaccaaaacatgctcaataaacttgtaggggtactcattgcatcc

SEQ ID NO: 56671 - DNA, 9235 bp, Oryza sativa
  unsure (1)..(9235): unsure at all n locations
gaacagcagcctcatggcctcctgctgcccctccccgccaccgcacgcctgggtctgcgccgcctccatctccatgggagacgacgaggaggcgaccgctctcgctactcctgcggcgggcggcgccgggttctccggcctaagggatctgatccggcagcgaggcggccggcggcaggaggaggtggaggggagcaccggtggtgttggtttggtcgggcgggggaggaggaggaggcagctgggggatgatgctgctgacatcatcatcatcatcatccttccgctgtttcaataagccgacgaaatatagccatcgtgtgaccattatgattgttgatcaaggtcaaatggagttgcagaatacaccctctgttttcaaattaagttccatcttatagttttaaaacgaagggtgtagttggatctgctaaaacatcactgctatactacttccgttttaaattacttgttattttaattttttttcttagctaaagttatgatttatgaccactaatttttaaaaattcatatagtttaactatatgtgaaatatgtattataaaattatttctcatgacggatcttaaaatataaatcatctaaattaaactatatgtcttctaaaaaatattaaactatatgagtttataaaaattactagttaaaaaataaaatatttgatttaagacatatcttaaatgactgaatacgaaagtcgcgacaacatggtatccagaaaattaagtcaccgattatgtgcttacccgtgtcatattaatcatattgttatctcctacgtacgattaataacgaacacggcctatgcaaactgcgcggctaactaccaatattccttattttctattctaaattttcatttttttctaaattgtatttttatatagattgtaaactcttattttagtatttttttaatttttatttttataaattaaagttataaattgtatttctatacggactcatacgtctacttctattttctttttttaatttcaaattttagtatactgatatggattgttttttctttcaatatttttttaatttcgaattttggctatttaaaattgtatttctatattgtctctattattctttttctctgattccatattttaattaattataaattgtacaccagtatgaactctagccttctcttccaatattcattattttttaattatctatgtaaattgtttttctatatggactttaattaatatgagaatttctaggcccagcaaacgcggagtctaattttcttaggctgtgtttagatccagggtgaaaatttttgccctgtcacatcggatatactgacacacatttgaagtattaaatgtagtctaataacaaaacaaattacagaatccgcctataaaatgcgagacgaatttattaagcctaaataatccgtcattagcaaatgtttactctagcaccacattgtcaaatcatgcagcaattaggcttaaaaattcgcctcgcaaattagtcgcaatctgtgcaattagttatttttttcgtctatatttaatatttcatacatgtgttaaaacgttcgatgtgacaggatgaaaaaacctgttagcggatctaaacatgtccttattacttaaataagttaatgcattagttcttaatccaattggttaaattagaaataaactttgtgaatgtggtttgtttggtcatgtccatctcaagctttttttactccgattcctatagttagtttaagcttccgtaaaaaaaattatataactatataactattatggccgtgtttagttgtttaggtgtaaaaattttgaagtatacggacacacatttgaagtattaaatatagactaataacaaaacaaattatagattccgcttgtaaactgcaagacgaatttattaagcctaattaatctgtcattagcaaatgtttactgtagcatcacattatcaaatcatggcgtaattaggcttaaaagattcgtctcgcaatttacatgtaaattgtgcaattgatttttttttcatccgcatttaatgctctatacatgtgtccaaacatttgatgtgacgtttttggcaaacaaattttggaatctaaacacaccctatattaaatctaaactgttataatctggatctactatgacccaatggttattttttctctcttttttcttgattaaaattggaatttctatttttcttgtccgttttcactattttctatctttcttgtccaattggaatttttttgtccgtttccaagtttttttttgtccgtttcagctcttaggtttatcttttttgtccgtttctaagttttttttgtccgattggaatttttttgtccgtttctaagtttgttttttttgaaaagtactccttctatttttctttttttctttaaattaacgtgggattttctaggccgtgagagcgaatgtggagactcttttttctattactatgtagatataatagatttagctacctacatcctctaaaaaaagctacctacatcagatccatgtcatctaatcccagccttaccaaataatttggtactactagactagtagtagagttttaagtaggacaatatattctatgtgcacacatcctaatgcagttactacgttatacactcactcactgggcactggcgaccataggatctcaatcggatggattggatccaaacgggacaatttcgtagaaaactgcccgcttcttcacctgtcgtttgttcccgaagcaatcgattgttgatgacctcgggatggcaagcagccagccagccacatttcacggcagacggcatcctgcgtcaccgacgccgtggtcggtggaaaatggccgtggccgtggtcggtggaaagcggcggcggatccctctggcatttggatacaagcggcagcggacaggcagacgacgcccagcagcggacgagagaggcgatagctagcgggatcgcaaaacaggaataggggaacgacggaaaagaactgctaagaagaattgcttgattgacagttcgtggatcgatccagatcgagccgaacctggagcgagcgccgcgcattgacatctctcgcgtgagccgagccgagcggggtgcggatggagccgtgggggctggccgtcggatgggcgactcatccacgcgtacgtcatgcatctgcgtagggccgggttgaacggaatgaggtttgcacctcgtatgcacataatttttttccgaccatgcaatagggagaggtcatcacgacgaacccactctgatcccgccgatgccgtcgccaccgccgccgctgccaccagcatcgatcgacaaggaggaggcgtgcaacaccttcgatgaggacgacactgacttcaatcttccattgattgtgagcatagacaccttctaacagggattttgattgcgggaggcatcttgattattcatcttcttcaagcaatctcccgtgagcatggtctaccgagaagattcaatccgccgccgacgtcttgccgcacgtacggggaaggagacaattaaggtgggggagaagtagcaggagcctagataaagagaagagagaaatctaagggttatttgcgaaaccactggtgaaaaagcggggcgttttctacaaattgccctgattatatcctatccatccatccgattgagatcctagctacgactgacagcaagtgagtgcacaaggcaatgagacatttacagtttgaagatgacgatatgctgtgtggtagaacttctatagtgaggggcgaaggactttaagagatgctacggtgtcctgattgtttgcttccgtagatttattcgcatacgcgaatacggaacaatatataaatgcatacattcttggtcaatgataggagaggacgacggaagaggacaggacgtagctccacttaggtagcaaacacttcctccatttctcatttacttgaaacatttgattgatgctgttttaataacctgatcacactttcaaattgttctacagattctgatgaacaaaaaatgtatgattgtattaccaatttatcatgcaatatattttggttgcatggtatattattttatatatttgtaaattaattatcgagataaggggtgatcatttttttaattaataagagaaaacataggtggtgtgatttttagataatcgattaaaaattacacccttcactcacgtagctacaaccaattattaaaaaaaatcactcaacgatgagcacacaccaacaagtggtatggctaagattagtaggtttcttatgaggttagggagttactgttatttcgttttctttttttcgagggattagggcagaagctctgcaaattttattatagaagaagagagaatcacaaggttcacctcttagaaaggtgtcacagcgaaggacataagggattacaagaattgagcttgtcatacgctttgcatacatggcgatgatagagtcaaccacctgcagaaccgtactatatgcaccattgaaaattctatcgtttctttgaagccaaatacccaaagtcatgtagatgattaagccattgaaatttcgtctttattctttgatcagttctcttcagcaagcttcccaccagtccagcatgtccccattgaagaggatgcattcacgagatggcgggagtgcgatgcgcatccacatgcgtgtaatgagagaagaatggaagtgaatttttttcctcgaggggacatcccctcgttttgtgcatgtcattcaaaaagttatcaaaattcgaaacaaaaataacaaatttgaccgtgaattacgcgttctattcatagttaaatttttttatttttatttctacttgtataagttgaattttaattggcatgttgtaaagtgacatatcacatattgatctatcctactaaatttttttaatttttttgatgactttttaagtaacatgcaaaaatgaggggatatcctcttatgtcatgatttgagttttccgagaaaaatgaattaagataatacatgatctctatttctatggccctttgatggtaccagggttaccacgcattttttagcgctaattaattaaccaccatctgaatagaaactgccaagtgttacttgtatatatgtacaatatataaatatataattatttgaatttgacacacaaagggtaaaaacaaacacaaccttaattttctcggttcttttctccctccttttgaacgcttttgcccttcgttttctcgttccaaacgcatgcaaattcatgaatcccatataggcccgaacgccgggatgccggccttcctgcacccgctcaccacgtccctgctcccctccgggttgctcgtcaccaccaccacctccgcgccccaccgccgcgccgccgccacggcgagctcccgcacgtccggccgccccatcaccgccgtgtcgtgcaccaccacccgccccgccatgctcttgccgcccgccgccgccgccaccgccgccctgatctcctcgccgtagttcgcctcgacgcccttcgccacccacaccagcgacagctccgtcgccgtcgtcgtgctcggctgcatcagcagcgacaggaacacgcagatgcccgaccccgtcgccaccatggtcgcccgccggtacatgccgatgaggtacgggaggccggcgaagtggacgccgcgaacccagaggtgggtcggcgggtcggcgacgaggccacgggtgaagtcgccgacggcgccggcgagcatcgcgtgggtgcgccgcccgtcggagatgatgccgaaggcgtgccactcggagagcggcgagcggctgatgcggccgaggaggcccgccctgacgccgccctggaaggtcaggatcgccgcgtgggtggacggcgcggtcaccgtcaccggcacgcggcgcacggtgagccacgggagggtggtgaagaaggtgatggcggccgcgagcctgatgtcctcgcgccccgcgaggacggcgccggcgagcgggacgtaggacctggccccccggtcgtagccggcggagagcacgacgaacgtccagagcagggcgagcgcgccccagccggcgaaccggtgcgtccgctcgaacacgttgtggtggaggtggcgcacgagcgggaacgccgccgcgcaggagagcgcgagcaggaagaggatggccgacgcgacggcgacgatctccggcggcatctcgtcgcggcgccggagcgcctggacgagcgcgtaggccagccacgcgacggaggacacgccgcagccgctgtggacgccgccgagggactggaggatcgccgtgacgcccgtcttggcgacgaccggcacccacggccggccgaggagcgcgacggcgagccagaacacgacgcggagcgccgcctcggagcggcacagcgtgagcgccaggatgttgcccatggcgaagacggcggcgcgccgctccgcgtacgggaaatggccggacgccgcgagcgcgaccgccgccgcgttcagcgcgacgcagagcacgaagaggcgcttgtacacggtgaacagtccctggtcgaacagtatgacggcgagcctcgatcgcctggcggtggccggcgccgccgccgccgccgccgacacgctcggcttcttcttccctttcaaatcatcctcgacgtcggcagctgcggccgcggcgacagccatctcctcgtcgtggccgtcaaagacggacacgccatcatcctcctcctcgtcgccggcgacgtcgaggtcgcagaagtggctgctggcgcggctctgcgaccgtccaacgccgcagtccggcttcgccggaatgatcctagagaaggaggagtaacggctcgacgacagtagaggcagccagatccaccttccggtgctcggcgccgccggtggcggcttggcagggcatgcggcggcggcggcggcggcgatggcgaaggggctcgccggcgagggcttgggctcgaaggtgacgccacggcagctcgagaacttgatctcgatgggcttcgttgtcagctcgtctcgcccatccatggcgcgaggcagtaagcctaagaaactgacttgaattaactagggtttggtttgaaatcgccagtggttgtagaattgcatgtgtatttataagcagctgaagcaagcaagcatcagcatgaatgcatgggtagataggcttgatgaaagtgttttcaactctatgtcaaggggatataccagtatttttcgtgcaactcaaatagtcatcaaaatattttttaaaaaataataagataaattactatgagatatgctccaaacatacacgtttaaattcgacccatgtaagttcaaacaaaaagaacaaagcggacctctaaaaatattattttttagttatatttattatttttattctaatataacttgtatagttcgaatgtaaacttgcgtatttatggaataatttatctcatggtgatctatcacattatattttttttaaaaaataatgactatttaggtggcatatacaataaaatatattctcctaaggaatgaagatccatctgagcttgatattacaagttggcatgaaggttgtaaaatatatggggagtctttgtactatattttgtactttggactttcaacgtactttccaaacgtatacaactatacttcaataaccgtgcggagtcttttgataaggagtactactatctgtctatctttatccaattagtactactgtattctcacagcattatcaagctagttctactccctccatttcataatataagtcacaaccacttttttagatgttctataatataagaacacccgcaatagttatctatagtctctctacaagagatccatatcagcatattttcctacttggaagagattaaatgaagagagagcaaaactatctactaacctggagatagtctatagtaaaaaacgatgcaatgtattagagagctatagatacccatgtagacatactattgaggtgatttactattaatctagtctattgctgagatgtacatgttttatagagagcaccttactttaccattgtgggtgctctaaggtatgcatgcatgtagacaattaactatggccccttctccattaaattattacttttttaaatcctccactctcatgttctctaattctattggatgcatgaattgtatttattatgataatccaaactacaagatgataataattatttcttggtctttgagttaaaggtgattatgccttatattttggaatggagggagtacttttatttttacgaaacgcaatacacaagcaatgctcatataaacatgctcacgtttaccttatccctataaatacctccgaaaactaaaccaacgtatcttgagaatcataaagtcaccgcagacgcctcgcgctcaccctatacatatagacacctcggaatgctgaaccaacatatttttgagattcatgaattcatcgcagacgtctcgctgtcgacaaatatgtcacttacccctgaaagaataattagccataaatgtgggcatcgtaccaagtcttagaacttaaacccggatgagtagattccactaccagaaacttaatcagttgagctaagttcactttgcatatttcatttacatctcttagcacaagagaatgtgtgcaactgtatgcacagttcaattaagaaatgatgacataaacatgaaatgcttttggaaatattcattttttatttcactgaattaaaaattacactcatatgaaggacattgatgccggttttttaaataaactgacaccctcagtaggagtcaagctgatgagccagccaactgccacgtttttaatttggcttgttgctcgctgctctctcgctctctcgaagagcgctgctatgagtgtctcatcctactcgcatccaccaccgtgccatgagcatcgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56672 - DNA, 9108 bp, Oryza sativa
ctccaggagagattgctggcacaagcagtgagggtccacttggtctattgccgcatcagatacgaggatcactctcgcagtacaacttactaaccctattgggctattcctcgagcaattgtaccgcatgttccaatgcagtaagtaaacatttatgattgcatgatttggaacagtttctttagaacttctttcttgtattgtattgcttcttcctcatgtgatttggtgcaaaatattgcaggtgttgtctgaataccataggagagggatggattttgtgatgcaggtgatcaacgaaccaacctatctggaagacctcaccggccttactgacttgatgaaatcagcggcctattctcaggtcgagtggattgatgaagttgacgatgacgacgagatggatatatgacgtgttgcatgttttttttttcatgatgttaacacgtgtaaatacaattcatacgcatacttagtccatcagacgatgagaatggcgttcttgaatctcgaatagcctcttcttaaccaactagcaaatcacagtgtaaacattaccaatctctggtgcaacaaacaattgtaacctaggggaaaaaaatgtacactttgctaatattcaatgctaatgttgttcccattctcaattccaaaagagaacgttgtccccgtgttaaatcgcatcgttttctatgtttctacgcttgctggagctgcaccgtcgacggctgcatgcgcctcgttgtgccgcaagtactcggcgaggcagaacccgaataacgcagaaactcccgcgacgtcggcgcccatgaccagcaccccggcgacgggggcgacggcgactgcgagcagcgcggccaggaagccggcgccgaagacgagcgggaacgcgaacacgagcgcctccacgggcacggcggcgccggcgccggccgcgaggttctgcgtgacgtggtacgcccagaggtagagcaggaggcagagcacggcggccagctccgacgcgagccacagcggcgagccgccgtagctcagcagcatgagcgccatcgtcgccggcaggagcagcgacagcgagcacacgaaggcgtgcgcgttcgcgtgcgtcctctgcttcttcctctcttccgcctcctccttgctccggtcgccgtaggcgatgccatcgccgtcgccggccagctgctgcttctccttctcctccatctcctatacaggttggcttggctcgagttgtgcccgtgcacgagcttcttttattgctccgagtcgggagctgagctcgagtcggattgcatcccgacttactctacggattcggtggcaaaaataactttgaagctttcagcagaagaactggacagcaacagcaaaagaggaggtatattgtgtatccatctgttcttttatagattataacaagatagttactagctctctgtactgtacagcaactcatgtgccggcagaagtcacaactgatggaacatggaaaatcaaaggagcaatttgagtaacatgtggtatgtacaagatacatgattcacccagctgcctgaaagtctccgaagtcgtcgtccacgctctcttgaggggccttctctgctgcagttggttgctcctgaggagcagcttctgctttcggtggtggggaagaagcgacgttatccgcggctggttgttcatgagaagaaggaaattctgctttgaaaggagtggtatcagctccagtatcagcagctggttggtcttgggaaggaaactccgctttgaacggagaagccgcgatgccagaatctgtaggagagaccggtgatggcggaggtggagggagcttgagggaaactggggcctccttggagttggctttttcgttaaatgagagcttgttgaagccttgctcaaaaaatgcagattttatctttgcgccggactctttctgcacagaacaaaagcaaacccaaacattaaggagatgttgcacaagaagcatataactacaaaaatcagaagagacgtcaagaggttatttctcaaatgatgtgccaaatctggcgtaggggcagtgcaaatatccttcaattaagttcaataaggctaagatggatccctacgtaagagcagctcaaactgatatatctacaaatatgcagttttatttaacacattacatggaaaatagtctagagagcaaaataatctaatatgaatattactgagaaatagtaggatcctgtaaaccattatacggttagcttcatttcaacaagacaagaaacttattaaaacaagtttgtttgaatacaaaagtacttaagacacgttcatcacacatgccgtataagggttgatatcttcgagccatgaataggcattgtcatatgcatggtaaacctggttgtcatgatatattttttttacaactgataattctgagaattggcacagataatattttcatcttaataaatttcacggtttgacaatttatgcgtgtcaatgcttggagtggacacaaaaattaacttcataataattatgtttgtgaaaccaaatgttgaactacttcctactcaatatataaggcatcttatgagtgaatacacagattaagaatttaaaatggtaatacaatcaagataataagaacagacaactatcgttcttaaatacctagggaattggagaaagaataaggccaaacatcagaaaatcccagccagaaaaaactggacctggtacctgggccaggctgttctggccaatgggaccgttaaaatagctgacaagggaaaatcccggttcaaccgccggtttcttagcccaccagaccaacctaggcaggtaacgagccattcaaaatttgcaaaagtagttagtgacaactggaattcaaactcaaaagatgttgctaattgcttgcatgggcaaaccaactcggctaacaccacttgcttgtttctactagctgttaacacgcctacaatagcacaagaagtagtacgctcatgtggtctgagacccgttgaccaagcgattcaacctcttacttactgatccaagtcctcggacaagtcaatgtctggtctggatctaataacattgtgtgtaattactttagcaaccaagcagctctagtggctttaggtaggatgctaatactctagtactgagctaataaaacaacaattacatcatgaaggcctacagaaacaatttcacatcaccaatctctagtttgaccaccaaaatatgacacatgaaaacttacattttttagctgcaaaaccaaagtttccccttctttgaggctgtaatccactgatgatgatttctcatagtgttgtaccatctcttcagcagtctttttcttgtttagatatctttgatgatgtaagaaataacaaatcataccggaaaatggtccgttataaaaagaacttattggataaaaatattaccatacacaactacaactgcaaaaaggaaatacaaattgaattcattgtgaccaaaaacagaaacatttcatctgaccgaccaaaagaaacataattggcaagcaaaaaagtacatcctatgaattgattgtatgggtagaggatttttttgggttcatttagacctttttaataataaaatggttgaacattcaaaataataatctcacacgtacgcgtgttaacaggaaatcaatgtcatgttagaccattttaatgatactgcaattgaatcaaattcacatacagagtccccagccattgagtgattacatgggagaacattcgaatacatatcatgcttcaagtaatgaacacaaggatacttcatatggtcgtgcagagcagcttggaaatcatatgcttgaggtctttcacggaagcctaaaccaataaaggcatggcgctgacgtccatctgaaaatatgtggtaagatttttttaataacttaatatatttctacgtatggatcaatgcgataactgataagccacttcaaacactatgcttaccacctcaacactatgatcaccaactcaatggaaaaaacattaagacacaagaaagtcataaaaatcatgagaagatcagcttatcacctatattctcttcaacacggagtacaaaatatctgcaaaaacaatgttggagtagcaacaatcatttcaggttatctttatacagtctctacatagtaacttatgcagaatagaaacactaaggacaaaagtcaccacaggattaaaccaccatgtggcagggaaaaaatgcagacctgctgctatcaataacaggttccaccggatgtggttcgtcttctctgaggaatgccctagcgtacagctcccctaaaaatgtgtccgaggaatcaacattggtgatcacacaagcactgaccaacggcactaccgtgattttttttgtacctgtgttcttatcttccagtttgatgatgcactcttctcctttgctgacaaccttgagagtcccttcccaagcccacttgttgacgttccattcatcagccctggttgatacccacggtttaaaaaatgtgactcaggctctcggctcataaggtcataccaaaatcagaacagaacaagtacaacaatggagtgagctaatccaagattgccgcattcgatagggccaatggaacgagagttctcgaaacaggacgacctatagctaattcagattgttatctttgatctgtctagcccctcacacagtcaaaccttcaaactacatagccttgctcccgcggacaaattgaaatgtgaatcctactaagcccatttctatcgggatttttttgatgaaccaagactagtatatacctgtaggaggcggctgtcttcctgggaggtatctgcgtaaagagagagaggattaaaaaaaaaacattagcacgttcacgcacacatagtgctcgacgaattgcgcgcccccaagagaacacaagcacgggggcacgaagcgggtcactgactacacacaccctaaacagtcaaacaaaccggaggaagaacaaggcggcgaggggggggggcgcacggggcgtaccaggtagacgtagcactcagcgacctggaacagcacgagctccaccgcctcctcggcctccgccttcgcctgcgactgctcgccggtgctcgacatggaaccggcgccggatcttaccgaggaggggagcggccggggaaaggaggggaggggggaaggctggccggatccggcggcggtgggcgtccccgaatgcggcgacgcggaggcgcgtgagagaggaatggatttcttcttgggggggagagagactgagagagagagagagagagagagagagagagcggtgggagaggaggaaggtggggaagggaagtgccgaagaggggagaggtttgcgtcgggttcggggtcggccacgcctgtttggtcttgggtttaggtgcggtgttgcggtcgtgttcggctgacccgatcgatcggtgttgcttccggtttgggtttcattccacgtatccggtcggtgtggcgatcagggtcacggtatataccctttgcttagattcggctcaatttgaaagattagagatgtccggctccattggcttattccgagaataaaccatacaatatatctacaaataaaaaataatttgtgaataaaatttatatatatatatatatgctcttgacgatctaaaagcaacgactgaaaaataaactatgataaaaaaaacccttataatcaactctaaatttaaggttgaaaaaacaaattttgtcttataagcataagcgaaaatatgatcgcattgcccatgacttgtttagaatgtgagattttatagcggtacaactcttcagtttatagcgggttaataccgcacgataataagaaattactcttttataatactgtaaatgatcgttttccatttgtcgtaaagtttattgacacctaaaatgctatcaagttggttcgcaccgagctcgatcatcacataccatcaatctggtgctcaatcctgataactatagtgcaagctttgaccgcttcactcaagctccacactcacacacatgagttctgtcggtccgcactcaccactcgagctctatggtcatgtggccggtctttagatctgctaatcgatttcccctaagccctattattgtgctcaagcttcatggctttgtgcgcgagcatcactgcctagccctagacttgagttctgcaatccaacataagctttgaaactacgtctgtatgctttgttggtctcacatcttatgtccggtagccccatccccaagttttgccaaccttgaaaatgggctctactacacgctgagagattggtgagcaattggcgggagaacgaggaagaaagatatatccgtccttagttgtataagtgttacttgtgacaaaaagaagtggacatcttctctatttttttttacattttagagtcaataaacttttagataaacagagatgatcctcaactatattatggcataaaatcaattttctccttacagcttattaactgtaaagattataaaatttaaaacattattgttagttcattattagaaaagaaaaggactgaactaccccctaactatagggaccacacgatttaccccacaaaaccacaaaaccagacacccccaaattttcataccggacagatgacatcccccaacctgatttgatctagagcggttttggtcctactcctacgtgatgcgcatgtggcaatctcgtcagcataaaaagtttaaagaacgatgagccagttagagggtaattaggactttttcttattaaaaaaatgaaaagaacattattagtaacaaaaagagagtcgagatttatcagtgtcagcgacgatacgagtcctaaaatcaggtaaaacgtcagagcgcataaactttgcaaccttaaaatatagccaaatgttgtgtgcacagtgcaccgttgtactactttcttggtgcttgagatttaatctatatatagtagtcaaatctactacaaatatgcttttggaatgctttcctcgcaccttcaggagcaactactcttggtttcttcaaaaccgttgcagtcatggatctagcttgctatcttgttgggaagagaaagatttgattgccttttatagtttcatagttagtcctagacgaatttcaagagcttatgttaatttgaccatattcaagagggtcttttgcaaaagtgcttgcactcgcagttaactcccctctagggataaacttcatatgtgtctaattatctatcaatatgtatctaattatctatcaataaaaatgcatgggttttttgtaaaaagaaagtttactaacccaatcatggatgaagtttctggtaatgtccacccggctaccagtcctatatcaaaggtcacgcaaaagcaaccatggaaacatacacggggaacttgtaaagcgtacacaagaccatcaagaagtgtaaaactcaacctgtggattatccgaattaatatgtcaattgtccgaggtgacaaagggacaaaagcacaaagcattgttcttgaaccaagaacagtgcaaaagtaaaactcaaaatctcaaaaactaagattttgcaccagccgggaatcgaacccgggtctgtaccgtggcagggtactattctaccactagaccactggtgcctcttgttgtaaatttagaaaacaaagttatataatcaggatagtaaacgagattcagaaacgctgtggtcttgctgttgtagttccacacaggctacttgggtctattcagtcagcaaggtaaatcatggggagaatatcatcgacatgtttgatctgaaaactacttgagcatatgttccttattgttttaagaaattttgttaaggagtacgatggaacaggcaaatactaagtttcagtaactgtatccttggtttcattaatatagttgctgctcaccttggtcgtgatagtgtttaggtgcaagtagaaaattgaaccaccgttttcttgaaacgtcttctttttttttaatgtaagtcgacctgtaaatcccaacctaacatcctggttccctagttaacaattgccacaattctcacttttttaaagaatagtcacaattctcacttccaatgcttaatctttcaatcccaaacaaagtttctttactgcaaagtagaagagttgaaaattttcaattaatatctaccctattttcataacgtctcgtatcttatcgatattttgcctaggatttacaacaccccatagttggtggccatctttctaagttctatgcacgtgattaaatttatactttaaaacatactacgttctagagtcttcagaaaagacaagtaaaacaaccatagaaaaactccactacttccatgtatgacaaaccacaataaaatataatactatttattttactaacattaatatcaatgtactattagggacgaagctatgaatgcgagcatccaagtttgaactacggtgcatatacgagaaaatagataaactaaaacttaaaaaaaattataccgattttctggagttctcatcttctcgtatgttccacccagtcactaaaaaaaatttgagcctttttcaatatgaaattcagataaacaaactttataagtcaaataagggtaagagcaagtttaacagtatagccaactactagctccaattcatatatagccaatctaatagcttattcatacaatagttacatactacactattaatatctggtctcatctgtcatatactcactgcatcttggagtccatgctacagctggctataaatctgtagcccgctgcttttctctcttctcatttattttcttaaaatatatttatttacagctagcttatagtctgctattgtacttgctataactataattccttttttagacaagtcattgacgcgtccggcttggacaccacggatgcccgtgtccagaaatcctgcggctgccggcctgacccgataaaacccctcgaccgatcccaccccaacccaacccttgtcgaatccgaatccttcc

SEQ ID NO: 56673 - DNA, 15307 bp, Oryza sativa
ggggggcgtcgggcggggccgccggcgccggtggcgcccccgcggccgacgtctccctccgcaagatcttcgtcgggaacgtccccgccgacatgccgtcggagcgcctccttgcgcatttcgcagcctatggtgagattgaggaggggcctctagggttcgacaagcagacgggcaagttccggggctttgccctctttgtgtacaagacacccgagggtgcgcaggcctcgttagtggactcggtgaaggtgattgacgggcaccagcttgtctgcaagctagcgatcgaagggaaaaaggggaagcaatcgcagcagcagcagcagcaatctggacctggtggggctcagccgccccaaatgctccaaggcgggccgccggacatgccgggttcagggcttgggcttggtggaccacaaatgggtgcgcagtatggtggccctgggagtctgtcttcgtatggtgcatttgggggtgtaggcgctgggctaggtggtcccaatccgtatgcgaatttgccatcttccatgggcggcggcggagctgggttgggttcattgggcaatcagatgccttctgggatgggtggtgctggggctggtgcgtacgggcctgggggattgggtggtggttcatttgggggctcatcccagtttggtgctggtgggatgggggcttatgggggtctaggcatgggtggagcctcatcactgtaccgcatgcaacagggttcgggtgggcttccttctggcgggtatggtgagggtaactaccctcttccagggcctggtttccggggtcaggagggtggaatgtcacctggaccaggtggtagagctcctatgtaccccaatgtgcctccttatttctgaggtaattttttgcaacccttccgtgtcttgaattttgtacctgattcccttaggctttttacacccaaatgcttgataattgtcttgttatgtggttatgcctgaacattaacttaatttgtgtttgaattgtgattgctgcatgctgtgtttgcatttatgtgaatgtgtatgtgactgaaatagtgatatgtaagaaactctcactggttacacactgacagtctgtagagatatggggcaatagagtagtgcagaatttataggatgctacttctgacaatataggtttagtatgttaatgtgctctagttgctgattacttcgttctgtatatttttatgctgagaaatctctttgggtgttccttgttttggtagcatcaaggttcagtataatacattcatagtaatattacacactcttgattggtaaaatgttgctcttgtttgttgttgcaatagttgatttcagtgcctgtgttgcttttatttgttcatgtgttttttgtagtgttggactctaatttgcatccaaagtggactgtcttgtaatattcaaggtatttgatttcttataatgctatatcatgcgtacctgtgtggtaatttgcttggtcggacaatgttgcattatatacttgaccacatttctttgaaaggttaaagtgaaggcaactgtctgaaatttgaggttgatctgctatttgagtatatataataaagtatgatccttttggcttaaaactgttaatcctgcctgtttgcagtacatcatatgattgttcgttcttgggtactctggcctgtggatattttttgtaggttactcctgaatatgttttcgcaatacaagcacatttaaaaatccatttgcctggtttgctgtttgacgatattctacctgtttcattttttgccttttttgcttcataattggcatgcagcttattgttttactcaaaacatttgcaattttgaagttgccatatttttatacaagataataagactaatcaatattctctatcatgaatcctttttttttgttatttctttgttatttctttttttttttgttatcaatatttatgcatctttacttcacttgatatttcttctcaagtttcaaagttgtgcttgatggcattcccctttaggattaggcttgtgatatttgagcttgatgtattaagcaatactatatcttttattttactttaaagttatattatcttaattttgtttgtatatttgtgaattggtgaactattgattgaattccagtgaatgtgtgaatcaggtgtgtgacaactcttgggagcatatgctttgaatggttgtgctgaattcagaagttgtctgcttacatggatgtcttgcatattctggctgcctctgatatggaaatcagttttttgctctcaatttttctgttacaagataattcaagctagcttagtgttttctgagatctcttcattagacatgtactttctcataaatatgtgaggtgtcgtttcacattgttgtgtaatgctcattgtcttatgatatccagttacttatgattacatctggtgcttggtttatttgcgtgacatgttatttggtggcaacttgattggcgaaccatttgttatcaatatgtgtctgatgttttgtaatagctatatataacagcagttttactgaatgacttcaggattttttttttatggttaccatctgcagatacgtgcagatttattagaaaacctcctgtattttgatatgactatctgctgagttggatctttagtaagaaagaatccatgttgtacttacccacttccatccccaactcttgtacctagcatttgtagtttcatcgagccatccttgttgctagatacttcattttgcttggagtgagaatttcctctatggtcagacgctatatggttctgttgtgctcttgtgatttggttttcaacatttcttgtgtatgtacatctacatcattacacgttttgcttctagtgattctttcttagatagttagactgtactacgttcttttgttgtgctcctgcatcattacacattttgcttcgactgataatttctcattttgtcagactgtactatatatgcttgtactgtgctcttgtgagttagttttcaacatatgttgtgtactcctacataattatacattgcatgcgtttgttaggagtattttcaagtgtacaatcacatgacttgttgctgttacgtgagagtttgaacattttctgccattgagctgaggggcatctttcttaggtccttttcttggagtgtagcagcttgctcccctttttttgggggtcaaatttgtgcttttgcattcactgaaattattttggcttgcactactgcctttgctattcgcaattgcaacttctgtatgcaattcaatcaccatgattttgtttagattcaaaaatttttctttaaacttccaacttttctatcatatcaaatgtttgggcacatgcatagagcattaaatgtggacgaaaaaaaaaacaattgcacagttttatgtaaatcgcgagacgaatcttttgagcctaattacgccatgatttgacaatgtgatgctacagtaaacatttgctaatgacggattaattaggcttaataaattcgtctcgcagtttacaggcggaatctgtaatttgttttgttattagtttacgtttgatacttcaaatgtgtgttcgtatacttaaaaaaaattggcacgcgaactaaataatactcatcgtatgagaatgctgctccatgtattcattgattcttgaattttgattctgtgataattaaataattgtaatgtgctagttatctatcattgtggcgctgatttgttttgtccacgattttggtgtacctgtttgccgctacaaacttacgcagtgttgattcctgacacactgacgggcttgtttatttctcgtcgtatgaacttgcatgcgtgatgctgcctatgctgtgcttgtttagtttatcctcagctgtgccattcattaccaggaattgcaaagctgcaaaactgtgtattatctcttttatcctaagctagtgtacattaactggagacctcgccaaggaggcaagcaagagcaggttccaggtatcaggcagccccggtaagcaccagtggctacagtcagcgtacaccagcggctgttgccgctgctccgtgctcaggggcttcccttccctggtgatggtgtacaccgacggatgcgcgtcgacccggagctcggagaggcgggtgatgttgaggtacgtgacgggcgtcctcgtgctccggatgttcctctcgacgatggacaccaggcccctcgggaaccatgggacgatcttcgtctcgtccgtgattggggacgtctggttgtagcaccagttttcgctgcatttgcaggtgttagatcagtcatcagaggtgtccattgtggctgggtgccgcgggtggtgcaagttaacttttacctcttgtgttctggggagatgcttcggaagaagaccctggtcctggccgagtccacgttttggtcgacccagctcgcccatgtcccaagtgcctggttgaacgcctcctcgcctcccatctcgaccggcttcccgtccgcctccagatggtcccacctgcagtaacacactcggcttcactgccctgctggagagagagagagccagagaggagacgctctggagcggagtggcttacgctctgaggttgccggtgtgggtccaccagtggccggtgttgaagacgaggacgtcggcgccgcgcagcttctccagcgtagccgggagctggtcaagcttgagcgccctcgtccggtcctgcttcgtctcgagcgtcaccaggaacgggctccagaagaactccaccgagcagttgtagtcctgtgcatgtttgagtcacatatgtaatcagaactttagaaaggtcctgcttgtcattcgatgtacggattgataactaaacgaacactggttagttgatacatagcccaaagttttttttttcaaactttcaactttccatcacatcaaatctttcatacacacacaacttttcagtcacatcgtctctaattttaaccaaattctaaactttgggccgaactaaacacagcctatctcaaatatatagcttttaaattgccacctaaaagttagggccagtttggtttggtgctatactaaaatcttggtagtaccaaagtttaggcaacttttagcactaccaaatttggatggccaaaacttttactatctaaaagatgtgttgttaaaaatttgacaccaaaccaaacaaatagaaacactattgaaaattgccaatgaattggtagggcacaatttggaaccaaaccaaactagcccttagtacataacctgacttcccaattcataacctgacttcccaattcacacactagtagttcaatccgctaatttgatactattaactttctcccatcatgtctctcactttcatctcctttccttgttactaatatggtgtcagtctcaaaataagcgtagttttgcattcttcatattcaacgtttaaccgttagtcttatttgaaatttttttataattaatatttttattgttattagatgataaaacatgaataatactttgtgtaaataatttttttaacttctataaatttttcttattttttaaataaaatggatggtcaaacattagacacggatacctatagctgtacttctttgaccattcatcactgttcatgtccaacgtttgaccgttcgtcttatttgaaattttttaatgattaatatttttattgttactagatgataaaacatgaataatactttatatgtgactattttttttataaatattttaaataagacgagcagccaaatgttagatacggattcccacggctgcactaattttgggacggagggagtacttggcaattggcatgctattcaacgtcaagtgtcatcttagttggagcatcagaattttcctaagcatgtccagaatttgtcttattttcggttattcacttatgtctatttgatacccgaggggggtcgtagactggtagcggatcgaaaatgataatatagaggacattaatacatgtttcatactattgtttcaacttaagttgggcttcccttatcgcaaagtgtaaactatttaacatttactgataaagtaaggaaaatatgaaggccgttgcatctcatggtttagttttggatagtgttgcgtgtcatgccttgtaataagaaaactcggcctgtacatatgcactaattctgggacgttgtccaaagaaaaaacacccccgtaatttcgcatgtacagccgacagagcattcttcgatttgactgatttgtcccgtaggtcaacactacctcaactctggcgacacaatcgccaaaactcatcggcggattaaatcaatcgtgtaatattctccctctagtttgtgtctatttcatactacaagtcgttggttttttaagtaagtttaatcaatttttttaaaaaaatatagcaacactttaaaataaaataaacatattatcgaaatatagtaaaagttaattgtagtgaaactaatttggttatataaatgttgctaaatttatcaaaaacttaattaaattttaaaatgttaaaaaattaaaatgatttgtaatataaaatcgaggaaataatatgaaatggaggggtagtaatttgtttggcgtgcacgtaccatggcgcggaagatcctgtagtcggaggcgacgtcgaggacgcgcgaccgcgagcggtcgggcacggcggtgtagaggaggcaggcgagcgactcccacatgttgcggttcagcgagtcgccgacgaacaccaccctccggttccggcactgctccagcgctagcgccagcgccgcctccctactcccgccgccgccgccgccgccgccgccgcaccctcgcggctcccatcgccactgctcgtactcggcgtccggccgcccgttccgccggcacgtcacctggtcgctcaggaacgggcactccgccgcctcgtacagcgggtagccccccgccgccgcgccgtcgcgcacccaccgcccctggaacaggtcgcagctctcctcatctcctccctcctcggcggccggcgaaggcgccggcgccggtgcggtgctgatggcatcatcgtcgtccccctccgccccctcatccccgccaagatcaggcgcgcgatcacgggcaccgcccggcgacgccgcttgcgccagcttgacgtacctctcccacggcgcctccccgaccacctcccgctgctgctgcggcgccgcgaagagcggccggcggaacgggcgcgtcgagccgaggaggaggaggccggcggagacgacgagggagaggcagaggagcgcgcagagcgaggtggccagcgcccacctctgccgcgacgccgccgcgacggcgagcgacggcttgttcgccatggcggcggcggaatgatccatcgctaacgacgagagtttaatccacaaagaagcacacaggtcaactgctcaaagcgaggtagtaattattaatttgtagggttaattagctcgccggagcacgggattaatcaaggcgaggaaagcatggaggaggaggggtttttggtttggttgctttcggtgaggagaggttgggtttttggttgggtgtacacactacacttcacttgggacgctgctgttttcatgtgcacttgaaaacagtcactgactcgcttcctctccatgtacgccgtgtttagttctaaatttttcttcaaacttctaatttttctatcacatcaaaacttttctacacatacaaacttttaacttttccgtcatatcgtttcaatttcaaccaaactcatgtgagtagcaattatactgccgctgatgcttagtggcaagcagtacagtttcaccaactgtaatcatgaagaacgttatgtttatgccttccagagtgaaaacgaagcaattttgatgctaaaattcctactatcaaatacgtggagtacttttaggaaaaaaaaggagtatatatttttaccagaatatttatatctttctcgtgtatccaaatcagtaattatggagagttggtgatggatgataattggatagttcaatttgtattcaaagttcgtgatcaagttgatgtggcacgtgaatgcttcttgattcgttattcttccgatcgatgcgaccaaagtacatacacataacataagccttgtggtagtacgtatgtaggtggacctgcatccatgagtagtagtagggtagtagatgagctgttgttagagtaaaaattagaaaaagcacacgcttttagccgtcagctgaatgggcacaagccttgttaatcttcacaacctccttttgccatgggcatttttctcaatcatcatgagactcagatcgaccacactactacctccgtcccacagtggatgtcgttttaactttttcttataacatttgaccattcgttttatttaaaaaattagtgcaaatataaaaaaaagataatcatacataaaatattttttgataataaagcaaatcacaaacaaaataaataataattctaaattttttaataagatatatgattaaatattataaataaaactcaaagcgataagtaatatgagacagagatagtagtaattatcagcgtgccacggtgtctgtcttttttccgggagagacagaggccatcatctgcatgtttatagcaattagcaaagtcgaatggtgagaacaaacatagtaacggagtcacgcgacgtgcacgttgcacgcacgtacggcgcgcgcggccatgatcagcgagcgatcgagcgtggccgtcgcgtaaagaatcggtgagatttgccggcctggttgcctcgtcgatctcgtctgcgtacgcgcgtaacgtcgggcaaagcgaagctcgcgctcgagtagtggctgcccggccatcatgtcggtcgatcattccatcgcctttgccgctttgcgtaacttatgtctatttagcacagctgtaactccacctttatttcttctggagttgaagtccagacgctctagacaaaaaagagcggagctagatagagcgatttccacaacttcattatagacataacttctggaactctttaccgtgttgggctttcgagtcatggggagttggaataagttcatatgaggtcccttaactttacactgagtccgattttcgtccctgaatcacaataccagataccatgggtccctcaactgtcaaaaccggtgtagatgaggtccctcagcggtttagatggcagttttgactgatgtggcgctgatgtggctaatttgacttagtcctcatcgtatgtggcggtgatgtggcacttggaagcaaaataaaaggtcggacccacgtgtcagtcattaaaaatagtgggacccaccctgctctctatctccccagcgccgtcgtccttgtcccttctccctcccggcattcttcatccttcctcgagctccctagccggccggcgagcgcgcggcggcaggcgagagagcggcggccggagctgcatgacctcgcccccctcccccctcctccggcgccgctgcatcgatctgcacgagttgcggcgacggcaagctcacagccacgggacacggtcagcgtggcgctgacggggcccgggactcgagctcgcagtcgcagccgctgctgcccacttccccaatcccctccatatgcgtcaaagtttttgatattcatggcgttctgctcttgttctggtggattgattgattggtgtgcttgtgcggatgatttgtgcgaaggcgacgcgaagaacgcccacctgatgtctctggacgtcgcctcggagaggctgcggctgttcaaggccgacctgcttgactacggtagcgtggcggcggccatcgccggctgcgacgacgtctttcatgtggcctgccccgtgctcctctccgcccctaacccaggggcacacatctctcttttttcagcaaaataattccttttcttctccattgactggttcaaactgtagactggttactgaaaatcgacaaaaatcaacagtttctactaaaaatgatttgtcgaaactattgatttctcaacaaccagtagtagctgaagtctgcagagttgtaattaaatcgtcatgttcttgtagctaaatgaattgatgttgttgtaggttcatacacttgctgctgctgtaacgggcacgacgaatgtgtggaaggcttgttcagaagaaaggttgggacttggtaaggttgtggtggtgtcatatgtctctgctgcgatagtaaatcctaactggcctgaaggcaaagctgtagatgaagattgcaactcgtgcagatcgatgcggcggcgtagcaggagtcttcgtcggcggcggggccaaggtcgtgcagctctggccgccgctccttcctctcccgtcatgcgcatgccggcctaccctccccgcccgatggctggcgccctccgcacttctccccacgtgcgcccttctccctctccatgcgctcgccggccggcgaggaaggtcgaggaaggatgaagaatggctgggagggagaagggaaaggacgacggcacggtggagatagagagcatggtgggacccactgacatgtgggtccactattttttaaactgacacatgggtcccaccttttattttgcttccaagtaccacgtcaccgccatataggactagaactaagtcaaactagccacgtcagcgccatatcagttaaaaccaccatctaaaccgctgagggacctcatctacaccggttttgacagttgagggacccattgtatctggtattgtgattcagggacgaatatcgaactcagtgtaaagttaagggaccttagatgaacttattcctggggagtttgcccgcacgggcccgaagctggttggaaaaagcagcatcgccgaccggcccacaacatgtgacgcgacggcggcccatgagagaagccggagcccaagcaaaaaccgcttctgctcactgggtccatgttgtcagcgacgcatggggccctccggcctccgctgccacgtgaggtgcgcccaatccccggggagctaggagcaaggaggcgcgcggcgttggggcagtggtactcggtgtgacctggtggaggccgtgctctccgccttttggctgcttgatgcgtcgcagccatccgatggcgcaattgctcgccgccgccaccaccaccaccacgccaccctgcggcggcctcctaaccgcgcgggcctccgcgtcctctcccggctgcttcctccgcgcgctgccgagatcccgcgccatggcctccgcctccggagccgacgctgccgctgcggcggttgctcccccgtcgctgctcgtcttctcaggtgcgtcttgctctctcccgctctcgccaatttggatcgcttggagcgtatgatagtgcgtgcgcgggcgccggggggtctcggtgatttgctggggattcgatgcgtgcccataccttgctgcgagtatgggcacgcgtgatggattggtcgaattggcgagaggaagttcctgtgatttgtgattggctgtgatttgggcgattctgtgcataatattttgtgtgtgactgagtatgcgagtttgggaacaaaaattgtcgaaattacatttgtgcattttttttccttactcaagccatggatccttcagtactatcttactatcttacccctccttgggatatgtattttgacgcaatgtggcaatttatgatttggtatgctcaactaggatgatggaaagtgtccagtgctttatgtgctcctttctagctcacgtttggatgttgaactaatatgacaattatggcatggatacatatgaacgctgctccgatagccctggtttatgtgttgataattggcacatcttaaattcttgtgatagccatgtctgaaatcctggatattctacctgcgaaacggaacactaaatggtgtttgtcttggtaacactaggttctgcgaaagcatatctccatgcagcgctggatgaaaataatgaaatgtcatttaatttccatgtcaaaattttttgtttcatatatcctgcttgaatgatggattgcacaaactataccatgctcctagagtagctgtttaaacagttctattttctttcttatggattatgcattttgcgactttgcgggatttcataaattgaaattcgcttggcacttgcaaccttaccctatctgtgtaatgaacaggtttccttttttccttttctggttggcacaggaagggatgcactaatgtcatttacttttgtgttctaatatttaacgctatccaggaggaaccgcttttaatggtgttgtagaagagctgaagaaagtgacgactcgagttgcacatgttcttcctgtttccgatgatggtggaagcacagctgagattgtgcgagtgcttggtaggttgaaatctcttgccacaccacctgctacctgagataacaatttgtatagtaattgaaaatccaacctgttcttaaatgttaggtggacctgctgtgggtgacattagatcaagatgcttgagattgtctgatgaaagcacttcagaagccctttctgttcggacattgcttgggcaccgtttgcctcttgatccttcagaagcaaagcttgagtggtagcaattagtctgtctattgcatatcaaaactcacctttgttcattcaaactggatcaagtaactggctgatgttttttatgtatgaaacaagatgtgtgatgttgttaggttgtgtacttgacaggtaccagattgtagaaggagagcacgctttgtgggatggtgtctcacagccatacagagaaacaatacgtgcctttttagtctacttccataatgaggtcagttcctctgtagtattttcttttcatagcatatttttaatttgcttaaagattttgctttgaaaatttcaaatgaacagttttctgactggagaacagaagagaatatgatttttcgcctcccccccttctgttttcttttttgccaagatttattttcctggtatagagggcagtctgatgatcaagcagtcgttccttgcccatgacatataattgcagtcgtttcgtttgtgcagatacttcgacggtcagctgaaatgttttgcttcaccaatggcaggtgattcttttaaggtgaaatttgcagtaaatcatattcttgtgattgcttttaacatgtcacccgttggtctcttgccacttctcaattcgatggcgtgacagggatgtcctttgtggcaatacttatttcttggtattggggcattttttgtggtcacaactcataataacaatactcccatcttgcctacatctgttattgactacagctttttattcttgcagcattgggaatttcttttttgctggggcacgcatattcttccagtctctggatgctgcgattttcttgttctcacgtgtgtcacagatccctgctgaaagtcttgttcttccagtgatatccacaaatgacaggcttacactgggatgcgaactatgggtaacatcacttatcagtattttagttgcacaataaaaaaaccagtagattcatttttcggactgctctggtgatctggtcttcttgttcttatgttggttaattttattgcttccatttatttatttatttattttgttatttcactgatagtttaattagccccccttataaactttctttaattattccaacttgcttctgaaaactggcatgattgtctttgttttacaatgttactcctattattacaaacattcccttactacaaaatcacatataatcatcttggacattattccattttcaggatggaactatcatccgaggtcaaaatgaaatatcacatccaagcaatggacgtaaagaagttgttaacaaggtactccagtctataaatcatttcagcatactcccaatagtagttaatatgatctatgtaacatcattgcgatgaaggctccaaagcatttctggggccacttcaatatgttctatggaacaacttttttatgttttatcttataaaagaagctatagaagaaaaaaaaatgttactcctacctttaaaattgtgttgccatatccttctctggtggactgatatttacaattgtgcaaactccatttcgttatgacaatatcggctatttttgcttcatttccgtttttgttcatggcatggttgtcattgattcacatgttatcttgaatctatgtttttctcctttttacctgggcatgcttgttgatttcttataatatttgtttatctgtcactgatttattttttattttgctttttatttttggaaaaggattgtaattcatgtagtgcacttccttcaaggattaagcgtgtcttttacatgtcaagtgaaggcagcaacctgttgcatgaggttagtacattcattttatcgtaaccacctagactgaacctttcattgcacatctatcatgaattcttggttgggtaagactttgatttttgttaaaacaaaagctactagtccctctaagaattgattcagcctttctactttaatttctcagcgtaaaatttttttcttgaataccacacatcttcatgttcttaataatgatcatgatataataatcagaaaatgtagtctatatttccatttatcatgcttatctaatcagtctcatggtgttacttacaacattgtgaactataccattcatcaatagtgggtttttagctcttggttaacttaattctttaaagagtacgcttactccttctaagcttagtaggcatgagaagggacaactccttcatatagtaggctgttatgttttgtgaatatcatgggcttaaaagggtgtgcacttataaccatgtaagcatattgggatgacatgtatcaaattagccacttcacaacagtatatatgtaaacaacccttttttatgttttaaaactcctaactgttcctactaaccttgcaatgcaggtatttcctgaagctaaccgtacagttttggagcagttaagtaaggtggactgcattgtatatgctatgggatcactctttacatcagtctgtccatcattggtaaccatgctgctctattttttgtttgtacataattgtattgacttgatggtcttaagtcttaacatgatatcagatatgttcatttttatactacatgcagtactaagcaaacatgggtgccgtg

SEQ ID NO: 56674 - DNA, 8775 bp, Oryza sativa
tcttggtttttagccccttggttgatcatgcttgtggctattggtgcttttgtctaaaattatttattctgaatctaggtacttcttttgaatgggtcgcatgacagagaaacaactgggttgcctgcttctggctttgtgactgccattactgattctctaaaccgtacatatggatatcctgacaaaagtctaaagaatcttgtaagttcggtgactgtgcctttgaacagattttcagctaatgattggaggaattatgcatcatatcatttactagctttagaggatgggaatatcccacagatcagcgtcccctggtccacatcttgaatgattcagttaaagatgtacatatgcccctgccccttaacattatctgtgtgaagattttccatctgacagcttctttttcattttgtgcagcccaaagactatgtgaatgctttattggtaccaaaaggaggccaaattcctttggatataaaaaacttgtcttctaaaggaatctttcatgtggtaagtgtttgtgtttgctaaaacagtgatcattaagtgtaaaatgtgtggaaaaatgttatagttatccatcgagtccttaactgtgtaatattttcgagaatggatagaaaatccagcctctatatccatgaatggatatatacagccaaaggttacatgaatacttagattctaggtcttttactgagaaacaatcacgaaaaagaaaatgaatggtcgagatgctccgaaattttaacgcttctttcctagttggcttttctgtgtgcgataccatgttacttccgtcatttcatccccaatgaaagaggatatctagcatcagcttattaattactactacctccgtttcaggttataagacgttttgactttggtcaaagtactgtttcaagtttaactaaatttgtagaaaaaaataaaaatattttcaacccaagacaaatttgttatgaaaatatattcaattattgatttaataaaactaatttggtactataaatattactaattttgtctataaacttagttaaacttgaagtagtttgacttcgactaaagtcaaaacgtcttataacctgaaacggagggagtacatgataaaactacaataattgcagattttgcacggtgggtcacattgagctctgtagccttggttaaacaagcttacttttgcatacttaggcatttatccattacatgttagaaaaaaggcacactgttatttacacaagataaatatgaaaactcaatgtgtaggtcggtattccagaagtacgcgatactggtccacgttcttctgtattgtagcttgtgcataaacagtattgagattgtcgttttaatgtgctaacttatgaagtatattgcaggttactgtggactctatacacgatggaaagacgggcattatttttgatccgcattcattgattcaagccctgaccagtctaatatcggataggcgtttcgtggaacctgatcttctaacagaaaatgtagagtctgtatgctgaaatctcagttctcaaatgttaggtatatatctcgctcctattttttccctgttcaatacattgtatggggaaactgtagcatcagttgcccacttgcacttcgtcagctagcttcattgcttcattcattgaaaacaaaatatacaaaaacaattgtgctcatagtttaatttcaccatcgaatcagatttcagttcttttatttcttgtgttattcaaggcgatgataatctcccctgttcttttgtgctgagtggctgaatgaataactaaatgatctgtgataattatttgaaggtacgtacgaacgaattaaatattataaagttgataaaaaataaattgtagtattctaagaaatctatatatagatttattattattattttgtgtgtgtgtgtaaaaatcgtacccttcgggagctcgggaagcccgggtattctttattccatttctctctaaaaaaacagggccttacagttgaacaagtaaaaccggaggggtcaaacgacgtcaatggaggagcgatgcgagacgggaaccccacgcgtacgcagcagtcggggatacggccggcactagtcgcttccgtccattggcgctaccctaccgggacggaaacggcatggagctcgagaatcaagatggctacaaagaagaaaaaaagaggaaaaaaacagagagatcgatcgggccagccagcaacgttccctcggtcatcggtacgattcagagcgtgtgtgttcagttcggcttcatcttcaattttgtatgtaccagtttggtccggctcaattggccacaaattatgaaattggttaatgcacaacacacgagtacggtacacacgcacacaccaattaaatcgagcaaggctttaccattacgaccttgaccatgatggacagcgagaggcgacgacctttgcttgacttcttcactgacccatggttggagctcgcctacccaatctcctatatataaaaagctagagctaccctgcatgcatgcacagcacagcccaagcgaaccagcagtccagtccagcacgggcgcacgctcaaggacacccagtgtacgacgagagatggcctctgctcgccgctggctctgcctgatactcgccgccgcggcggcggcggcggcgtcgggtgctccagctccggaggacgacccgggcatgccgatggcggcgcggcaccggtgctggatggcgagggtggggcgcacgtacgcggacgccgcggagaaggcgcgccgcttcgaggtgttccgcgccaacgcggagcggatcgacgccgccaaccgcgccggtgacctcacctacaccctggggctcaccccgttcgccgacctcaccgccgacgagttccgcgccaggcacctcatgcccgacgctgacgtcgacgagccggcgaccgcgagggtgttgttcgagcaggaggagaaggcggcgaagcagcatctccctccctcacgcccgcctgcggtgtggggcagcaaggactggcgtgacctcggcgccgtcacccctgtccaggatcaaggcaagaataattgcagtaagcaccaattaaactgttttattaataataaaaatggattatatcttctgtctcagtgagtacgcagccaaaaaaaagtcgtagaaaccaaaaaaaaagtctttgaagtaaaaagaaaggaataaacaaaatgatgtgatagaaaagaccccaacttttgcaatgaaaatattaactgaaagggaaactcttttaagcatttaggtggacgtctactggtttcttacatcccaactaaatgttagtatgatttttttttaaaaaaactgataagacatattaataatatatcgctccataaacatgtaagttagaattaaatttttataaattataaaaaaaaagaaatttgactattggatgtacatatactggagtttaatttgttatttttattataatttatagaagtcgaatttaaatttgcatgtttgtaaagtgatatactacctattaatctattttattattttttaaattttttttaataatcatttgattggcatgcatgaatcacccaagagatttacaacccatcttccaaccgaattacgtttccagaatcacataaatcttgcatcttcatcatgtcgttcatggcggccggggtgatatgaatctatgatgtgtcgtgtgtgtgtgtgtggtgcagacagctgctgggcgttcgcggtggtggcggcgacggaggggctgatcaagatcgagaccggcaacgtgacgccgttgtcggcgcagcaggtgctggactgcaccggcggggacaacacgtgcaagggaggccacatccacgaggccctgcgctacatcgccaccgccagcgccggcggccggctgagcacggacaagagctaccggccgtacgacggggagaagggcacctgcgccgccggctccggctccgcgtcgtcctcgtccgtcgccgtcgtcatccgcggcgtgcagaaggtgacgccgcacgacaaggacgcgctgcgcgccgccgtggagaggcagcccgtggcggcggacatggactcgagcgacccagagttcaggggattcaagggaggacgcgtgtaccgcggcagcgctggctgcgggaagaagcggaaccacgcggtggcggtggtcgggtacgggacggcgagcgacggcacgccgtactggctgctcaagaactcgtgggccaccgactggggggagaacggctacatgcgcatcgccgtcgacgccgactgcggcgtctccagccgccccgcctaccccttcgtctaataactaaggataccgtgcgtcgatcgctgtcgcgtttccttcctcgtttcgtactaagttaccgtaatttcgtccattatattcgtatacatgcttgaaattcggaagcatgtatataagagtatatcgtagagtcaataacccatttgtactaagcaagtgtatgtatatgcatgcgttgtatccttcttttttccttgaatacatatcacagacattcatgatgcgtagtggtagtagattatgccgcgcttcttgcatgtgtacaaaactgtaacgtgttagccccaacagacattccaactcatctggacagtcccgtccgtcccgtgtggcgtgtgctcctgaacgactgcaaccttaattgccggccacagacggccggggctcattggaggaggatcaggggccaaaaattagcgaggcccactactattggaaaaggctaagtacattttacgttcctcaactatgggctgcgttatttgtgaccctcaactgtaaaaccagctattgagtgctccctgtcttataaaccaatgcaaattgagtcattcaatagtattgattgtggttttggttgacgtgacatcctagatagaaaaagaagaaaataagaaacgcattagaacctggctaccccaccttcctcttatcttcaccccccctctctctctctctctcattgtggctcgccagcggctgcacccatgggagctcgattgaggaaggctgcaccaaatggaggaaggctgcgaagacataggagctcaaagaggctagcgagaagggagctcgattgagtagacactcaccatgccatccctcgtctcccccatctccatcgccatgtgcgcaaggaacttgaagctcttgatagccacatcccatcagcacgatgacagacttcaagtggccacttgccctctcatgatgttgacgtcgaaggcaaagaggttgaagaggatgagaagggtgtagtgcttgctgaagctagacgaagtcagatgtagagaggaaagcaaggagcagcagaagaagcttagcctccaatttagagaagcagccatgtgcgccgccgcattcgtagggagtggaacaggagaccaagaagcaacatgacggcaatcgaaaagcagccacatccaccacaccacatcgttgactaccacgaagcatgatctacgagtcgtccagatcagggtctgcatccatggcttgcttgaggatgccaccgccgctccatgtaggcaaccacttgcataggagaagctcgtcggtagttgggattaggaatgtagagtcgtggggtgaagcagcaacacctatggaggccatgatagggagcttctacctgctgatgggaggtggctagcggctaaggagctcaagcacccaaaagccgccaccaccaccggcgccacgcaagagtactagacgactggtgtaggagagggtggtggtcttcggctggtggggcggtggaattgaggatgggtgaggtggtggaattgaggggatgtgcagtggtccaaacaactggcggagagaggaggagacatctgcatgtaaatggagaaagaggggaagagaggagagggaaaagggaagagagatgggtatgccactgacagatgggacccactaactattttaaattctaggcaaattttgctatacgacaccgtgacttcgcgttttagctgtcggacaccgcatgcattaaagtaataatttccggttgaagaggagagagaaatcgtgtgaaatatcaaaaatgcccttgggcccacatgtcaactctcctatctatcctctctctatcactcatcttctctctctatcccacatgttagcgacgatggtgggcaggcgaggtccagtggcggtggtggcagaggcagaggcgtgagggcaagggcagagcggacgcgaccagcgatgtgcagaggagcgccggcgctggccggacagcgggcgaggttcggcggtggcatctgcgtgtggaggagcggcgtcgtggttggacgacaacggctgcagcgcgcggagtgaggagccgtcgcccacgcagagtgaggagggaggggcgccgtcgatggtcgacgccgctgtctgggcgtgccgttggccggagccgtcgtcctccggtcgccacggccactcctccctcgccctcacgccaccgccagaccttgcctaaccgccgtcgtcactgacatgtgggatagagagagaagtgaaggaggggatatagagagaagagagataggagagctgatatattggccctattactgacatttcatgtgatttctctctcctctctaacaggaaattattactttaatacgtgcggtgtcgaccagcaaatattcaacttttgagaatgtcttccccaaaaatcacttcgtgcggtatcttatagctaaaaccgtaaattcatgacgtactttagcaaaatttgcctaaattttataatggtaatgctacgtaagcgtcccgtagacaccatgttagatgaaaatcagattaacatgccacgtaggacgaatcatccaattccaaaccatcgagactcgagagattcaatttatactggtgtgatagtcggggacgtaaagtggatataccctcgtcccctgtcatttgcctattttgatccgctcagccacttctccatcacccgcgccacgcatgtgccacatgtgccactcgcgcatgcaagtggcgctgctcctttgcacccatgcatgcaggccggagcgagcagtagtagtagttagttattgcaagcaacctcagcgatcgcattcgcacgccgagttttcttccaatatcaggacaacaactcgtccaccctgcccattcgctcgctcgctcgccgtgcgtagctagctgctagtagctcgtttcatcacgttgcatttgcgcccgatcgagcgggccggagcgcgcgtgccgccggtgccggcgtgcgcgccgtcgtcgggacgggccgtggttcgatgcacgccgccgtgccgtcacttgcgagagtggcagacagggacggccggggcatgcgcagcggcagctagcccatatatgaacggagcccacaacccagcatagtagtataatgtaatgtgcccgccgccaaggaggagtgtcatcaggattgatcaggctagcaataataatgtacaaatggactacgcgcgcgcatgcttagtcaggatggggatgcatcgatctggtgcaagcaaacgctgaaacgcaggagtgcatcttcctatcaccttaattgattgttactcctttgctattcgtcaggtgacatcgttttcaaatttctatactgggggaggcgggaatagggcagagggaggggtattgcggactcggtgccggtgaaccggctggcttatttttattagggttttaggattgaaggtgggagggggtttgggaggcggagagggcgatttaaataagtgttaagggtggtgaaaaccagcggcggacgttaaggtgccggggccatgagaatagaggagggtgatgagcggggtttacagcggatctagcggtgtgagccgccggagatagggatgagaggcatggccggagaaaggcaccatagtttatacagtgtttatggatctaatcttgggggaagggggaaaggaggagggaagtggccaggaaggtgcgactgattggccttgccgctaatgtcgataaggtggacggaggtggcgacggttgggtatggaggaaacgatgagagaggtggagttttggtaataacgcttaacatgaatgttgaatcaatttgaattgttaaaaaaattgatttatgttgaaggaagaaattcgtcggctgatatatagtactctttgtactaaaatatagttaacttcatataaaaaaatatagttaaatatatgttatttttaaagtagctatttactactccaccttcgtctcaaaatatattttttttctatgaatgtttatgttttaggacggatgaagtatatcttttatagaaaggggtaagcctctaattgttgttatcagtgtaatagccatatagggatgggatggaataatcgtgctgagcctgagattgaaaccggccgtccacatcaatgggatcacatctgtcaccatcgacggccgatatattgttgcttcttccatcctcatggtgacaataacatgcactgtgtagtttgccactcatggtgataacgagatgcattgtttagatcgctggctaaaaaaaatctacgccgatttttggagtcggtaatgatcttggccgtgcaggttactggactgattgacggccgtgtgcatgccatctaaatgattatgagtatgaggatggattctaatctctcgggtggacgtccacccgttt

SEQ ID NO: 56675 - DNA, 1326 bp, Oryza sativa
atattacatattaacctattatgtcaatttttttgaaaatttttcataaccatttagatgacatgcaataaacggatgaacatccacccgagtgtttaaaagagtttccccggtgtgcatgtatggttgaagttggagtattgtgcgtcgggataatgggattttttcgatcggttgattggctccggcgctggtcggctttgttgctccgctgcctgcttgcttacggtatgcgtcccacttcctaagatagaatcaactaatcctttctgataatatatattaatacttctttttgcaattggagacacttcgtcagatgcatggtgtttcttccttgccgagaatcaatgatcatttgagatgttccatcactaattgcaacatttgagatgctttaaccagatgcaaaactcaaaaatatactaatgcaacattaaaaaaaccaatacgtacgagaaacaatcaacaacatgaagaaaaagaattattgacaatcaacttcaatatggtgagcgcacgcctttaatgcgacaatacatatcatttgcaagtacaacaatatgtaaaaaaaaagaatataataagatgaaacaagataaacaatgaattgtaacagtatctaaaaaaactgttcaacataatcctaccagtctagattagccttcttcctctactcagagtggccagatccgctttcttcctctactctctagtggctagatctaggctcctcatgaaaaacaagtaggattcctcactttgggtaaccactctactctcggacaaacatagtgagggccgaggacttggaagatttggaaggcggaggtgcagcccacctatgagtaagcaaaagtgtgcggccctcctatgagacatattaattcataaatatgcaaagttaaattcactatctacaagttataacaaaaagaacaagggttggtttggtttgtggcctagataggtcttaccaaattttgtcaatgccaaattttggtaagttttggcatgactaattttgataaggtaaagttgtgtttggattgaagccaaaatagtctaagttcactattgaaatgacctattttcttagggggcttttaactatttgccacttttagatttggcaaataactatttgccacctctatctcaatgacatgtgggtccacatatgtctatgacatgtgggcccagtggcaaaaagttaattgccacatctaaatatggcaaacggttaaatatctcattttcttaggcatgtcaaaattttgcttcaaaccaaatagacactaaacactattaaaattgacaaatatt

SEQ ID NO: 56676 - DNA, 1333 bp, Oryza sativa
tcctgcagcccggcccagttaggcccagcacgagaggcagtcgcctttctccttcccgtgggcgccgcaccaaccagcgtgcgccatgggcgcgcgtgccgcccaagccgcagccgccgcccacggcttgcgctgccgcctgccatcctccggaaccgtccttcgccttgcgccaccaccgtcgcgtggccaagccgccaaccgcctctggaaccgcctccaaccactgacctccatcacctataaatagccgacgaagtcgtccatattccccacactatccgagctcatcgagctctgtcttcctctctcttcctcaagaccggctgccaccactgtcggccgatctccctcatcagagctccactagccaaactctctcaccaccagccttgcctcactccggcgaacccatttttccacttttccccttctccttctctctctctcctgccggttcatggacttgcgctcgccgttccagccattcccctaaccccctctgccggccactgccctccctaggtgcgccgcccgggaacaccaccggccgccgccgtcgccgcctcccagccaccagagcatcggcgcccaactccctctctcttctctgttaaccggctggaaggaggagaagaaagaagaaggcgggaggaggaaggaaaagagaaagagaaataaaagaaaagtctgacaggtgggccctgcacagtacattttcgcaatttctagattttaatccaaaatctaatctttagaagcccatatctcctaaaccgtaaatccgatttcagtgaaacttggaccaaaattcatctaaattcaaaccctacatttttatacccaattttctattttcatattttatttgaatttccttaatctatttaaataccatttgaagttatatttgatttaatcctatatttgaatttctaatttaaacttatattttatttttcaaatatttcctttttatcccaaaatatcctttagccactaaaaaccgccggttagaactttacgccttctatggggacgttcgcggtttactggtcccgacgtcgaaccgttggttgtaaagcccaacaaaatcctaacacaagatcaaagtgctgctcttggcaccccacacctctacaacacgccgcacagttagctctcaggctctgtgtgatcctaacagctccgccaccactcacggttgtcggagtaacacttcctgcacaaacttcttatttctctaaccgttatactgtccattgacaccgactagagaagatataaaacctaatcgttataatacccaactttagcatcgactagcacatag

SEQ ID NO: 56677 - DNA, 3552 bp, Oryza sativa
ctatcccatactagcacatgtggttgcactgtatacgaaatgaactgacgttgagtgaagtccttaggtcggtttgggcacactctccccctatcggtacacaactaatcaccatatgtgcaccacttgaggcccaaacctaaaatccatgttttccatcattttatttatcaaaatcacaagtattaaagttctgtccagattatttcaaaatcaatttttcatatttgtaatgagcccataatgacaaggaagaccattctaagcatggctaagcattatagtaacctagtgaggttagtcatattgttcctaaggttaggaatgagggatatggatatatgtggggtcaaggtgaatgcaaacaataggagtttgtctaacaagtttaacaaaattttaatttattagtgtacaatcgacatgcaagatttgcaaacattttcaataacctccaaaacataggttcaaagtgatcaaagagagggaggtgggacttgccttgaatcaggaaaatgtcagcacctaaatcacttcttcaccgtttaagcaatcatctatacaaagtacacgttatgcaattaaacaccgaaatatgcgaaaaatccaaaatgctctaaaatggatgatttgtgcacagtgaataggtctggtctaaaattaatttaggtgaaagaatttctattttatctcattttatttgggagttatgaattttagaagtttcgtcggtatagtgtaggatttacttaggtactattgtgaaatgctgttgtaaggtgattcttattaagtttatgtttgctggggtgaagatatgtgttttctaagactaacacatttggtttcataatttttagagttaatatgaattctttatgtattttacaaattataacgtgttataggtgtatagtgttctataggttcatggctttagaggtttaggtctagaacttgcctcatctagctagtgatgtataaaatgagtattttagttaactaatctaaccttagttcataggcttatggtctttattatcatggttcatattttataaactaggggagctctagtccatgttagcaatttattatatcaacctagaaattattatatgagctaagtgctttaagttttggtggatgggaatggaactatgaattcactggtctaacaagttttatttgggtttcattatagctagagtgtatttctatgtacatttatatatatacatattgctcaatcgatactatgtgattagaacctatcctataaatttaaagtttagagctataacctgtacagaaggttccatattttattttactatgttgaagcccactgtttgctggttctatagatatttggttcacttcatttagactaaagatgaattttctacaaattttacaatttaaggttgctctatggtggttattacttacataagtatttagaggcttttatcatacagtaagtatataattttattttataacttggaagtatatgttttggtgattctacagaacttgggtttactcaaaaaggatctaagatgaattttatatgaacttctaaaattcagcttatctaaaactagtcatttaaaggtaatagttttagaggcatttgatgtatagtatgtatactatttcattttgctttataggagaacataagttggtggatctgtagaaactgagtttgctccaaaatgagttgtaatgaattttgtatgcattttataaatttgtgtgtgctttatgtgtgatttaacttggataaattttagaggctaaatttgtactgtgagtgcaagtttttattccataacatcaaagttcccaatttggtgagttcacggaaatttgaatcatcttaaaatgagctatatttaattttatatggatttttacaagttttagttactgttcttttataatttcagattttgtttccaaggggtccactgtcagtgagagatcaatatacaaaaagatccctgaggtttctaagaatcaacccgcagacctaggctcatatgtcagtgagttgaaaagttgcacattaaaccttatagttgtttaaattctcgaaacaaggtccctgacttcttttctcacgcagagaggcagaacagccatggctgagctcaatctcgagctcaccggcgacaaacgatggctcgtttgggggtgcgaccaaaagacaaaatgaagatcatgctattgcgattccattcctctacttttcttggtcagtggacatcggagtaacgccggcggcgagtccgaaaggaggatgttttcgggtggtgatgcatgtgcttctacaatcatgtattggttaattgggtgcatgcatgtatgttctataggcttctgggtgctcaccgagatgctagacaaggctggggatgtctgcagagtcacagcgacggcgaagctccatggcggcatggcacaactccagggatgacgtccgctgctcgatctgtatggggagtcactaatacggtgcatgcaagaggtcaaaggctatctagagaggccatgcatgcatggaatttgactgacgctcaccagagagaatggaatcgatgatggaagcggttgaacggaattggaaaagacgatgtcgacctccaagatcgctgcgccattggatgggtttcttgagggtaaatggagaggaggttgaggtgaagctggtggcgtggtggctcgctccgacttgatctagattgatggcaacggcgacgatgtcgctgcggcggtgcgcagctccagagctccggtgtgcacggcagcgttcccgccgattggctgcaccagagaggatgaaatcaaaaggagaaatattcggcatggtgaggagagtatggaacgcaagagaagaggaaacgaccgcggctcatcaacgattgcggccatcgtcttcttcgcagccggcgatggagaaccagtggagaagagcagcgaggatgctctccctcggatggatcggcactggaatggtgggtgaagagtggcgacgcgtctgggagaggcagagatggagctcagcgtttttaggggtcgacacgtcgtggccacgcgtcgcgcggcgtccagagccggtcggcgctcgatctctccctctcagtgtttctggctagggaagttgcacagaggaaaggcaagccggagggactgacaagggggcccaggtcgaggtaaactaggtggaagagagatgtgtaggcagaaacatgggtgagcttggtttttggacgaatttccggaattattttctcctctaattttgtagcttcaatacttaatgtgttgatcagattaactagtgttgattttactggaggtaggtgtatgtacctagtttctattttctttggttgcactcaaaaattatggatagattacttacagaaattagaggaatatgggttctttggaaactagttcgaatttttaggagacctaaacagagaagataaattctggaaaaattatttttattcattataaatgacctagtatttg

SEQ ID NO: 56678 - DNA, 1085 bp, Oryza sativa
ggtttagttgtttatctagatcttagttaatattcatgagacctattatgaaatgcaaatcgaaaatccaaatgcaatccaaatccaaatgcatatgaaggactcaagtcaaacatgtctatgagagtatgcatgcttacacataaatttatatttttgtcctaggttagagatgcaaaggttttaatttgttctaaaattttatcatgcaagagttagatcaacttcacctaggtttaaaatggaaatttttggtttacaaaattgaagaactttcctttcaactagttttgatagaaattccttaatcctagaattcgggtatgttacaggtatgcaagggatcaaaatcaaattttggaggtatacaaggaagtaaggaaaattcaggggtatagaagggattaggtaaaattttaggggtatacaagggattttctctattacctaacactagaacgtgatcgcttatctgtgatgggctgaaagcatcatcactatcgggtaaggccaccgtcactgggtaaaggtcactgatgtgaggaaaaatctcaattgagcaaaagcccgtcatggatggatgttatcttaatcgggccgaaaacaaagcccgtcatagatgagtatgaccagtcaaaccagcgtagttaggagcccgtcacggatgattaatatcaatcgggcaccactaagcctgtcacagatgactagtcatctcaatcgggcatttagatagagcccgtcaccgattggtttgaccccacgtgttgagtcaaacgagtcccggctcagatgacttatctctatcgggcttactctgaaagcccgtcacaaatgacttagctctttcgggcttattctaaaagcccgtcatggatgacttttctctttccggcattattaatatgcccatcagggatgagtttggaacaaaaaaaaaataaagttttataatttggctagcctcaagcctttgctagccatgcccgctgcaaaaattgacagaagcacatatatatagtcccattcccagcaacccattcccaatatcacagcattcacagccaattcacaacatttatatt

SEQ ID NO: 56679 - DNA, 1354 bp, Oryza sativa
gatgtgccaaaacttagtgaccatccaaatggaccaaacttcttcacaggaaccattccaatttcttttggccaacctaaaaggcttgagcatactaaatctttcccataactgcttatcgggcaccatcccagcagtattgggggatctacctctactcagcaagctggacctttcttgtaataatctccaaggagaaataccaaggaatggattattcagaaatgctacatttgtttatcttgaaggcaatagggcactatgcggaggtgtgatggatctccacatgccatcgtgccaccaagtttctcacagaacagaaaggaagagcaattgggccagattgttgattccaatatttggtttcttgtcactcacagtactgatatgccttatataccttgtgaagaagacaccaagaagaacatatctatcgttgctttcttttggaaagcagttccctagggtttcttacaaggatctagcccaagctacagggaacttctcacagtcaaacttaattggaagaggaagctacggttcagtatatagagcgaagttaagtctggttaaaataaaagttgcaattaaagtttttgacctagagatgagatgcgcagacaaaaggttcgtatcagaatgtgagatcttaagaagcattcgacatcgcaaccttcttcctgtcctaactgcatgttcaacaatagactatagcggaaatgctttcaaagctctgatttatgattacatgcctaatgggaacttggacatgtggttgcataaaaaaaacaccagtgttgcttcaaaatgtttgagcttatctcaaagagtaaatatagctgttgacattgctaatgcattatcctatttacaccacgaatgtgaaaggtctattgtccattgtgatttgaagccaacgaatatccttcttgacaatgatatgaatgcatgtttgggagacttcggcatttcaagcctcattcttgaatctagattcacctcacttggacattacagtccaaatagctctattggattgaagggaaccatcgggtatatagctccaggtatatatgcttcttgttacaccttaaattcatgaaaggcaatctgttttctgcattaatacttatacataataatgtattaattagtgtgattttgtcttttcttttagagtatgcgcaatgtggccatgcatcgacctgtggggatgtttatagttttggaatagtacttctagagatgctgataggtaaaagaccaacagatcctatgtttgagaatgagctcaacattgtcaactttgtggagaagagcttcccagagcagataccacatataattgatgctc

SEQ ID NO: 56680 - DNA, 779 bp, Oryza sativa
agtaattggaatggttcctgtgagaaagttttggtccatttggatgatcactaagttgtggcacatccccagagaatcaggtattttcccagtaagcttgtttgatgtaagttgtaggtagatgagttgtctaagattactgatctctggaggtatggtaccttgaagactgttgtagctaagatccagctttaacattagcgaagggtttcccaaggagggtggtatgtgaccttcgaatgcattgttttccatatagagctctgtcagctgtgtaagattgccaatggagtatggaataggcccagtgaacatgttcttttgaagatataaagattgcaagtttttaagattaccaatccattggtcgatggcacctgctaaactgttttcatcaagtgccagtagaatcaacccagagaggttccctatgctaggtggaattataccagataatttgtttccacccaaaatgagatattgaagagtgctaggtaggcaaccaattgaattcggtataactccctgtagttgatttgcatttagtgcgagcatttttagcgccgtgcagtttgtcaacacatccaggaatttccatcttctgtatcttttgcttcaagcatgtttagctgaaggtctagtttgacagtcgtaaaagcttaaccaaggaagtagggatccggcctgtgaaattgttggattgtagaacaatatcttctagcattgaggcattgcttaaggaagctggaatgtgaccctcgagtatgttgtgacccatg

SEQ ID NO: 56681 - DNA, 3401 bp, Oryza sativa
tcttagttctaaaaaaaaagaagaattatttgcatcttcgagctccacatcaacgtgatggaacaaaatgcagagtctagacaggaatacgattgctcggacggcaatggcgtctagagggagtagatcacgagttcacgaccaacgaagcttgatcttgtaaagccaaagtcgtcagctttggcctgttctgtattgcggtcaggcgacggcaacgtatatgatatcggacaaggaatcgcagaacgaatttaagcgtgtggttgtaaatctgcggcacaactgttcttaaacctctgggcgccacgggcctgagccaaccacatacaactcacactcgtttccactttccaggcagtaacagcgtgttgctcccagcctccaactagaggttagaacctaatttattcccttcggtaatatttcctacacttcgtgcgccttaattatggttgtcaattttctcagtatgaacatattataggactttagaggcgataagcatgcacagtagatcgaatcaactttaattttgagtcccccgcccaaaaaaaaaaaaactttaattttgagtcatgctcgttcaagaaaatgcacgggaatcgtatggctgacctactgcattcttccctccgtttgactgacatgtattgagttatgcttttttgattgcagctaagcagcgaactgtgaaacacagcatgcttgtagttcttgagctgctgccgctgctagtgctactacgcggagctggtggcatccgttgcgcaactgtccccgaaaacagcacggacatgctctcattgctccatttcagaaaagccattaacgatacggctggagccctgaacagctggaacaaaacatctccccattgccagtggaacggcgtcacatgcgcaacgaagcaccccgggcgagtcacggtgctcaacctcaccggccaaggcttgtcaggcccaattgccccctctgttggaaacctgactttccttcgtatacttgatctgtccgctaattacttctctgggcagatacctcctctcagcaatctccacaaacttgaaatcctcgatatgagcatgaactcgttggaagggaattttccagattggcttacaaattgctctaccctatcggttttagacctcagtaagaatacgttagtaggtgcaattcctccgaaaataagtttgctttccaatttaaagaaactgggcctttccgttaataatttcactgggaccattcctccgaccctcaagaacatcactaaccttcgacagatggtcattgcaagtaatcaactcgagggaaccattcccagtgagcttggccaattgtccagtttgcagctcttatcattggctgacaacaatctctcaggcgaaattccacatcccttctacaacctctcatctctgcaagtactatctttgcgtgataataagctaggcaagacattagcacctgacattggtgacaagctctccaatctcttgcagattttcttgcaagataatatgtttgaagatagcatcccagcttccctgggcaatgcttcagggctaagaaaggtagatctgtcaaacaatgttttcactggcccagtgcccagttcttttggtaagctttcgggactacttgctctaaaccttgataacaatgaccttgaagcaagcgacagagtaagctgggcattcttacatgcgttggggaactgtagttctctgcaaactctatcattagcacaaaataaattaactggacctatcccagattcgattgggaatctatcgaaaactcttcaaaacctagtattaggtggaaataaactttcaggaatagttccaaattgcattgggaaactttctcggttaattctattgacactagattataattttcttactggtactatcggagaatggattgaaaagttggaaaaccttcaagttctaattcttgaaaacaacaacttcattgggcctattccatcctctatcggcaatcttacaaaattgggaagactccaattgcgaaacaatagatttgaaggtcccataccaactttaagaccatcttgaaagcctgaaaactgcaaacaggcccatgtgctgaccaactggatcggacctcaggatttcttcttcactatggtgtttttggtttctggaaaatcatacaaggcgagcttaaattgttgatgaagaacttctctaggatgaaccgatcgaccagtcatccggtgaaaatcctccgcgtcgggagcctgatggaggagaaaaaattgggcgccccgcaccacgctacgcctccgcgcccccaccacatgcatgtgcccgttgcaacaaccacccggatataacgaaaacgctctattaaagaggatccgttttatttttttgttccgccaacaatgtttcagctagtgtcgtgatgtttcactatgtatggatcaaatgttgcagtggattttgaaactgtttatttcatcctgctggacacgtggtttgttaatgtacacggggtttaagtgttgcaatggctttaaatcgtttgttttatacgttgaaccaggttgtttcatctagcgatctgaccgtgttttactttttctaagaattgaaacattttttcgctatttgctgaaacattgtttttatatagggtgaaacaacgcccaattttttggaaactgttgtttcatacgttgtagcaaaatgtttcgtaaggtgatttggttgtgtttcagcttttcaaaagattgaaacattttcaatctacttggtgaaacagcgtccgattttaaaaaaaaaattgacacccgatttgtaggcgcgtacgtcttccggtgacgccgtgacatcattggagcagcttgccattgtgctaaaaaaaggaggttgatggaataacttgctcacagcttcgcggcctaatatggtaatttatggagtgcagagaacatgggtatcgtatatcaatacggtctgcgtatctatatctaagatgcagaagataggtcaaatccatacaatatgtaatgaagtaggacttgatcgtcatgttgcgttgcatcttaaaacatggcatagaaccccgactgcatactactatgtacatagattaaaaaactgatactgactccagccaggttttccttattataaccttatatcccccaagtagcctctccagggcaacaaccacaacacaatcaatacaactcggtggatacaattcactaaaataggagtagggtattacctcttatctaaatagtctgaacctatctaaatccttgtctccgtatatatatgcttttagcaccggttcgaagccctaaaaatttattgctgattcaaaacatcaacatggagatatctagaatcagctaa

SEQ ID NO: 56682 - DNA, 3967 bp, Oryza sativa
  unsure (1)..(3967): unsure at all n locations
nnnnnnnnnnnnnnnnnnnnnnnnnnnnnnnnnnnnnnnnnnnnnnnnnnnnnnncagagtgtcaggaaaccatcacaaatctaagcaggcagctgcgagctcttaagagtccggcagtttcaggcaatctagacagcccagtgtccaactccagaccaagctcatctgactacaagccccagtcacttgcatgcattcttgctgaaggggaggactccagcactgaggatgccatttctcctgcaaccaaagaggtgcactccaataaagaacctgatgctgcatcacggaaaagcgtagcacaagatggtagtgttaatgctgtcctcaaagctgtggaagaggaattaacacaagccgttgttcatccgatcttcccagagccatcccaagagactatttctgctgatctcaagaagaagagacggagccccagcttgctgggcaggataatgttcagaaagaaagtggaaggcagctagatcatgctgctgatctggtggatgcactgtgatggtaaaagcttgcaaaatctagtagcactccaccactatgctgtcactggagatttcgactttgaacgaacgagcttgttctgtttgttgagcattcctgttccttagggtgcaacctttttggacacgtattctgtcacagagactgatgacttgtggaagagactctgagcacatgatctgtatcggttttccttgacatggacaaattttctttttgtatttatggcctccatggttgtgtaaatgttaatttaataagttaaaaattcgttcttgttcactggaatacgtacatgcaattctttttttctgtctgagcggctccaagtttcaagacctctctataccgtttggaaaaatccatacaccgacatgagattacaggtacagaagtagagattttggaaaatatcacaaattcacaatggaaaagcattggagctggattgcttctgaattctgatacagcagtcagcagaggaagatatccattgtgccttttgaaaccacaatagagatatactgttagttgccctgtagttgtagccatttgaatgcaaaagcatttcaagattcttttaggtagggtgaggtcgccaccagtactcatcccaagaaggattctctcatcacagggatgtgaccttctgactttgtatacagaatactatatttgctttataaacagctgaaaaataccaatcatgctttcctttccaaaaaaaaaaaactaatcatgccggtgattgtcgtaatcatttacgaggtgtacagtacagcaccggcccagctgatctcaacagaaagaggcacaattggcctaggcctcatcatctagaagcaataccgtctaaactaatcctgagtcagcacaaaggatggccatattcagatattctaaaggcggccgtgacaggatagaaggcaacaccatcaagccactggggtttccagactctgaccgatcgcaaaaacaaacaaaagtctgaagcgctaatatgcttgcgtcaaatacaaaagaacggcatcactgcgtctgcatgctactgacaattttctcaaggctttatattcctcgagtcatttgcgttgcagttgcagacaactggatgcagttctgctccaataattagattatcattcaggttgcagacaggaactcatccaggcccggtgatgcctgggacggcaagagcttgtctttttctttcatttttttttgtgttattttctgctgctgatagactgatgatggcaattgtttgtcacttgtcagtcatgtactctgcctcgtactttttgttgctggatagcgttattcggcagcgtagccatgttatcatgtcttatcttgtaggctttctttgggttgtaatgcaggccaaatggcaacttgtaggatggtttcagatccttcacgccgcgtttggtttctgaaggggactgagatttcgtctcctcccatttggttatagctatctgtctatcaccacaagtttactgtttgcttgtgttcttggtccaattcagacttctgcagtgctgcttgcttgacctgcagctcatccaaattccatgtatacttttcttgccatggttatcctttgtaacactaaactgtctctgcacctgcgttgaaagttgatttgcgtgtgatgtgtaacacgtgttcatgtattgcaacttaaacttcatcacaaacttgtttcactaatttgtcaaagttttgctttttgcaagtttgcaaccctaggaacttcattacgagaggtgatagtacaaatgatcaaggacagaagaagatgccattctcagtcatgcaattttgtacttcaacaaatgagtcttttatttttttgaaattgaagctcttccccgatccttttctcatctttattccagattatagttatagaacctacctccaggctccagccctacatctttacaccccaaagaaaaagcaaaaagaatgaaaggggagaaaaaaaaagaagaacgaattacgaatcagaagctcactatataagacaaccttttccatctttttaatcttttgacctttttacatgtttacatctaggtaacaacatctagaagatacaaacatccatggaaaactgcagccgcgatgtcctaactcctaagcatattgtcagaatcagccattaactgctgctaattcctgtttgacaagtgagccacctgtccctctcatcagtgcttacgtcagtctcgtaatgagatctcgaacaggtcggagtcggcgtccgggtcgccggccgacgcgccgccgccgccgccgttctccttcctgctcttgctcatccgcgacgccgtctccagccagccggagtcgacgcggcccatggagaagaggtcgccgctgtcgtcgaagtcgaggcccagcgagccgccgctccggccgtcgtcccccgccgacgcggcgcggaggaagcacgggttcgccgtgcgccgcgcgttcgccggcgcgtaccggaacttgccctgcccgaggttgaccagcgccatcacgtcgaagctggaggcgaggaccgggtacatcggggccgagaacgcgtcggcgttgcagctcacggcgtggaccagctgcccgtccaccgtgaagaacaccttccgcctcgccggctcgaagccgcagcccaccaccttgtccacgcccgcccacgacgacttctccgactcgtacaccagcttcatccctgccatcgaatccgcagaattttcagctcaagatttccacggtcgcaacgcgaggaagattcttggaacggggggagtgattgttaccgtcgaggtagaccgcaccgttggagtggaagccgatggacgacgcgtacgttccggccagcgactgccgtggcggcgcggcggacgcggcggcggcgaggcccaacgacatgaccgtgtgcctctgcttgtcgtggtgatcgtcggctttcgtggcggctctggtttcttgggccgcgttcttggcgtccggtgcaaagctgatgagcttggcgcggtcgctctcgctggagccgtccctgccgcggcggctcgccctcgacgccgaccactccggccgccgcgtgttgaggtagatgatggtgatctcgaagtaggcgtcctgcgggaacggcgcgccggcgaggggcgggccgggcagaggcaggctcatcctggcgaggcacagggcgctgctgttccccgccgcgtcgtggtcgccgccgcggagcgggctcgggatgctcccggggagccacttcttggcggacgccgagacggccgccgtcgccgcggccaccaccgggttgagccgcaccgcctgcatccgctccgacgaccccgcgggcacctcccacgcggcgtccgccatgtcgcggctgtcccggagtcgcaggcggggcagagcccccagagcggcgacgacgacgccgacctc

SEQ ID NO: 56683 - DNA, 2186 bp, Oryza sativa
ccaaatacgtgtaatgatgaaagtataagtacacaattggtagttttcgctcacatctcttattttaaataaaataaacaattgaaacgctctagtcactcacatatcttattttaagataaataaacatatcaacatgcactagtcatccgcataccagctcatctgtactccctcccatatttgattttaaatatatgtttgacaattcattttacttaaaaattataaaaatattgcttgttttgttgtgacttttaccattaaaggtgctctaaacatgtcttatgttttatactaaatttttaataaacgaactatggaaacatgcataaaagtaaataatgtcatatatttaaaaatggatgtaatattattttgctgatttcaccaatgtgaaaaaaaaaaactgtccctaagaatcggtcaagttatgtaatttgtgtaacctcccccctccctacaaaagaaactgatggatgttggcagtacttcttttcagctgaaaatttttccaaaaaaaaaaaaaaacttaagcgcgtaattaatctgcataacgcatccgttaacccttttttctttgcaaaagcttcagctctgacctcactcctcactaagccatccccttgcagtttaatttggaggtacaaaacgccggtggacgtaagccggatggcacgcgagaacagacgtcagatatataccaaatcctatgaaaagtaatatgttctttctccgatgcgtcggtgtcgcggcaaacgtcagatgcccgcatgatcatccccggccgttctgttcacgatttcttccacttttttctattccaacggctcgctaatctctctctctctctctcgttgatagcaatcaacagcacgtgatttggaaggggctcacacgtggggaagcatcgatctgggacggtgtcatcaggcgagagtcatatcctgttcggtctgtgcagaaacgagttgaatttggtgcttagtatctgtcttaatcatggagctatgcatcttttgtcagctcaacttgggtgcttatttttagtcccatcatgaaagtgtattactactagtttcttgttatggacagcttgtcctacttttaaatccatctcggctcaaacagagaatattggctttggacataaccttgatttgggccttgcaaagggaatgcatttcgattggaccaatataactcagtgaagcaattgactaggacggtacaggcccaaagacgaggtggaaacagtacaaaaggcatcaaaatgcctgtgtccacttgcttggagactggagagtgctttaacctgagaattcttttttgtgtgtggagaaaaacctgatattatgtaaatggatattacctagggtaagcctctcatttgcatattcattcagattcaaagccaacaaactagaaagatagaatagaatgatagaactccagctcctcgttgggttcacgactctacccacccgctagagaactctagttcaagtcctggtttcgataattatgaccgtgtgcatctgtgattagtgtagatgctggaatgtatagaaaaaaatcttattaaattcaactagcattgtggcctgcgcagattgcgcggctaacatcattatattttctctcatataatagcatatatgttttctcattatattatttaaatatattaaaatgacaacataattttaaattttgcaataactttacgaaactactaatatgtaatgttcctattgtattttatatacgtgttagttatgaattatttttaatatcaaattttagttatttgtaaattatatatattcctatatagactctagactcatcttttaatatatctttttaattctgaatttttattatttctaattgaatttctatgtggactctaaactcatctttcaatattctttaatttttaatttcaaattttaattacttctaaattgtatttctatactgactttaactcttcttccgatgtttttcttaattttgaatttcagttatttgtaaattgtatttttatacgaactcaaaacactacttttaattttattatgtttattccgaatttttgttagatttaaattcctatatggactctatactctacttctaatattccttattttttaattccaaatttctattttttttct

SEQ ID NO: 56684 - DNA, 722 bp, Oryza sativa
attcttcactccttgatctaggaagtagcttagaaacaaaagagaacaaaaaccttgaagagaattttctgaaaacatcaagggcgtactggccccagcccaggttgcttcggcccagccctggacatggtggctccttatcggcttctttcttgggccatgtatatggcgtcagaactcagaagtcgattccgcaacaggaagaactcatccctctggttcctcttcccgcacacaaatttcccgtcgcccgggtgcaaaatcccatagctggcggggcaaaattcacacttcgtcttgtagccgtgcggtttactcttatctgttgatagagtaggaaaacagaagtcataaattaggatccttgttatgagagtaaaatcattagcagctgacatcagagagtcggcatagcagagagtgacataaattaggcaccaaaccaacacatgataaatgcagtttatgaaattcaataaatccgtaacatgagccgtgacttaccgatgatggtgcaggtcacaacggtcgcagagtcgtagtcgtcgtagcgtagctcggcgaagaactgcttgtcgggtgactcgggaggagccctgttgcgcttgttgcgggagcgtcgcttgcggcctcttttcacgtctgattcgtcatcatcggcagcagcagctgctgcttcatcggctggcttcaccgggctgctcctcctgcgagccaggaag

SEQ ID NO: 56685 - DNA, 3586 bp, Oryza sativa
ttgcaatgtattatggtgctaatacaatatatgcgtgattaagttgtttttaccgttatgtggtccaccgcagcggggccttcaggctgttctgctagagcctcagttgatgcacagttgctactcctctgcgtggggcttacttgtactatgggaccgggagtggcattggtcgacctatccctgatgcgtgcctccatccgagcctccatacctaacagctcggcagtgagctcttctctaagctcttctttaagctccacccgaagttgggccttaatgcgtacagctttctgcaccttggaaagcttgtgcttcttgtactgccacgcgtattggggaaacccaaacttccatggagcattggagccaatgccccttgttcgtccacggtgtttttcatttcccaacgctttcgtgaggatgtcatcctcgcgtttttgtgagcagacctcttaggaggcatgtctctcagcattcagttcgacctggggtacagttaggacgcgttagacgaagaatacgatacaacataatgaaacttattctatgtgttcaacttacgattttctggtacaccgcttgatctttgggatttgggaacgaaagaattccgtcactattcttcttcacccttgcccttgcctagttccttgcccgctagaccgggatatcagcaagcacttgcggggtgttagattccgctgcagcttcatcctccttgtcccattctgcctgtttccccgcgtagcctccggtgccaagccggtgcgggtgaagtttccttgcctgcagttcacggtaggcctggctttttgcccgagactctttcgttgatttggcggcatggaactcatcccacatagttcgggtgattgtaacgcctcgattttcgctcgggattaaaaatcattcaataatgcattttctagaaattaaataaaagttaaatcaatttaatcaagtgaaataatgggagaatttaaaattttcccttaaaaatcattggccgggaatattttgtaatattctttgtgccttcaaatactctccggatttttcccgtgaattttcggagctcaagaaataattttaaagtcacaaagttcatttaatcaatttaaataaaaagaaaaggaaataatcttccccttcctccctttcgggctcggcccaaattccccccccctctcttttggacccggccgccctccacttcccctctctcagcccgtcggcccagctcggctctctctctcccctccctcaagtctacactgcctccctagcccgtttcctcctcctctctcaggccgacaggtgggaccggtgggccccacctgtcatccccaacctccggccagctccaaccgtcggccacgccgcccactccccccgccgatcccgcgcctcccctcgtcccaaccggcgtggacccgagtccccttccacctcgcgaccacatcccgccccactccccctctctccccgcgggaatcgacgccacgccgagccgccacacccgccacgatgccgccccactccgtcgccggttgccgcctctcccgggctcgatcccgccttccctagcctataaaaagcatccccgtgctcccctcgtccgtttccccatttttcccgagcctggatactctccctcgctctccccacgccgcacccatgcgccgccacactccggcgaactccggtcgccgtttcccgcctccacagccgtagccgcgccgagccgccgccaccgccagcttcgccaccgcaaggagaagcccggccgcctcttatttccccctctccacccctcgagcaccaacttcaccaccaacccgagatcgccgccgtgtttgccgtctccatctgtgtcgccccgcctccccggtcgacgccggactgcgccgtttcctccctcggatcggcaactccgagccgcaccccggccaccacttcctcgccaccgggaaccgctgaaatcgccctctccgcgccccggtcgtcccggtcaccgtccgccgcctcgcgcctgtggtatgccgccggaccaccgttgcctccccgaggagcccgccaccggcttccctgttgtcgtctcgccgtcgccgcccttggtgagcatccctcctctcctccccgctccctgtcgccgccggtggccgtctggccggttcatcgccgccgcgctccgcgcccgcgccgctgccggttgtgctgggcagccggttgccacctccccttgccgcgttgcgccaccactccctggcgtgcgtcgccgctgcccgcgtgcgccgccgctccccgcgccgtcgccggccgtcgtcgccggtggccgcgctgccgcgcgccatcgcttggctgggccggcctgagccgtgccgtgccccagccgcgccgcctcgtggccgcccgatcggctttgggccgatccgggccgtcggttcccgtggaccggcgatggaccgcctcggtggtcccggtccacggtggaccggcgcccttgtgtcgctgaccggtggggcccgcttgccggcgccgcctctcccccttgatgacgtcagcatccccttctcctttggaagaataattattaattgtgtcataaatcgtatttaattctagaaattcatttaaatggctcaaaacttctaaaattcatatctaattcattggaactccgaattgagccgttcaacttgcaaaattcatctaaaattgagcttacatgtttgtttactttttatgtactgtttccttggtttttattagagtttttcctcgttttgtgtgccagcgtgtagaatccgtcgtttcggaagtccgcgatcgtgaggaaaagagttcggaagattgttttgaagaagcaaggcaagtcacacattccccttgagcatgttaatcccaatttataaatgttttaccgtttgcaaataaacatgcatgtcttgctaattacatgggattcgggtattacctatctgcttgcttgtgccatgtttacttgatatctgcctttgtcaaccttgggtaataaatcgactagctcatgttacttatgtgacctagctagaattgtatgcttagccatccttaattaccactaactcagttgatgggataattacagtattagacctttttagtatcagaatgagctgcgtgctcgagacatctggccatgcttcatggtcgtaattatccaactaaaatgcgactgaatggtgggctgtgggtgcatggtttttgtcgcgaccgggaaaattgccttttcccgaacgctagtgtatcaatccccgtcccaggaaaagccggggtacaccacacaaacatgatataaaagacacatctttattatatcgataatatttacattattacagaggcgcttcaggcctgacaatcaaaaataaacagcagcggactagcgggcctacggctccatcttcacaggcgctcaactggggtataagccaggactccacctaagacttattctccaaagcttctcttactgaaggggggagaaagatagagcaagaatgagtacaaccacagtactcagcgagcacaccggagatgc

SEQ ID NO: 56686 - DNA, 5638 bp, Oryza sativa
  unsure (1)..(5638): unsure at all n locations
tcctgcagccctaggtcatcttgcttacttaatgacaaggtgactgttgtgggggggcaattactatcaggggtcttccttgagcgatgcagagcatgtttctgtttatcaatcacctttcggcctacttctttcatgctagagaacatctttgccaatctcttttatcaatcatctttcggcttatctctaacaggtggtattctttaatgtggattgcggacgcttctggggacgatgaggtcctttggcttgctgcctttcggtgaaaccttgatgtggttcgtcaaaaagctgcactgactaccttccgggaaatacattgcttgctatttgtatctatgccactagggtttatttgccgatggtcatctttagtgcttcctcgagatggggagcatccatattgttcttctgccatatcacctttgacccttttctgatacctgatagactaattaccaaccatcgacattatgttctcaaatattgatttctcccttattacccgaatacaaggcactgccttaaacaaaaagggaaggtgcttatcatcggtacattgtatcctcaacatgaatcatccataaacatagcaagctcactgtttatagacatgaatatatntatttattacatgaatgctgcaaactttcgattacacaatgataagtagcgaactgaaaaccacaagcgtggctgctcattttgattctggagagatatagctggcgttgttctagtgactgcatcatccttgattggttccgtgatgatgtgttaggactgcatattgctatcattcacaggagaagcttccttctgattgctgtttgaagcggatgacggttttctgcttggtatcgccctcctgaggttgattgccctttgcttggcctggagtaggtcggggagagacacaacttcttccatctacgacaattctttgctgaggctgtcgatgcagagagtggttggtgctgaaggtattattgccatgatttattgcaaagttaggtggagcaagaggagcattggtgcggtggatgatatcatcgatgttgttgttggagctgactagctgatgagacaatcgtagagttgttcgttggatttctgcggtcttggtcaacaacacactaagttggcaatccttgggcacatggtttgttccttcacacagaaaacatgtcacctgcgggtgagacactcccctggtggatggtcttcttcacaatgagtgcagagtgtgagacacatgctagcacgtgtccaatttctccacaacgggtgcatgcctttgatccgaagaagacacatctgaaactcttagtccaaacaaatgtctcttgggttaatccgttgattttcttcgccatcaatcgctaggttatttgattcataatagattatgagtttacggaaatgagaccctaggtctccctaatcaacaacaaaatgtacacaactcacagcacttgcaatcttaacatggatccttcataaacttatcaaactccttcataatctcatgtttctctgtcattacatgattgacggggatcaactataaaacaaaagtatttgaacactgatataagagtattatggttgcttctgactagcgctaggcttaacaggtactgcatttgctccagtgaccacttggcgattggcatgtctgctcccttaacaggtactacagttgtaacagacaataactttctcacgctcaggttcttcatcttgtacttgattccttggctgctgtgctggaacatccaaaggtacaatgccgatactggcctctgtcttgtcaactgatggctggggctgaaattgagcattgacaccttgtggtaatgctctcgctggagttggagctgttgcaacgcgggctataggactgcttcgggatgcatggatgacaattcgctgaggagcaagcttctgagtgcagggagttacgtggactgacgtgccggcagctatgtttctcggttttgggcacttgtcggcgaaatgacccattccttgacaattgaagcaacagatatcttcccggactcggcattttcttttctcattttgattcctctgtcctggcactggagtcaggctgaaactgtaatcttggcgaggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgatttctctacaacgagagcatgccttatgttccattttattctggttgaaaccttggggagacttctcatcttcatcatctgaggagacttgatctgaatcttcactatcagacactctacctccattagctaaaagttgctctgtcaactgtggcgcacctcggaaggtatttcttctctgacgttttgtcattcctggtggaggccattctgtgctggtaatagtcatcttacgtacttcttcttcagttcgcatcggtgcctttctcttctgattcttactcttcctgcctttggcttgcttagtacgtgaccccacgtggtgcgaaaggctaggaggaaagcattttctaggattcaatggattgtctccattgggctcttcactttgcacactaggctgcaaacttgacttggtgcgaggaggctggtttagcgatgtctgccctgctaaaccaaaggaaggggcttctttgacatatacccatggacaattcagggcatagtgtccttgctctctacaatcgtgacaaaaggggacatcctcttctggcattggaagctcattgacctgggtggcaaacgctcgatcaaacacatactgattttggtcttgacttccaactaatggtagctgtgaactaagcagcatgcttggaatggaccaagggtgtgccctggttaactctcttgaggccagtggtggattgagttgaaaacttgagttacttgaggcatacccgctgacattctttcctttttctctgttaaacatctgttacaggggttgaggtgagagaggaaacaagccaggaaagaatagaccagaactagagacaggaccttaaaggaactaattcttcttgctgatgtgttgtttgtttcacttattctgcaagttgattaagcaaacaacctagcatggttacatcacaacccaccgatgcaaaccacgcgctacacacacaagcaaggaacacacgactaacaacactaccctatagggtggcttaggttttgcgacgggttctccaagatcttcactcctgcttcacagctggcttcactgtttccttcatttcactagcggatcctgcagtcttccggagcttcggcaaacaactgacgatgtcttcttcttcactgacctgaccatctagtactagttgaaatccgaagaaggaagaagggagtaaaccttttgcaaatagcgcaggggaaaggagaaaaaggaactttcgcaaatagttttatttataaaatatgtccttaggttttatccactcggcttatcctacagtcgagatggctctgataccatcttgtcgcgaccgggaaaattgccttttcccgaacgctagtgtatcaatccccgtcccaggaaaagccggggtacaccacacaaacatgatataaaagacacatctttattatatcgataatatttacattattacagaggcgcttcaggcctgacaatcaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggagatgcacaattaatgcaaaggagtacaaggggataataatataggggttaagttttgcagtaaacagcatttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccctcctagccatagacaagagtaccgacccaatcccacctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgaatattcccaaagtctaaaattataaaaccacctaatgttgtcctattaatcagcgaagcatctacctaaattcatactagtggaaccataaatagagtgtccactagttggggttttgtttattctagggtgaacaaggtaataataaccatagcaataataataaggtcataacaaaggtaaataggcatggctaaataaaacagtgataacgcgggaatttaaataaagcgataatgcattaatttaaattaaaaaaataattttgtaaactgggcttcaatatgctcaaggatgatgtgacttgccttgctcgctttcccagacgtcggcttcaacttccacgaagagcgaatcttccgaagctgcagcgtctacacgaccaacggaaaagaaaaggcttttactctaataaactccatataacagcagaaacaaagcacaaaaatgggttctttacttcttaaggaaaaattagagacttgaacggtccaattccgagttcaaatggccaagatatggccatttgaagtttatatgctctttaaatggatatttgcgaatttcttcatttaaattttaattaaaaatcgggtttattgcgtcagccgagagagagggcgcgcggaccgggtccacgggagtggggcccacgcggcagcccctcggtccacggtggaccgggtgcacgcggctggcgctggccggcgccgtgg

SEQ ID NO: 56687 - DNA, 1968 bp, Oryza sativa
aggaagtccggagcgacggcggcggcgaaccggagctcggcggcgacggcggagagagaggaggacggcgcgagcacgaatccgacgggagagcgagcggcgagtggcggaaacggaggagggaggcacggggaacaattatatagcgtcgggagagggagagagcggccggagagggaggaatcggccgcggagatctcggctccatcaatgacgccggtgaaacttgcgggattaaatccgaacgaatccgagggagagagagagggaaaagcgggggaaaacggagagggaatcacggggaatgattccccccactttattgcgcgcggggacggcgggatgcggcggaatcggcggcggcggcggcgctagggcacgggcgggcggcgggcgcggcgcgaggatagggatgacaggtgggccccacccgttagcgagggtggcgggcgggcccgcctgtcagcggcgcgcgcgcgggggaggaggccggtgggccgcgggggagaggagagagagggagggaattgggccgagccggcccaagagggaaaaaggggggaaaagaagacttttagggatttttctttttataaaaccttttcaactttgtttatttcttctcaattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagggaatgatttttatttcgggatgaatttatcaggacgtgacagttttgctagtcgcacccatggcaattaaggaccggttcgcgggatgccctggaagaacttatcgtacttaccacaagccagcgtgggcaacggcagggcttgtagtgtagctttcctttagctgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccgatatgtcgtggtggcatgtcggcgcacggaaatgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatgcactgtagttcaggtgggttggttgggcctgttcaacgtggtgtagcgttgatcagtggagattcaatattactttaattacttaattgttttactgttttgctcaataaaatgttttacaactgcctttatgcaaatagccacaaacccctccttgtatccgcttgcacgtctgcatcattggtgtggcttgctgagtacggtggttgtactcagccttgctattattcccccttttcagaagtgtagtgtttctgagttgaagacgaagttagaagaccaaggctcagaccccagttgagttttgcctgtggagtggagctgaagccccactaggattgcctttttccgctgctgctactttcgtttcggtgtgaggactaagtgcctcttctgtaagtattttacgctttatttaagtttggaactgtatattacttgtcgttttgtgtaccctggctggtcctggacagggatttagtacacagaatagtctggaaatttgggctaaatttctgggcatgacagtgatgaatgggtatttcccaaatggttctggctgggcggggttgaggacgtactccgtgaccagcgttgtcttgaaatttttccaacaattctccatcttgcggatagctgctggggctgcag

SEQ ID NO: 56688 - DNA, 1271 bp, Oryza sativa
aactaataatttatatattacttgtgataatcatattctaagcaggggttaagataatccaagggtagagtgacacacaagcattactactcatcctcataataatttatctaagctaggtggaaagaagagaaaagaaacctattcatatacttctagtatacatattatacatacattctagttagctgatatactagctaataccctctatccaatgccctcctggtacttcgagaagccacccctgactgccgagttccttacgacagcccgtcatgaccatccaaccagggctaaatacggaggaataccctccccaagaaattaacttaggattatatataggcgcggaggaatacctgtactgagctgtcaccatcagcggcccacctctcatccgtaatatataaccccaaataatgatatcccgtaatctagacactacgcctaaactaccagataatactctaatatcatcgtcatgacatagagtaattgcataagcaaacactatacccgtaccaaagcatctcccagataagctagcagcataatcagtataacatgaacataatgtaaagttggtattcatatactcgaaaagtattccaataccataaatttatatagaagaatattctaataaaagtacaaagcttacaaaagaggaaaggaaagctgctagagccatacccgaactcttccaaaggcttccggactcctgattcctattctaattctattccaccagctagatactactaaactaaacttgagaggaatgagagagctcttgctttaggtgtgtgagtgaagtgagaaggtgaagtccttttatagctgaactatgacggttgtgacggttggaatggtcggtaataccctccaaccgtcattggggcttcatctcaaccgtctagccaaaacctggatccaacagaggcgagggaggttcggccgaaccaccaagttgaagttcccaaaattaaaagaggataaacgatattaaaactcccctaactcgaaaagagggaataaaatacattgaaatttcccgacaaaattccctaaattcgaagaaccctaatttagggtaagaaccataagagttaaaatccaaatcaattaaactatgggttcgggttacttaacagacttgaagcccctaagctcaccagagcttcccgggaagcggcaccaccgcaccttcacctcctcacagtcacattgggttccctgtgcgcgcgctgtcctggagcacccctcca

SEQ ID NO: 56689 - DNA, 854 bp, Oryza sativa
atatatatatatatatatatatatatatatatatatgtatatatgtatatatatatatatatatatatatatatatatatatgtatatatgtatatatatatatgtatatatatatatgtatgtatgtatatatgtatgtatgtatgtatgtatgccagtgcatagacttgtgaggtgggtatgatttactacgtgaacttgtaaatcgtttattttggtgtataaacttgtctagtatgtgtaaatcaaagccaaaacatgtggtaactaattacactatgttggacgttgaataggatgttatattggcttacatgtcaagatgatattattgaatcaaatatataataagtcctgttaattataaaattaaaaatatatatagagggagtatataatggatagaaaataatagaacaaaataactacagtatgcataatggttgattttttactcatacgacatatctcatatcctcatgtgtgagtgacatataatcatactaagtcaacatgactggtcacaatataccgtttcggactaggtcgaatgcactagacaagttcgtgcaacataataagcattttacaaatttatatactaagctacgtctatgtgataagtttgtataccaccaacacagcatacttttttagatttgtatttatatatgtttgtgaggaagttacgaaaatatacgcggctcacagcacggcgatgcgggatagctgagccgcgtatattttcgtaatatacaggaccaacgacagagacggtcctgcgcccttgtacggcagcaccgcatcggcctgcgcaatgcagcatcagggcaagtaccataataccacatat

SEQ ID NO: 56690 - DNA, 2637 bp, Oryza sativa
aatgctgcgcgccgggcgcccgatggcagaggaaaaatcggacgcctcgggctttctttcgctatttgctgaaacattatttttatataaggtgaaacaacacccgatttaaacgagtgaaacatttttgatctatttagtgaaacaattccgatatacctggtggaacatcgtgcaacatttaaaaataattcaataataagctaaaaaaatttcgtcggaatatatccatgtgtggttttgttttaaagatttaattgcaacgaatttaatgatgcaatcgaatcatgatttggataaataatttaagagaaaaatcagtttaaaatagtttttacacgtaaatcgggcgctgacgtcagcgtccgatttttcaccaaacatcggacgtccgaactggagttgcctcctttagttgtggttgcctgggaagtctttcaaggataacgggcggcagtactaaggctcttcacagtgcaatgagctggccagttgcttcacaactccacgcaggatggttgatggcgtggaggagagagggtgtgggccagagttccttcacatggttgctcggttccttggtgagcaacgagttcctcatcaaaaatggcttaaaaaatgcctgcaaaaaggactgagcatgcacaaaaccatcgggagacggaggggagaagaaaagcgaactgcaaagcgattccgtggtggggccggcctgaaaaaaattgagggtgggttacgcgtgcgtgcactgtggagagaggagcttcaaccacttttcctgggtttctttcatacgtggacatttgggttgcttgcccaggctcaccgcactgctactgccctaatgataatgcttgtcgcccgcgcgcgcccttggcccacgtgctacctgttggcccacccacttcttcctctctttttccacaaagatgttttatctagtgtacttataatgtttcactatttatagatctaatattgtagtgaattaaaatactcttttgcaaaaaaaaaacccacatattttggaaactctctattaagaaaatttggtttatttatgtatagatctaatgttgcagtgaacgaaatattcgattgcaacaaaaaacccacatattttggaaaccccctattaaggtaatttggtttattttttattccaccaaaaaatgttttacctagtgtaatcacaatgtttcactatgtataaatctaatgttacagtgaactgaaacattctttcgctatttgctgaaacattatttttatataaggtgaaacaacacccgatttaaacgagtgaaacattttcgatctacttaatgagacaattccgatatatctggtggaacattgtgcaacatttaaaaaaaatttaataataagctatttttttcgtcggaatatatccatgtgtggtcttgttttgaagatttaattgcaacgaatttaatagtgcaatcggattatgatttggataagtaatttaagagaaaaatcggtttaaagtagtcttgcacgtaaatcgggtgctgacgtcgagctgacgtcagcgcccgatttctcagccccggatcggccgcccgatccgtaggcgctccccagtactaatggtgtggcaactgatggcttggacgaaattccgcgtttaaacatgagaattgaatcgctgtgagatactaacctgcttccagcagtcccgagattgcaagttaggccctgtttaaacatgagatacgaatggtgtggcaaccgatggcttggacgaaattctgcgtttaaacatgagaattgaacagctgtgagatactaacctgcttccagcagtcccgagatctcaccttaaattttttttcgccatatcacatcgaacatttgaatacctgcataaatataggttaaaaaataattaattgcgaaagggcctgtagcctagtggttacaagagcctcagtagcacctgaggtcctgggttcgactccccataggagcgaattttccaggatttaacggcgctgtgctttcagtggtaggcgacgtacccgtcgacaacgaggcgcttatggtgacttcgtcagactccccataggagcgaattttccaggatttaacggcgctgtgctttcagtggtaggcgacgtacccgtcgacaacgaggcgcttatggtgacttcgtcaatctctccagaatttaccggcccagtcttcgaagatgctcagagggatagggtttgcgtgcgtgtgttcataggggtgagtgcgcgtgcgttgtaagtgtctgcgttgtactgtgtaattttcaaaaaaaaaagtttgcgtgcgtgtgttcatagaggcgtgcgtgtattcataggggtgagtgcgcgtgcgttgtgagtgtctacgttgtactgtgtaatttttttaaaaaaaaataattaattgcacatattgcgactaatttacgagacgaatcttttaaacctaattgtttcatgattttacaatgtggtgctacagtaaatatgtgctaatgatggattaattaggtttaataaattcgtctcccggtttgattctgtaattgggttttctgttagtgtccaagcacctcttacgacacgttatataatatccgatgtgacgcgctaaaac

SEQ ID NO: 56691 - DNA, 2540 bp, Oryza sativa
taacgtgtaatcgtccataagaggccgaatttaatccttaaaaactcatcagatttacccttaaaagtggcatctaacttatttttaaaaacaatcatagatgaatctattgtagatgctatttgttgttgggtagattgtattacctcatcattacttaccaagtcgggagcgagcttaggaagtggctcgggcttaatgatcacgccttgacgagtcatagtgcacgccctcatcaacgcttcctgtgtcatctccttgatgtactcctccatggacttgcggtcttctccttcgaaatcatccaatgagatcggcatgatctcattcccgctcatcatggttgatgaagaaattccttgattaatttcggccatatagctcatagctgaaatatttgaccgaataaattaatatacggtcttcttagaaaacagccgaaacaaatgaatcagctttaatatttctttttcttaaaaatacgtgagcggtagtaaatcggctttgttagcctgatttttcttttttaaataacttcactcggtttctgtacacaacaaagaatatacagaaaccaatactactgttgctggctctagatagactgatagatcggctttgtacagcctgatcgttttcttttcagaacgcgttagatttctgattttttttttcagaccgtgtacaggaaggatactgccggtcgcttgttgctgtttccacacgtggataaagatagattccggctgtatagccgaaacactcgattagacgggaaatcgatgaatcgatggcagcagttagcttgatgaccgaacagtgtcgccgccaaatagattgatccgatcaaaaatacgtagcggcagtgacggattttgtatagattgatttcggctgtttggccgaaattcttgactcgacgaaacgaaaaggtgactagtttaaacggaattcggccgtgatatggccgattagatcgtttcccagcggagtcgccaaaaatcgtgttggcaacttttttgacaagttgacaagcacgatcgcagcaccttaagccttgcggtgatcctagagtcgccaaccacctcgatctagcaaagagctaaacctagatgggttttgataactaaaccggctagcggagccgatttctagataactacccgtctcgtgagcaaaacggaaggttttcaggacaaacctacaaagatgtgtcgcactctcgcagcggcggcggacggtttacggcgcaaaccgacaaagatggacaaactaagagaaaactaaaagcaatatgaaaaacgattcgattgattgattgtagattggtttttacaatgaaccggccatgtcccttatataggggttggtcttgccctctacaggccatcctccacgtccaactcgggatagaaaccaaaggaaaccagaaacatgccttcccgagtaaggaaatctcgagacccgacgaaacacagtcggactcggacctgccggtcagaccggccacacaccgccggtctgaccgaccctcaaccggcggtctaaccgcccaacacacggcggttagaccggcccactcggaggaaaccggtagacttccaaattttggcaatctttcctattttaatcctaggtgacaaatttgggtgtaaacacatgcctccctgcctttttgatgaacaacgtgaatctaaaagcatacaccatgtttttggtcttaggaccataacccaattaccggccatattacctcctaagcgtcttgccaaacactcatgaagtatttcttcaagtatttcccgttgattgctcacttaaaacgctccccttgaagtgtctcaaaaaagtatgcgttccctcgacgggtcccgcacactcgataaagaccctcccaactaggagaccacttaccgaactcctgggatcgagtacccaaagcaaaattgtcttccaaaccaagtctctaacctgaaacaactttgctttcatcctcttgttgtataccttggccacccttttcttctctttctctatctcttcgaatgccttcaagcgcctgtcgatgacttcatcaaggttatctcccatcaacgtcttgtaatcttcactggacaaatcatcttgcttgatataacgaagagaaccaagatttacctcctccggtaaaacggcttcttgaccataaaccaactcaaaaggagtgactttagtagcactatgtttagatatcctatgcacccacaatgcttcggaaagcacctcatgccactttgggtattcctcaatctttttcttcactaacttcaacaacgtcttattactcgactcggcctgtccattagcctgagcatagtaaggagaagaactcaacaatttaataccataagattcggtaaaactcttcacttccttagacataaaagaagcaccttgatccgtagttaatgtttgcggaatactgaatctatgaataatatgtttcaaaataaagtcaattacctccgtatgagtcatattattcaaaggcacagcttcgg

SEQ ID NO: 56692 - DNA, 1651 bp, Oryza sativa
cccagagagtgtccgagtcactgaccaacctgctgaacttcatggaatctctctcgttcatagttgggtcatcaacgtcacgtaacatgtcttgcagcatatcagggtccacatcaaccatttcaccgcccaatggagatgggacaaacatgtcatgctcttcttcatctccttcttcgtgattgtctgcaccacttctgtctgcagttgcaccatcagtacccagatcttgctctccatgcttcacccaacatgtgtgtctctccatgaatccccggcgtatcaagtgagcgtgtacttccttttcatcgtccaacaaaatatcattcctgcaatcgttacatggacaacacatgtacttgtcgtttcttcttatcctatcttcctctgcggctttcataaaacttaatacgccatctctatactccttgtactgacgcctcaagtcagtcgtgtacatccaacttcgatccatcgctgaacaatgaacaaaatattagttaacatctcatgacataagtactactaaattaataggaaatgattagtacccttttgtttacacccaaatttggcacctaggattaaaataggaaagattgccaaaatttggaagtcaaccggtttcctccgagtgggccggtctgaccgccgtgtgttgggcggtcagaccgccggttgagggtcggccaaaccggcggtgtgtagccggtctgaccggcaggtccgagtccgattgtgtttcgtcgggtctcgagatttccttactcgggaaggcatgtttctggtttcctttggtttctatcccgagttggacgtggaggatggcctgtagagggcaagaccaacccctatataagggacatggccggttcattgtaaaaaccaatctacaatcaatcaatcgaatcgtttttcatattgcttttagttttctcttagtttgtccatctttatcgatttgcgccgtaaaccgtccgccgccgctgcgagagtgcgacacctctttgtaggtttgtcctgaaaaccttcgttttgcccacgagacgggtagttatctaaaatcgctccgctagccggtttagttatcaaaacccatctaggtttagctctttgctagatcgaggtggttggcgactttaggatcaccgcaaggcttaaggtgcttcgatcgtgcttgtcaacttgtcaaaaaaaagttgccaacacgttttacttacttttatgattttcctatttttgtttgcaaaaaaattacaaaaattcgcctccttcaacctcccaccaaaatagtgaacagtgggataactacagacaacggactgctggagtatatatagtgtgcaaagtatatctcaatcgggcaaaaaaaatgtcatctctaacgggcgcacactaatctctaacgggcagaaatagaagcccgtcacagatgagagtcatcggtgacgggctataggaatatgcaccccgacgagtacattacaacggcaaaaatttaggcccaattgagatgacttcgttctgacggcccacgttgcccaggcatgtaatgggccgtacagatgagaggatctgtgtgtaaacctaccgccaacaaatactagccatatactacataattcttttggtttcttttattttcaaaaca

SEQ ID NO: 56693 - DNA, 1617 bp, Oryza sativa
gagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacgactgtcgttgaggaggtaccggttcaggcggagacagcttcggaaggattttccggaaccgcgagcggaagtgttttgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaactatgctaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgttgtcaccctagataatgcatctgctaattctagagctattgaaatattgcaacatttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaa

SEQ ID NO: 56694 - DNA, 1543 bp, Oryza sativa
cctgcagcccatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttctttttttttttaacattagcaaatcattacttttttaaaaaacttttatttccattttttaaataccattttttcattttttaacattagtaaatcattacttttttttaaacattttatttccatttttaatttttttttccttatacatttcctttgcttttttttttttaaaaaaacactgtgcacagtgcactgcaggctggcggcctgccttcacgggccgccgtgccccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggacacctataggctaaaccagtccacaaggagcctaatagagccccatagcccatccatcgtcgtggcgaccagcaaggctgccctatctttgctccgcttccaccgttccacttcatggcaaggcaagcgccgcggcggcgcacgtcgtcggagggcagagcgaggaggcgcacggatcggcacccgtagtgggagcattgtgggtacaggtatccgagggttttctaaatctcatataatcctcgagttgttactgattaggatctgcaggttgggattgggatttagggatggaaccatctctggttgcgatattccttgcttctcagtgaaaagtgtggattagtagtattgttccatgaaatctgacattagatgtgtagattatgatttatgtgcttataaatcgccatgataagctgtgcataaacagaatcacctagcttagaaccttcacaatcctaaccagccaaactgtaaaaaccgtttaccaaaatggtgactccaaaatcaaggttagtgcgtagtgcacaccatccacatccatatgttgcaatacagaatagtagtttctcgcatctcccggatatacggagggccaatttatcatgttttatgcacatcgcattcaaagcctacaagagcacaaaattacacaacttccatcacacactgtaactctttcctgcaaagcaaatcctcccgcttggtcgcttcagcataggatgttctaattgcaagcaacttgatagctatttctctcatgttcattcgttcttttgggatcagaggagtgcaggaaagagccacttgcactacagacaacaagcatacatagaaacaattttctttcttggtcactgcttgattgaagcccttgtattcttcttggagtcgagcatcaattatctgtggtatctgctctgggaagttcttctccacaaagttg

SEQ ID NO: 56695 - DNA, 3721 bp, Oryza sativa
cctgcagcccagacaggttgtttcctcccaaaattagaatctcaagatttgttggtaggttaccaatcgaatctggtatgactccatgtagctgatttctggctaatgacagtatttctagagtagtgcagtttcccaaagcattcaagaatgaccagctttcactgtcttttgctctaagtttgtttgcctggaggtccaatttatggatctttggaagctctccaaaggaggtaggaatcaggcctgtgaaattattaaactgaaaaactatttcttctagcattgaagcattgcctaaggaagctgggatataaccttcaagcatgttatggctcatgtagagtattttcagattagtgaaatgatcacccatgttatttggtagagtcccaccaaactgatttccgctcaactctagagcttgaagagaggacaaattaaaaaggcttgctggtataccacctgatagcatattatcccctagccccagcactgttatattggaaaattggctaagttcatcaggaatgtttcctccaagttgattcagctcaagatagacctggtctaaataggtaatgttacccagagattgagggatggcaccagttagattgttgttgttaagggccaaaaaaactagattgatgaggatacctatttgcctgggaatctcacctcgcagggagttatgatagagatgtaattccttcaggttggaacaattagtgagcgtatctgggataattccacctaacgaattgtagctcagattaaggacttgcatcttctggagattgctaagatcaggcatctggccggagaagttattacttgacagatcaagagtacgaacaaaagtcaggtttccgagtgaggcggggattgtgcctgacaagccttggccggcgaggttgagtgctgtgactcgcccggggtgcttcatcgtgcatctgacgccgttccactggcaatggggagctctcgtgtcccagttgctcagggctccagccggatcgttaattgcttttctgaaagtgagcaacgagagcatatctgtgctgttctcaggaacagttgagcaacggatgccaccaactccgtggagaagtagcaggagctcaagtacaaaaagcatgctgtgttaatttcacagttcgctgcttagctgcaacaatgaaagcataactcagtacatgtcaaccggaaggaagaatgcagtagatcagccgtatgactcccgtgcattttcttgagcgagcatgattcgttaaagttgattccatctacttatcacctccagaagtccagagtcctatagtatgttcatattgagaaaattgatacccataattaagccacacgaagtgcgtaggaaatattaccgaagagaagaaattaggtagtaacttgtagttggaggctggagcggaacaacacgctgttactgcctggaaacgagtgtgagttgagtgtggttggctcaggccccgtggcgcccagaggtttaagaacagttgtgccgcggatttacaaccacacgcttaatttcgttctacaattccttgtccggtaccatcatatacgttgccgtcgcctgaccgcaatacagaacaggccaaagctgacgactttggctttacaagaccaagcttcgttggtcgtaaattagactcatcagccgcatcccttctttgtagctgcaccccccccccatcccccacgcacccgctttatttttcctttcttattgtaatctcttagcctcttgggctattgaacagtttttccctctattttaatacaaatacaccctgcagggtttaaaaaaaaaagctccggagcgacaaagctacaggagtttggaattttgggagatatcacctagtgcttttttccgtttgcaggttggcttttggctgaccctgtacatattttctcttgtttttctgctcctctattaatataccaggcaaagcttttgccctcctttaaagaaaaaaaagcttcgttggtcgtgaactcgtgatctactccctctagacgccgttgccgtccgagcaatcgtattcctgtgtagactctgcattttgttccatcacgttgatgtggagctcgaagatgcaaataattcttctttttttttagaactaagatgcaaataattcgcatagacatttgggtcgccgtcactaggccaaccagaggacacgaacgggcccaacaaaacgggctatgaatggagggaggcatgtggcccattgaaaggccacaggcccataatgtcacggtctgctacgcatcgctaccagttcgccacgaagaaactggggctttcttctccagtcctccggttcctccgcagtgcacgcccgaagggcgcaggagcggaggcgcaaaccgtcgccggagggcggacggtgagacgtcgcccgcgaccgaccagccgccgcccgaaggtattccgtggttcctagatctcatcagtctttactcgtggggcagtcagggtcgtcctggatgggaggcgggtaatcttttaccctggggcagctgcttgcggggttaatgttgtatttgtaaacctgtaacctgaactatcttctaaatcttaataaacttcgaccggctttgcgccggtccggcaaaaaagagatctcatcagtctttactcactcgtgattagccgctgcagattctgaatttgaattaggaaattgattttagtttggttaaaattgtgctagggagtttatgtagaatagtggtaatgttccatccatgttagttggtatatggattaagatctttgttcatctccatggctacttgtacacctactattatggccacaccattacaccacccatctgagatacttatgtacttttatgaaatccttgatgatacatcaaatccaaatccatgatgtttaattcatgatagcagaaaaaatatttttcctcgcattaaagatatcaggttcatgcaaaaatcatcatctttgtgcatttatcgacaaacctggctgttacacacgcttcatggcacgctataaatcactttagcgaaccatgactagctctcttgcctaattgcatcgacatatgaagtttgaatcgcatgcaatctaatggctacttctctcatgttcatacgttttgttgggatccaacacgtacaagaaagggctaattgtgcaagagaaaccaagcattggtatgttgcattttctgttttagttgttgcgtgaatgaatcccttgcattcttcctggagatgaacatcaatgatatgtaatatatgatctggaaagttcctctccacaaaattggtaatggtcagctcattctcgaacatagagtctgttggtcttttgcctattagcatctccataagtactaccccaaaactataaacatcaccgctggttgatgcacggacactttgagcatactctgacaaaagggattaaatggtacttattagtgcaatttgaatctttatatagcaccatatgtggcaatgaaatttacctagagctatgtatcccatggttcccttcacaacaattgaactgttacaaccagaattcccatctgatgtcaatgaagaatcaagaacaagacttgcaatgccgaagtcccccaaatgggcactcatatcctcatctagaaggatattcgtgggcttcacatcacaatggacaataggcctt

SEQ ID NO: 56696 - DNA, 7378 bp, Oryza sativa
aatgatatgtaatatatgatctggaaagttcctctccacaaatttggtaatggtcagctcattctcgaacatagagtctgttggtcttttgcctattagcatctccataagtactacccaaaactataaacatcaccgctggttgatgcacggacactttgagcatactctgacaaaagggattaaatggtacttaactacttattagtgcaatttgaatctttatatagcaccatatgtagcaatgaaatttacctggagctatgtatcccatggttcccttcacagcaattgaactgttacaactagaattcccatctgatgtcaatgaagaatcaagaacaagacttgcaatgccgaagtcccccaaatgggcactcatatcctcatctagaaggatattcgtgggcttcacatcacaatggacaataggccttccacagtcatggtgtaaatagaccaaagcatcagctatgttgacagctatgcttactctttgatccatggacaaatgtttgcgaactacaccagcatgtccatgatgcaaccatttgtccaaattaccgttatgcataaactcataaattagagctttgaaatctttacctccattgtctatcgtggagcatgcagttagtacaggaagaaggttccggtgccgaatggttcttaaaacctcacattctgatacaaaacttccgtttgcacgcctcatctcaagattaaaaaccttaatagccacttctattttggcttgacttaacttccctttatatactgaaccatagcttcctcttccaattaggttcaactcagagaagtttcctgtagcttgagctagatcgctataagaaactttagggaattgcttaccaaaagaaaacataaataagtagcttcttgatgtcttctttccaagagttataacataaatcaacatggtgagggacatgaagccaaatattggaatcaataatctcacgatattaggcttcctttctattttctgtgaaattgaagcgcacaaaggcatatggaaatccactgctcctccacaaagcctccagttgccatcaagtgaaacagctgtaacattttcaaatattccatttcttggtatttctccatggagatgattgtgtgaaagctctagcttactgaggagctgtaggccactcaaagcagttggtatggtccctgacaaactgttataggaaagatttagtacgttcaagctttttagattgccaaaatatactggaatgtctccagtgagaatgttttggcccaattggataactaccaagttttggctttgccccagagcattaggaatttccccagaaaacttgtttgatgaaagatgtagttcgaccagttcttgaagattaccaacctcttcaggtatgctaccttggaggttattgtagctcaggttcaatattgagagttgcgaaagatgtccaatgttgggtggaatgatgccttcgaatttattattttgcagcgagagcattgtcaactgagtaaggtttccgatggagggagtaattggtccgatcaagttgttctcacggagaaatagaccttgtagatttttcagatttccaatccattctccaatttcaccactgaaattatttttaccgagggatagtctgattaagttaggaaagttgccaatacttggggggactacccctgatatgttatttaccgaaaatattaaattttgaagattgattgatagattacctaccgaatgtggtagggatccctgcagattattttcagctactgagagcgttgttagagcagtgcagtttgtcaatgaatgcaagaattcccatccttggtttccatttgcttcaagcttgttgtacgcaaggtttagtctagacaactctgaaagccttccaaaagacgtaggaatttgcccagtgaaataattcgatgacaaatctatataccacagtcctgaagcattgcctagcgaagttggaatctgaccttcaaaattgttataatccaaggtggcctgttggagcctagggaaggcatcgccaaagttctttggcaatgccttgcctagcatattcaactccaaacttagcaactcgatacgggacaggtttaggtcgatgggatttcacctgatagcgtgttattacctataagaagaatagatagatttggcaattgccaaatcctgttaggaatgctgccctctaaataattgtttataagcctgataaagtttaagtgggtgaggttttgaacagatgctgggatgatcccagtgatattgttagctgcaaggtccaagtattctagcttggtaagggagcctatattaggaggaattacaccatgcagcaaattaccagagatgtctaatgcccttaggttggaacaatttatgagttcattgggtatagccccctctagtgcgttgatactcaagttaagggtgtccagttgctttagatggttaaggagaggaacctggccaaagaagcgatttgaggacaagtcaaggatactaagagatgtgaggtttgcaagagaggaggtgattttgcctgccaagcttctgtcggtgagattcagacctgagacgcgccatggccgtgtagtagtgcagatgacgccattccaccggcagaagtgggtgctagtgttccaaaaaaccaagactccttctggatcttcaagtgatacccttcttgaaatctatcagcgattgtagatctgtgttgtaatcgcggacagttgagcaatggacgacgacattgttgccaactccataacatagcagcagcaacaccagttgtatgaacacggcgagtttcgtgggttgctcttgctcggaacacatatcacctgcaaaacagtaagaatgaacagggatattatgtccattttcataagatgaacatcgctgagccagtgctgcagtgcatagggcatactaccaatgaagaatcgaagataaccggtactcagctcgaacaacgcgtggccaggttttggctaagatgaataccaccggcttgggcagttgggcccctggacaatggccttaaaaacacaagtcttcagcagtgtcacacatctagcgccttgctctgctctgccgtgtcttgaccgctcctactgatcagaatcgaagatgcctactcctccggtattactcggattttccatctccagtagcagtagaccagtattccgtccgctttccaaaattttactacacgcgatgcggagtgtcagccactcagccgtggcactccactgccgactgtcttcactcttcaggcgctgcccgcggttcactcaggaaaactggactttttcctagagaatttcagcatgcggcctgttgtatcttacggcccgtgcccggccgacgaacggcgactaagaatgggccagattaacgacaaaacggcccagaaaatcagaattaaatcaagggagcaacgctgcagcatcgcccagcccagaaggacactgcctaccttcatcgacggctttgcctgaccaagctccgccgccgaccaccgcactcgatctaggtttgcaggctgtgacgcgcgcggtcgccccgtcgccagatggcggagcgtgaggcctggactcctagatctcatttgtgatagccgatgcgtatctgcagtttgggatttggatcaggaacctggtctttgttcggttgaaattgtgctaaggtttttatccatgaaacttgacgcctggatggatggatcaggattatgatatttgtttagccccacgacagtttgtccaaaacaaattgcctatacttgaaacgatccttaacgagccattagtatagaacttttggattctgaatggggcaccagggagagcttagtagcttatgcaatcatagccagatgtagcagtaaaatagcggcgcaatttatctctctcaacgtgagagaattaccatgtttatgcctatgcctacgatactggctcagatcatggtatcactgcggtgattggtgaaacctggctagcttgcattcggttggccgttacatcatatgacattttaatcgcatgtaacctgttagctacttctttcatgttcattcgttcccttgggcataggcgtgtacaagaaaaagcaacttgcaggagggacagcaagcatgcatggataaacgccattttcttctactgctgttgcttcaataaatcccttgcactcttcttggagatgaacatcaattacgtgtgctaatcttatccggaaggttcctctcagacaaaattgagagtgttcagtccattgttaaacacgggatccgaaggtcttttgccgggcactatttctagaaatactattccgaaactgtagacatccccactaattgagcgaaaaaacgaaaaaaaaagaacgaaaattgatgttttacactttgagtacaatgtaaaagctcactttttagagtaaacaatagattgctttacatgatttcaagatgtgggaataacggagcaatatatccaaatagttcccttcaatccgattgaattgttaaaacttgaatctaaacctgaatggcaagccgatgtttatgtactagaatttttttctcgaaccacatggtcccgaattcccaattagtgaaacactgtagcactactgaatacacaagggtattactcctcggaatttattgtaagacatatctagtttagtgaggttcaaatcatttggagaaattgaaggggcctgacaaattgttatgggaaaactccttagaagatggtcggaatgtttcctatagaactgaaattagcaagggaccagacatattggtccatttgaatgatcagtaactactgagtactgacattggcccaaggtttaaggaatttccccactaaatttgtttgacgaaaggtctagtcgtgagagttgtttaagattaccaaactcaaaaggtatgctcccttggagattgttatagctaaggtttagtatcagcaagttttgaagacctccccagctaggtggtacagaaccagttaagtcatttttcgcaatagacaaaaacaccaattgtgtaagattgcaaatggagggtggaattgtcccgacaaagttgttcatttggagatttaagcgttgtagcttggtgagttttccgatccattcttcaattgtaccggtaagattactttcgtctagcgagagttgaattaaatcatgaagttttcctatgcttggaggaacaattcccgatagcttgtttccacccatcagtacatattgaagatttacagaaaagttaccaatcgaatttggtatgactccctgtagctgattattagataatgaaaacccattgagagaagtacaatttgccaatgcatggaagaattcccagctttcgctgtcatttgcttcaagcttgttattctcaaggtttagataggacacacttgaaagcttcccaaaagagcttgggacatggccacttaaatgattgagccttagatccaattctgttacttctgaagcatgccctattgaatatgggatgttacctttgaacatgttgtttcctaagtataggagttggatgtttggtagggcgtcgccgatgttagatggcaatgtgctgcctaacatattggacgtcaaggataacatcgtaagagaagacttgttagggagactttgtgggagttcacctgacagattattttggtttaggtacaacaccccgatgttttgcaactgccaaaactcgttaggaatgcgaccgttgagttgattttctgaaagatcgacatactgtaaactggcaatttttccgagggcttccgggatgatcccagcgagattgttctgggaaaggtccaaaccaagtagcatggaaagattccatatggtaggaggaatcctacccgttagattgttgctagagaggactaaggcggtcaggctggagcaatttgcaagtccatctggaataattccgttcaaactgttttgactcagattaaggacttctaggtgttgaagatcatttagaagaggtatgggaccataaaagttattatcacggagaagaagctttcgtaggaacgttaagtttccaagagaagatgagatctggcctgatagactttttctagtgaggttgagccccgtgacgcgccaaggcctcgcctggctgcagttgacaccgttccaactacagaagtggatgctggcgttccaattgctcaaggctccatttggatcgctggtgatgccctgcttgaacccgagcagcgcctgcagatcgacgctgtaatcatcatggttaggtaggcacctgacgttgccaaatccgcaagtcagtagcagcaatgccaacagtacaaccatgttgctttgcacacatgaagctttcgtcacctgcaaaagataaaaggcatatatgtataatcgttcaagtagattagcagaccttattatgtataataaggtccgaggaacttattgtctcctctgcagctgaccataatcgattgaacgatcatacggttcacatcgaccttatcttttttcttttgaatggtcagccgttgccgacgttttatataaagaagaaggtgtcctattttaaagagaaaatgggaccaaacctggtagtgcacagttcattaaggaaaagtgggcaaaaaccacaactactcatatgtaagcaggatatgcgcctaccctaagtaatcttgcaacaagaaataagagaaacggcatgtatgaaatactaactgacaagagattagcagacctcttcctcgttctgacatgtcaaaatttcctcggacctgttctgctagaccttaatacagttgtacttggctcaggcaccagcgccatggggttgggtttaaaagagttgtatttcactgtcacgtccgcaagatattattctgttcatcatgcatgctttgccgtagcttgaccgcttttacagatgtgacactcgacttcatcagaatagtaaacgatttctcccaagcactttgtcctcgtgctggtgttgctatctagtaacaagatttacgaacaaggctccgtcgtttcgtttattcgatatttacaaataaaaaataatttttgaataaaacttttatatacgagcaaaggctgaaaaataaactttaatgaaaaaacccccaaaatcaacttcaaatttaaggttggaaattcaaattttggctgataagcataagtataagtataagcgaaaagataaaaccgatatttactatctagccagggacaaaaacgtccgcaaaaaatatttaaatgaaaaatgctttacaaatgcaagaaaca

SEQ ID NO: 56697 - DNA, 1215 bp, Oryza sativa
ttttgactcaaggatactatttggagatgaaggaaggcatcatcaaaggttgtgtttggttaggcttttcaacctgcttttgcttttgcaaaagccaaaagccaactaaagggcccaaaagccacatctatttttgcctaaagccagtttttggtgtagtacaaatcaaaaacatccctaattaaggtccggcagtaatagttgttggaaccttcatattcattccttccaaagagaagcactacaacttgattttaagattgccaatagaagatggaatttgtttaatatgtagtgaaactgttatcttcgagcaatagccactctagttttgctagccttccaacccatccttcaattgtaccacttaaactgttggtatctagtgcaagtgtagttaagcctttaagtctccctatgcttgggggaactattcctgataactcattaccacctagatataactgttgaagatcggttgataagttaccaattgaacttggaatagatccttgtagctgattcgcagctagtgagagaacttgtagaagactacaatttgttaatgcgtgaaaaaattcccagctttgatggctgttactagcttcaagctggttttcctcgagatttagatgatacagattacgaagcttaccgaaagaactaggaatttctccattaaaattgttgttttctaggtctagtctttccaaccctgagatatttcctacggaagctgggatgtaactttcaaacatgttatgatttaacataagccattggagattggggagggcatctccaatattcggtggcagtgtagtaccaaacttattcaattccaaagctagcatctttagagaagacatattaaagaggacatgtggaatttcacctgacaggtcattgccacctaggagcaacctcgacaaatgtgacaaattccctagttggtcaggaattgttccagtgaagtgattagaagctagagctaatctctctaggtgagtgatgttgctgagggttggtggaataattccagtgaaattgttccaggaaagccgtaagaccaaaagattggagaggagatctagtttgaggggaatttcaccagcctgaaattcttagacagttccaatattcttaggctggagcaattgacaagtgtttccggaatcacatcttgcaatgagttcgtgctcagattaaggactt

SEQ ID NO: 56698 - DNA, 1925 bp, Oryza sativa
gtcgccatctctctctcacacggtgggggttagagacggtggggggagcggagaagaagagaaaaggcgccggccatggcgcggcggcgcgagggccgccggcgtcggcgacgccgctccgcgcggccgcgcgcccgcgagagaagagaagctagggttttcggcggccggccgggagagggggttttgatcctccgatctcggcgcccggccgtccgatcgaaaccctagctgatcggacggtcgacgccggtcgggccaaaaacggcccaagagggagagcgcgcgcggcgactttcccggcccaggcccaggttgcggcctggtgggaggggggagcgcccgcgcgcgccaaaaaggccgcgggccgacctgaaaaagtccgtatgaggtccctcgggggccgaaaatgaataaaagagaacagtagcaattttccattttattttgtcaattttcatgcaaattttcaatagaattttgaatagatttttgcatgttttacctctgtttaaatttgaaccaacgggagaattttcacagagagagaattacagagattttgctactgttcatatgttttttatatagttttccgctgcaaatagatgaaattgatgaaaattagtgtttctaaaattaaatttcgaaccaacgggagaatttaattttaggaacattaattatgtgctatgatgttgtaatttttctgaccaacgttgataattgcaatattatagttatggttatatgtgttatgtctatttctgcccaacggtgatgtaggcttaatgcataatattttaatgttaattttgttctcaccgcacatgattatttcaggtggctactccttgatgggttgcattaaagatattccgaccctgaaaggagataactacgcagaatggaaaagaaaactcgaccttgcttttatcttgggagaggtggactgggtgttgactaccccatgtcctatagaacctgctgaacttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaaacaccatagagttgccaatggagttgaagaaaaagttgaagctgttggagatcttcctctagagctcgcgaatggcttcatacttt

SEQ ID NO: 56699 - DNA, 720 bp, Oryza sativa
tagtacaatgcaacgtctaagtattacttcagaaaacagaattgcctttcatgaattgaagatgtggcaataaccatatatcctggagctatataccctatggttcctttcaatccaattaagctattcggacaggaatgtccaagtgaggcaaatttagactcaagaatgaggcttgaaattccgaagtctcccaaatatgcattcatatcactgtcaagaaggatattcgttggcttcaaatcacaatggataatagatctttcacattcgtggtgtaaataggacagtgcattagcaatgtcaacagctatatttactctctgagataagctcaaacattttgaagcaacactggtattttttttatgcaaccacatatccaagttcccattaggcatgtattcataaatcagagctttgaaatcatttccactatagtctattgttgaacacgccgttaggataggaagaaggtttcgatgtcgaatgcttcttaagatctcacattctgatatgaagctttcgtctgcgcatctcgtctctaggtcaaaaactttaatagcaacttgtattttaaccggacttaacttagctctatatactgaactgtagcttcctcttccaattaagtttaaccgtgagaagttccctgtagcttgggctatatccttgtaagaaaccctaaggaactgcttttccaaaaaaaagcacgataga

SEQ ID NO: 56700 - DNA, 1045 bp, Oryza sativa
tggggttcatgccctatttatagggcgaaatttgagattttttggaattttttcgaattttttatgaattttttagcctcccaacagttaatttcaaatttgaacggtcaaatagccgttagtgccacgtggcgccttcccattcgaccgccgcccgccctgtcagtgcgccgctggcgctttcggcctgacgggccgcccgggccgtgccgtgccggcctgctacagtagccgtgccgtgccgtgccggcccgcgggctcggccagcggcccaagcacggcacggctacacgggccgtgccggcacggcccgttactgtagcaggccgtgccgggccgtgcctgctacagggtcggccgtgccccgggccgcccgtttggcccggcccatttggccagctatagtttagccaatgttaaagcccacaggaaaaagtgcaccgaaggtccctcaacttatcatcgggataaaaaacgtcctcaaacaataaaagatatatgggatcccttaactatataaaaccggtcgcagtagatccctcagcgggtttgaccctgatttggtcctacgtggcagctgagtcaacgtgggtcccacatgtcagggtgaccacgtcatcatctctcaaccccccccccttctctccctcctccctccctctctcttcctcacttttctcatagtgttggccggcggggcgaggcaaggcgggaaagggaggccggcgatgggcgatgcggcggtggcaggtcgggtgccgcaggccacagcggtaggcgcgaaggtggaggcgggatcccgttcgccgccgcggcgatgggcttcgcatggaccctccgctcgtcgccgagcaggcggcggcgatggagcgcgacctggcgcactgcggaagcgcaaggacttcctgtccgtcgtgctcgcggcgagagagtcgaacaaatcctcgagggagctgctcacgtcggattacatcagcatgctcacctacgagcaccccctcatcaggtcagccacgacgtcgttcaccatctccccggtggtcta

SEQ ID NO: 56701 - DNA, 2074 bp, Oryza sativa
ttgggctacctgtcgtgtggcaccattgctggcggtgctacccggacttgtgcaacaaccaacagcgacatcggcttcggccgcaacgccaacatggtctaccaaccccaacgacgacgacgccatgaaccccaggaagggcacgctctgctacgccatcatccgcgacaagccactcttgatggcgcaccatggccgacggcgtctccatcttcggtgccagccacatcttgatgacgccatctccatcttcggtgccccagccacatctggattgaccattgcccaccgccgcggcgcccacctgtgcccggcctactgccgtcgcgtccccgcaccaccgcaccgcccatcccgcctcgccctgatggtcagccggcgcgaggggaaagtgagaaagaaagagagggggaaggaagagatgaggggagagagatgatgacgtggtcgtcctgacgtgtggggtctacgtaggtctcatgctgactcagctgccacgttagataaaacgggaccaaaaccgccaaatgacaacccagttttgtaagttgagggacccgcatatctggtttgtggttgggggacgattttgtaactcgatgacaagttgagggatctttggtgtactttttccaagcccacatgggtagttttcttttactgggccgcatcactacttgtaggccttctggcccacttgggcactggcttacgcacaaactccgtgtgtcagtgtgtgcgctttcgcgcgcacggcgaaccctgacggaaccgcagcaacgccgaagactcgcttcatcgcctgaaggcgtgagaagagacagacagctgcggactgcagcgcagcaatggcgagagccgtgccgcgactgccctgcgaagataaaagtctctactgcttgctttgattctctagcacgcggtgatgccaataagaagagtatggctagaggacatggaaatcggagtagacaccaaaggagtcagtgtcttatcctcttattatgtacaaaacggtcaagacacggcagggcatttttcacagtaggagaaacgggacctgtggatgtaacggtgctacagaactgtgttttaaaggcccgagtccagggtctcgagccaattgtacataccacaacgcaagcaagtaatactcggctcgagcaaaatcaattacaaggacaagtcgccctgctgttccgtattgacatattggtgagtggtatttctgtaagcactgcttatcttgtttccggtcgtcaattttaccgaacgagcagacggtaacaagagacgctacatatttgtatatgtcttacagtacagtagatgaaatagttaattagagagcatatcgtagttagttcactttatcagcaaacagtttatgggacaagtttctgcttctttgggaaaacttttatcggtgcttacacctcttgcccagtggcataggcaggaatttttctttgggtagtcctagttcacaagttcatgtcacgtgataaaactttcttgcaccataaaactgatatacaaatacaaatttagtgaaaatgcgatagaaataatgtcttccaactgttagactttgcactaggatcacctaggttagatctagtcgggtggttctatttgggtttgatgaatgacattgtagagattgaaaacgggagagggtttagatagaccgaccggttgaggtgttggaggatgaagaagtgccggccatcgtcgtcgttggcgctcggttgtcgtggatgcggcgccggtgaggtcgacgacgatgacggctgcgggagtgacggtcgtagatgtcccggcgatgaggtgtggcgcggcggtggcgcttcccgtcactggctgcgccccctctcgatcggattagggtttgtagggtggagttggcggcggcggtgaatctcgtaccttgtgccgtgccggcctccacccctcttttatatggcgcagtgtgacgggggcccaccagccattgggctgggcgcccccgatcagggcgcggtcaaggcccccttgagccgttgggctcaaggggagagagatctatctaaca

SEQ ID NO: 56702 - DNA, 1524 bp, Oryza sativa
cataaagaaagtgaatctgagttgcttgttcgtgggagctattcccagttatgaaccaagtgatatcttcgaagatagtctacagaggtcagagtaaaatcacatctaacaacgaagcttcaaatttggccggataacgatcagacaataagaagtccagcagtaaaactatttgggaagacgtcaaagtatatccagtgggataagttggttctcttgggaagcataattcaaaggcaaagttatcgacccttgcatcaaatagcagaagtagctatcacccggagaccaggaaagctaatatgaggcagttggtggcgagttagaagcaaatgacaagctcaacttagaagtaaatgacaagcatgatattctcatgatgacaagcatgatattctcatgatgacaagcatggtatcctagtaatgacgagctgatctcgacgcataacgtgaaatgggtaacttgtatgaggttgactccaaagatatgaactatacgaagttctggaactgaagccccatcttcaagtgccgcaacccagacgaagtcagctaaaggttcaaccagggacaagtcaggtgaagagaagattccacctgcaacaggagatcgagacaagcagtacagagtggagaagctttgctaggcaagtttgttatagaaaacgcgacggaagaagtcagataagaagagaagaccgcccaacctatcttcctgctagcctcctcgaatctcggggacgagattcttgtaaggggggtggatttgtcacgtcctgataaattcatcccgaaataaaaatcattccctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattgagaagaaataaacaaagttgaaaaggttttatagttttactctgatcagaggtgtacaactgtacccacaagacacagccccacgacacatttccgtgcgccgacatgccaccacgacatatcggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcagctaaaggaaagctacactacaagccctgccgttgcccacgctggcttgtggtaagtacgataagttcttccagggcatcccgcgaaccggtccttaattgccatgggtgcgactagcaaaactgtcacgtcctgataaattcatcccgaaataaaaatcattccctaaaaggaataatagaattaattaaaattcgaaaagaaattggcaaacactaaaatacgtacaagaaaa

SEQ ID NO: 56703 - DNA, 762 bp, Oryza sativa
ttttgcagctgaagtgttctacatatacgtgccaagactcaaaactcagagagccaacctgacaacctgtaaacaaacaaaagatgcgtgtcctgaaggtgctgctgctactgctctacggcgttggcaacatcggttgctcaacggttcctgacaacacaacagatatgctctctctgcttggtttcaaggaagccatcaccaatgatccattaggagtcttgaacaattggaacaaaagcatccacttctgcagttggaagggcgtctggtgcagccccaagcaccctgggcgagtcacggcgctcaacctcgccggccaaggtttgtccggcaccatcgccgcttcggttggaaacctgacttctgttcgttcagttgatttatccagtaataacttctccggccagatacctcatcttgccaatctccagaagatgcaagtccttaatcttagcttcaatacactggatgggattattccagacaccctcacaaactgttccaacctgaggaaactagacctctatacaaacttgctaaagggtatgattccttcggcaataggtctgcttagaaatctagtttacattgacctttcccggaataatctgactgggatcatcccggcaagcctaaaaaatatatccctcttagaaacaatctatcttcaagacaaccaacttgaaggaagcattcctatgagcttggccgattttcaaatattttggttctggtcctagggggaaacaggctatcagg

SEQ ID NO: 56704 - DNA, 1796 bp, Oryza sativa
tcagaatagtgaagttccacctccctaggactccgcatatcgtagggaactttttgacagcttttgtcggagccgtcggatatccaacatcgtccacctctattatggtgtagactttcttaggaatcttattctaggtcctaggattccgactcgaagtagtcccagtagtggtcgtcgacattggttcgccttgctgcaacatgtcctatgtcactgttgtatggggagaaagtactttttaaacacaaaattgcatctacacacattctctgatagtttgatattcctctatctcctacctgcgttcgcctcgtcgacggaaccatagcatccatgctcaataaggccgaagcagccgggaactcgacctcgacatcagtatcccactcgaacttgctatcaatgtcactaccataagatagtggcaacggtagcaaaatctagtgggatatggatgtcgaggtcaagatcccgtctgctccagccttaaggaacatggatgctacatatctgctgacgaggcagacgcagatagaacacataggcaaccaaaccctttctatccaagatccctaatgttatcatcagcaaactcctagattgcgtccaagattattttgttagggaccccttattcccatagatacaacaaccagctttggatactgaatttatgggaatggggttccctaaagaaatgaccttgaaagcaatctaggatattggtaacgataacagatttctagaaatgttgtatttgaacgaaatgttctgtttaccaatttttcttggctggtactgtgcaggctgtaacccgaccaaaccagatttggcaaccgggacacttcgtattctcctaaatgccataatttcagtaacttcatttaataacagatttctatgcatatccatcccatttccctcaaaatcacccaaaacagcctatattacacaagtcacatatatattatttttgtacttaaaaaaacacaagtcatgacatataataagtttggcttcagttttgctcagaaattatgcttcaattaccatcatttgcaactgccccattcccccaaaagaaattaagaacaagtgtagagggtctgtctttataaaaaaagaaccagccatataaaacagccataataattcaaccatcacagcccacatcaattcatccatcccattggacccaaatatcccaaaaattatgcaaacaaccatatctctactacttaaaaaataagcgctgcttccatcgtccgtcaaaaaaaccggcgaaaaaaccaggcgagtgagaaaaaaccggcgaaaaaaccataactgttcgatcaaaaaaaggggcgaaaaaataatccgattctgtgcaaaaaaaaggtgacaaaaaaaccgggcaagagaaaaaaaccggccgaaaaaaccgtaattgtccgatccaaaaaaaagggcgaaaaaaatccgattccgtgaaaaaaaaaggcgaaaaaaataaaaaaaaatcggtctgattaaaaaaaaggaatcaggctaaataaaccgggcaaaaaaaatcaggcgaaaaaaaagaatctgattcctacaaaaaaaagggcaaaaaaataaaaataaaaattggtccgattccaaaaaaagagaaatcgggcgaaaaaaccgggcttaaaaattgggtgaaaaaaaccgggcaaaaaaaaaatccgattctatggactgttggtatttcttaccgatattaatagaaatataattcccagcaatggcgtagaaatatttctggtatattatggttacag

SEQ ID NO: 56705 - DNA, 714 bp, Oryza sativa
attcctgcagcccgttgtagggccgctgatcatcacttgaccaacgcggcgctctacagtttcgctgttcaaacctatagatcgagaaccaaaattgataagtcagggggaacatatacttaaggaatggaacccagaatacgagaaaaataccctgaggagaaacccgggtcgcatcctccggccctgagtagtcaaaggctagatgggctcgagcctagagcggctggatccgtctaccgatgaagtcagcagcgacttcataccccgacaaccctcgcactcggaggtcatcgatgacatcgatgaaagactgaagggagggggtcaaggcgggcttggcagtccaagacgaaatattgttcggttgctcctcgggaacaaccaagaccggatccgaattttctaaccacctcacccgccatttactacgagaagaggggcactggaaggggatatagcgcgacttcaggccatccctaagtcgaaaaccaacgcatcctgacaccctgttggattccatccaacgcaactcatagtagaagcgaaagaggtcaagaaacggctctacccctgtcggtgatatgggaccgggagtatcatgaccagaggcttgaggcagacgcaatcgcccacgtggcctggcaccttcggggacgtcgggcccgagggtgaggtgtccgccctcctcctgatttccccgagggggggggg

SEQ ID NO: 56706 - DNA, 1521 bp, Oryza sativa
cctccacctgggcgctgaatccatctagcaccgcggtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccttgtcgcaagctgccccggaggttgtcgcctgagcgtcacccgagggagtgggcccgagcgacgcgccggcggtcttgttgtgaaccgcctcggaagacgccatcgcctcagcctgcgagcccgggcggtttcctcccgagtggcttcttcagcctgacgagcccgggcggcctcctcccgagcggcttcttcagcttggcgagcccgggcggcctcctcccgagcggtatcctccgcctgccgaacccgagcggcctcccgggcggcctcttcagcttcccgaaggcgatctgcggcctctcgccggtcagattctcgcctctgttcctctgcggccgccggatcttcggcctcggattggccggacttgggatggcgggagggacgcgacgggacatcgctgaagcagaagaaaaaaccagaaggcaaacaaaataggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccgtttcttcttgcgctccccctcgggctgcgatgttggcgcggccccctccgggcgcctgctgctggcacgtgccgccccgccccctcggggaggagatgggggaggtgttcctcccagtttcctcttcccccgggcgtcggtagggcggttgctccccgagcccccgacgcggggcccagaagcacgaccccctccgggggtaggttgatccccccggcggctcccacctgcgccgccatggcccttaggagcctgctcctctgaggccccgaccgccgtcataatggtcaagatggagacgcgatctgggtcgctgcagagggggaggataccgtgggggatgagggacgcctccacggagttgagatttagcacccgttggatcagtatcttgaaatcctcgggggcccaatcccatctgaccccctggcgggtccgcatatagtcttcgggcccgatgtactcccaggcggcccgagcgcgccgctggagcggcgcaatccgacgacggaggtagtcgccgtacaccatggccccggtgagcccctgggatcgcaggcccgcgaggcggtcgaggacggcgacatagccatcccccagatgtcgcgcccagaaattcacgaaccagaatttctaagctgaatgtgtattaaacccctgtccaggaccagccagggtacacaaacgacaattgttgacata

SEQ ID NO: 56707 - DNA, 759 bp, Oryza sativa
ttcatcagtgaagttgccaccataggcatgattcaccatgttaatgtcgtgcgtcttgtggggttttgctccgaggaaatgagaagggccctagtttatgaacacatgcctagaggatctctagacaagtatatttacttgtctgagagaagtttctcatgggacaagatcaatgagattgctctaggcattgctagggggatcaactacttgcaccaagggtgtgatatgtagattctacactttgatatcaagccacacaacatccttcttgatgataactttgttccgaaagttgctgatttcggcctcgctaaactgtacccgagggacaagagttttgtgccggacagggctttacggggaacagtgggttatatggctcctgagatggtatcccggagttttggtgtcatatccagcaaatcagatgtttatagctttggaatgctactacttgagatggctggaggaagaagaaacgtgacccaaatgcagattcaagtaaaagtaaggcgtactacccatcatgggtttatgaccagctaatagcagatcaacaatttgatgagatatcaaatgttgctaacatgcatgagctggagaggaagctatgccttgttgggctgtggtgcattcagatgaaatcacacgatcgaccgacgatgagtgaggcaatagagatgctcgaagggggtgtggatgcgctgcaagtgcccccgagaccatttttctgcgatggggatggcattggcaatg

SEQ ID NO: 56708 - DNA, 761 bp, Oryza sativa
tcaccgccggcggcggcggcgatgccgaccgagctgtcgccgaagcacgacgactcccgtgtcgcctctggctttggtttttcttccggcgagattagctgctgcttgctgttgctgctactgcaataaaagagagagttgacgtgacacgctgacatgtggggtccacgtaggttccacgctgactcagccgccacgtaggctaaaatcggggtcaaaaccaccgagggatctaaagcgaatggttttattagttgagggacgtccggtatctggttttgcggtttgaggacgattttgtatctcgacgacaaagtgaaggaccttgggtgtactttttccttatatttgctcgtgaattgggccacatgtgaaccgtccgatcaatctatcgttcatgtgccgcgggggattaggtgggccatcgaagcaaggccttagatgggccatcctaacctgtggcccagcaatcatcatccccttctccctctctctctctctctcaaaaaaaacaaaagaaaagaaaagaaaaacatccctttctccttcctccgatccttgtcccccaccactcttcccggcgagagctccggttaatgcggcggtttgcgtccgccgccgcttttcgcctccgtctacagatgggtaagctgtcgtttcctcctgacatatgcgagagtgcgtgaccaagcctcgccgtcgcccgtaccggcatggcgcatctgttagagcaggttagcaaactagtcagctataaacat

SEQ ID NO: 56709 - DNA, 7733 bp, Oryza sativa
aattcctgcagccccggcaaagatccggtcgaatctaccaagcccgatgccacatgtatcgtcttctcaagttcctcacaccacctccgtctctcccacctccgtctctcacattattagtactggtactaagagcagtaagagcggatacaatagcagactataagccaactataaatatattttaaagagataaaaggaagagagaaaagagcagctgcagcacggactccgagacgtaatgtgtgtatgacagtcacggagctcgtggctcctcaccgggagaccgcgcagacccccctttgccagttcggccgggggcttagggtgagatctcaagctctctctgtatgtggaaagatcgcgtgcccggaagaaacgcgagacacagacgatgtatacaggttcgggccgctgggaagcgtaataccctactcctgtgtttttggtggatctgtgtaagagcaagttacaaaatatcaaccagccctctcctctcccgggaaaatcaaaatccccccttctcttcgtgggcatggtcctccttttatctcttaaggggataccacatgtacccttccctttttaaactggacttttcttctttacataaatggacggagatttgcacggttgccctccgaacgtccttctgatgggacggcacatacctacctccacttctgccgggggcaggcgcgtcgtgggaacgtggctgtgcgctgacgacatgagcagtgtcagaccggtcaccaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtatcacgctagctccagctggggacgagtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaatggtgtcttggccgtcagtcatgggcggtctcttcaagactgccacatcacttgagcagcgctcgaatctgggcgtgcagattcgtttcgtctggagatatggtaacgtcgcttcggtcggcgatcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaggacttgctcccttcctttcgccactattcccctttccttcgccgtttgcgccctaaactctctctttgctgcgcctcaccttcgccacacacgctcgttctcaaccctctctttctccgacgacatggcacggggctccgctctgctcgacggtagcgtactaccgccttcccgcattgtgggcgagaggcaggctgggctgccgcgtcgcttcatgccggaatccgccaccggccgggagatagtgatgctgggcgaggcgcgcccagcaccagattacccggggcggtccatcttcttcctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccagtgttgaaccgctacatcccctgcgccctccgcaagaagtgggacgattggaagagcgactggttctacaccccccttgccaacgaagcgcgcctccgactcccaagccagcccccggcgccggtctccagctggcgggcgccagtggatctgggggatgactatgacgccgtcctcgaccgcctggcgggcctgcgatctcaggggctcacaggggccatggtgtacggcgactacctccgtcgccggattgcgccgcttcagcggcgcgcccggagcgcatgggagtacaccgggtccgaggactacatgaggacccaccggggagtcagatgggattgggctcccgatgacttcaagatcgtggtccaaagggtgctgaatctcagctccatggaggcgtctcttattcctcaaggactcctccccctctgctgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcggggagcaaccgccctgccgacgcccgggggaagaggaaacagggaggaacacctcccccatctcctccccgaggggacggggcggtgcgtgccagccgcaggcgcccggagggggccgcgccgacatcacagcccgagacggagcgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccaccttgtttgtcttccggttttttcttctgcttcagcgatgtcccgtcgcgttcctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagccgaagaagccgctcgggaggaggccgcccgggctcgtcaggctgaagaagccactcgggaggaaaccgcccgggctcgccaggctgaggcgatggcgtcttccgaggcggttcacaacaagaccgccggcgcgtcgctcgggcccactccctcgggtgacgctcaggcgacaacctccggggcagcttgcgacaaggccgcgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccgccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcgtcgccaccactgcgatgattgaggcgcaggactccctccgccttcaacacgggagctgggaggcggagctaaagaaaaagctcgacgccgcccagggggtcctcgacgccgccgctgcccgagagcagcgagcaacagaggctgaagcggcgtcccggcggcgcgaagaggcccttgaggcccgtgccatggcgctggaagatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccacgacacaacggctggcagacagcctgtccctccgcgaggcagcgcaggaggagcaggcgcgccgcaatctggaatgcttccgcgccgagagagccgcgctggagcagcgggctgctaacctcgaggcgcgagaaaaggagctgggcgcgagggagcgcaacggcggggcggctacgggcgaaagcgacttagtcgcccgcctcgcagctgccgaacacaccgtcgcggacatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaatttcgcgctctaccaatctggaaggcctcgccccgcaccttaggaggatggcctgggctgtccaacaactccccgaggagctcgagaagaccatcaagtcatcctcgagggacctcgcccaaggagcggtggaactcgtgttagcgagttaccaggctagggaccccggcttctccccatggatggcgctggaggagttccctcccgggaccgaggacgatgcgcgcgcgcgggtccgggatgccgccaaccatatcgtccaaagcttcgaggggtcggcccctcggctcgcgttcgccctcagctccgacgaggagggcgacgccagcggtgaggacgacggtggcgacgaggccggcgacccgggcgcattggaatgagcccccaggcccccgccaatctccaactttttcattttctttcttctttttgtatagatcaacttaatctgcaatcaaaaatgatgaaaaatttctatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcatggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgacccccccctcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgcagtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagtttggagcgctcccttcgggtcccgaggcctggactccgacgggcctcgggggtcggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctattccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcatactctgctatattattggtcgtcgaaagtcaaggcggaccagatatctaaggacgtctcctgtcggggaggtcaacgtgacccccgcaccggcaccctggagggacagagaaccatcgaactgcatcactcagtaggtggtgtgaggtagctgcgaggggttcgtgctggcctcggggattgagacggtctctggagccggggtccactctgccacaaaatcggcgagggcctg

SEQ ID NO: 56710 - DNA, 1941 bp, Oryza sativa
ggataagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacctttcggtggggccgatcctctttgctaggggccgtatccccggggcgttcttcattcaagtggcctttcggggcacacttgtcttctgtgccgatgacctcggggtcggaggatgaaaggggcggccttccctcagtggcctcggggccgtcctgggggtcgggggctcctggcatcgtcggacaagcaggcaaagggccaactccggtcgtcaggggcctctggcctccgttcgactcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcagagggccgactccggtcgtcaggggccgtaggccaccgtccgactcgggggcctctcctccccgctcgctcccgggccaagttagcacagaatgggggtgcacgaaatgaggattgtcttcatcgcgctccacaaccaacgctgcactaactacttggggggtcgccgctaagtaaagtagcaggggctcatttggctccggggcgactagaaccgggggagagctaagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacatgagcctcaacattacgtcctatttggctacccaaagaaattcgagtagtacgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagtgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctcgggctgcaggaat

SEQ ID NO: 56711 - DNA, 1879 bp, Oryza sativa
aattcctgcagcccatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccaatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgcgtcgcctcatgagtaggggccgcggccagaagctctcgcttcatagccttgaagctccggcgagaaacgtgagcacacgctcccccgtcgacagtggcaatggtggccccaggttcttggaaacctaggtcatcatcaccatcatcgacgtcaacggcgggggccttctgtctggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagtgattcatcatcccctcgctgtactgcgtgcaagtccgcttcttcacctgggcgtggataagtgccttgaaagttcatggtgaactgctggcacaaatcctcccaggagtggaccgacgcgggcggcaggttcattagccaaccccgcgcctgtcccttcagggccatgggaaagaaattcgccatgactctgtcgtcacccccagcggcctcaatcccggtcgtatagacctggagaaactcggtggggttgacactcccgtcatacttctcggtgatggtgggccggaaccttgggggccaacggacattccgaagactcgccacaaaggctctacagccgacaccaccagccgggggcatggagggctggtcctcacgtccctgtcgaggtgacactctggacgaagaggcgccctccgttgcgcggggagtacgccggctattacgccgacgctcgatgtcgaggcgggcatccggctctccatgccgatcctcccgagtcggaggtgccgacgagggagtggcagccgaatggcgtgcaacagccgccgctcgccgcgccctccgtctcgacgacgcggaaccggtagtggcggcgccggaggtcttggtggtggcggaccgtccaccagcacccaggcgctgctgtgccgtcatgaccaagttggccacgtcggggctgcaggaatt

SEQ ID NO: 56712 - DNA, 3047 bp, Oryza sativa
cgtcgtccagccatcgctgggctggagactccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgagctcgacggcgtgggtttggctccccgtcgtcgccgctcacactcggagagaggtcgtgcacctttgcttgctcggccattaggctgaacaagaaaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtgtgtggaaagatcgcgtaccaggaagaaacgtgagacacggacgatgtatacaggttcgggccgctgggaagcgtaataccctactcctgtgttttttggtggatctgtgtaagagcaagttacaaaatatcaaccagccctctcctctcccgggaaaatcccccccccccttctctctttgtgggcatggtcctccttttatatcttaaggggataccacatgtaccctctcctttccaaacggacttttcttctctttatggacggagattggtatggttgccgtccgaatgacacttcgatgggacagcccacacctacttccactcccggcggagacaggcgcaatgtgggatcgtggctgtctgttgctgacgcgaccagtgtcagaccggtcacagatcggtcattcttgtcctctatgcgtcagttcagcgatctgcatgatcacccttctttttatagcatcttgcctgtaatggttgggatgaagcctggtattcatttaaccagggctaagtgccatctctaagaggtaacacgctagccccggctggagacgtgtgcctagaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgtttgaccagaccgcaataaatgcggttaggtgagccctaccgtgttcacccaacctatgtacatagtgcaaaccccacagggggtcggggcacctcggccctcggggtcggggcaggagcaacccgacccccccccccctcggggaaatcaggaggagggcggacacctcaccctcgggcccgacgtccccgaaggtgccaggccacgtgggcgattccatctgcctcaagcctccgggcgcaatactcccggtcccatatcaccgacaaggttaaatactaatatcgacttagattatatagggtatccaccatcctatgaaatatccaacggcttgattgtctagatactgttattctttccatacttataactgcatcagttaagtttgaccttataagtcgtgattagaatctcaatctctagcctgcttttggttgccgattagggtagtatcggggtttcagccgatcttacctgatttaactcctttatattttatatgcttgattgatatgttaaatccgccctttatattaagatcttgttgcatttaggtatattaaacttcctgtttgatatattttgcttgctttaatatcttaatatagaatggtatcggagttttagccgatacatgctagatctatctgatcggctatgctatgaatgcttataatctccttgttaatatatattttgatctaagtgatttatactatctcggcatggcgaccgatatatcctaatcacttgatttaagtatatatcgacagaagcattatataccattaatatttacagccgatcgaatagatttagttctttctttcctatttatgactgccgatcgattcaaatatgtcatcggctcaaagataaatgatatgtcatcggcgactggccgattggctatcatttatggatttaaccgctatttttttgtctttatttcttgttgattgcaggatcaaatcaactggcacgctcacgaacctaaaggcaagattttggacgtgcactgaagttaagcagatcttgcaggccagtgtgtgtttttcgcatcaacttctattgtttgtaaataaatgaatagcgtacgaaattcatttcactgttgccggcccggcagaaaattcatttcactgtttacaatcgtttctagcttcagcattttacagcctacttacaagctagctagctagctgacttggcttccaagcagacacaagctttagtgctcatcctcctccgagatttcagttagctcagagaagaatggtaagaatccactgttagtgtgaacgcaaaatatgatcttgcggctaaacctaaagtcggcaaagagatattttgtttagggtgatcgctacagtgatcgatctctcatgaacatccctgatcgggggataaccgccataccctagtgtcggttccccctgtgtgcagtggctataaatagagatcaatacctaagtgttaaaccctaagagatttctctcgctacccgatcaaacaacccactgaaacacagggaagaatcaagacacgattctcttcgtgcttccaaactagaagagaagaaagaagaacaaagacagagagaatgggaactccaggagatcaaggtatgatccaatcccattttaatttgtagttccactttgtgccaaaccgattctatcaaatccaacaatggtatcagagcaccgggttggcctcaaattggaactcaataagtgtttatgttcaaattgttcttcgtgttcatgcccaaatccctctgttaaagttgagttaagcccaaatcatgcaatcccgaaatataag

SEQ ID NO: 56713 - DNA, 1854 bp, Oryza sativa
acgcgggctaaccaggccgcgcgggaggcggcgaatgccggcctaggcccaggttgttgggcctggagcccaggcggaaggcggcgcggcaatgacgggccaggccgagtgcggcctggctcgagaacgtggcccagttcaaaaaaaaaggttatgtgggctgcatactaatgggcctaattaaaaggattgggctgagataatattacaattaaaattttcttttttgaagaattatgattatgattatgatatttgtgtttaaacattgaagatattttattatgttttagttaatgataataagaataataagtgattttgttatgtgataaaattctctttcatttatttatttattttatgatcattacattatatttattacttaaagttattattgttttatgcattatgagtttatttccgttacaaataaatattataattaagtgtgacaaataattgtcattctggccaaagctgattgacttttatttgatcacaaaattttattaattcaattcaaatctggctaaagctgttttgattgaattaataaaaggagttttaaacaaattaataaagtgtggtttgtatttattattctggccaaagctgattaataaatacttattcacaaaattttattgttcatttccttctctggccaaagctgttttggatttgatcaataaaagaaggtactcatcttatgcctcacaaatttccggaataatgggcaatattgaacaacttaatggaagtaattatgcttcatggaaggagaagctggaaattactctagctctattggatattgattatgccctccataatgatcctccggttgagcctagaccggaaaatgagaattatgagacattaaaaaggatatatgatgaagtaaaggcaaaatgggatatttcaaaccgtaaatgccttatgattatcaagagctccattattgacgcaataagaggagcagtcccagatactcagacagccagagaatatcttgctaaagttgaggaacaatttaaggctcttctaaggtttatgccaccactcttattaaaagattggtcaatgaaagatacgattttactgaaaatctgagggaacatattatgaagaaatgtcacatggtttctaagcttaaatcaatggaaatggaaatctctgaaggttttcttgtccatttcattatgtcatctctgcctcaggagttttctccatttacgatcaattataatgcaatgaagatcaagtggggcattgatgaattaatagccatgtgtgtacaagaagaagaaaggcttaaggcagaaagagttgaccatgcaaatttatttaagcactccgagaagaaaaagtataagaaatttaagaaggagtatttgaagcctaagcctattcaatttaaagaaaaagggcaatcttcgaatcaatcccagcagaataaatctggaggaaatccctatacagaagaaaagggaaaagaaaaggatgggtgctacttttgtggaaagagtggacaccgccaaaaggactgtattggatttatgagatggctcagtaagaaaggtactgatgttatttcttttgttgatgaatccctaaatattgattatgccaccaattcttggtggattgactcaggagcgacaattcatgttgcaaattccttgcagggattcgctatgaggaggaccctaagaagagggcaaagaagaattagagttgctaatggagttgaaactgaagttgaggccattggagacttcactctcacacttcatactggcttcaaacttcagctgcatgatgttctttatgtaccctctatgaaaa

SEQ ID NO: 56714 - DNA, 1082 bp, Oryza sativa
  unsure (1)..(1082): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtggttcgcatattttgacttaaatttcattgtcaaagtaccctctcattctttagaaaattaataaaatttctgccaatatgaagttaattgtgcatcccatacttatggacaagtatcctctacatgccgttgtgcctagagagcgtcgccagccgttgtcattgcagtaaggaataacaagatattatcactctttgcctccttccattctcattcatcatattacataaaaaagatacatatacttttccgtaaaattttattttccgcacattataaataacattgtatatgaaatgtaataggctattatttgttatagaggggaagattttgtttcattaacatggattaaactaatttattgataaggtgagtacaaaattattaaaactttatagaattccaaataaaactactactaatttatttctttataggtccaccctgtcagatttccatcaatctagttctattgtgcctgaaaaagagaaacacataaaactgattttgccgcgggtttgctccaaatttttgtgtttgtacgcttttttcctccctcaatttgccgggttttcttctccactatcggaagcagttatgatcctaatagagaaaacaaaacccatctccttactcctgaacataccgatccaatctctccagtcatcgcagcttctccacagcagatcccggcgcccgccacggccgacgacgtcgtcggtgcggcggtgcctcagccctgtctgctcgtccccagggcaagatcacccgcctcaacgcgcttctccacgccgtcatcgagatcgaggtcaactccgacgcgctccagcagccggcgcgcgccgacaccgagcacgcctctggccacagctactgcgggccgctccacggcgtccccatcctcaaggacaacat

SEQ ID NO: 56715 - DNA, 1524 bp, Oryza sativa
atttaaatgaagaaattcgtaaatattcatttaaagagcatataaacttcaaatggccataacttggccatttgaactcggaattggaccgttcaagtctctaattttttcttaagaagtcaagaacccatttttgtgctttgttcttgcttgttatatggagtttattagagtaaaagcccttttcttttccgttggtcgtgtagacgctgcagcttcgaaagatccgctcttcgtggaggttgaagccgacgtttgggaaagcgagcaaggcaagtcacatcattctttgaacatattggatcccactttatgaaattactttgatttaaattattgcattatcactttatttaaattcccgcgttatcactgttttatttagccatgcctatttacctttgttatgaccttattattgctattgtattattaccttgttcaccctagaataaacaaaacccctactagtgggcactctactcatggttcccctggtatgaatttaggtagatgcttcgctgattaataagacaacattaggtggtttttataactttagactttgggaacattcatatctcttggactttatggaatggttggactattgtggaattggatgcacacctctccctctattcaaaactctcaaaatggttttacgctgggcttggggtgcatggttttgatagtagcacctcgaccacataaggaccggacttcgggcctctgttgcaaagcactaccgtacttccacatgtctagtgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggcaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggctcgtgagggttcacggccttgtttaataatactgtgtagctctaggatcgtctttacaaaatggctttgggcaactaagtgacttttaaatgctgtttactgcaaaacctaacccctattattattcccttgtacccccccttgcattaatcatgcatctgccggtgtggcttgctgagtactgtggttgtactcattcttgctcaatccttcc

SEQ ID NO: 56716 - DNA, 716 bp, Oryza sativa
agtaggtgggtggaaaattcactgccaccaccattggaatctttttaaaggagtatagatacccatgcaagttttaaaattctatacagcaagccatataaaaatctggaatcagttttacttttattttaaaaaaacatcctttttatatacaaatcaagggaatactaattctctttctttctacatgcaggaccgcgggtcactcttgttgcaggtaaggaaataactcaatcttttgtccattctgcatgaaatttcaattaaatgccacccaatttatgaactttcaacaaagagagtgtatatattttctaatccaaataagaaatgccatgattatcttgacaataaaggcacatctggaaaataaattacagaattatgtcatctccaaatgcagctaactaactttcttatttttcaatcagctacatcatctgtagccacatttgtaattctttcattagttgtggccactgcattctacatctccttaaagtcaaggtacaacaaagagatacatttgaaagttgaaatgtttctcaagacatatggcacatccaagcccatgaggtacactttctccgatgttaagaaaataacaagacggttcaagaataaattaggccatggtggatttggaagtgtctacaaaggtgagctaccaaatggagttcctgtggcagtcaagatgctagaggggctgcaggaat

SEQ ID NO: 56717 - DNA, 1689 bp, Oryza sativa
ttatttgtttgtttacaaacgaaagaagctatatgttatagaaagtgctactgaatgatagctgaaaaaaggtgctacttaatccattcataatttgttctctgctttgctgtgacattcggatcaacacagccctggagctggaggtgttgactccagaggttagtgtggatagcggcaggagacagctgattgcctttgactgaccgggtaatttctttgccgtgaactagggggaagctttcgtttatcataactttgtgattgggatgccatcgttatgtgtggccattggccaaatgtgttgttggccggtgcatttctgtggtgtgcgtgctgcatgagcacgccagagctcattccgatagtgatgatcaagtctccgagacctagagatatatggacctgtttttgctgaaatgaaatgccacgatttggacagcctagtagcgcctgttgttatcgctgggagctgtaatccaaatatccaatatattcatgtatgactaacaaattcactgtacaccccctgtttatgtttgtctgacgactctgaccacaggaggaaagcatagcacgcgcagcggcacaggtacagagctgcaagcctcctccactaatcaataaaccaaacacacagtgtatcagtgtatcagaacttgagatgtgatgttacttcctttcgatctatttacgcatttctgtgcaaaaataaaaaataaaatttttctggaactgtttatccatttgtcaggtgatttctaaccaaaaatcacccaaattttttctacccttagatttacatccaattgactacaaaagagaataactaatacatatctacttacacaatatttttatcaaaattacagtgcacttacatatcatatcaactaaatttacaaatataattttagttatataggactgtaattttatattttaaagaaaataataaatacatatctacttacacaacatctttattaaaattacagtgcacttacatgtcatatcaactaaatttacaaatataattttagttatataggattataattttatattttaaagaattatcaaaattacagtgtacttacatgtcatatcaactaaatttacaaatgtaattttagttatatatgactataattttatattttaaagaaaataatcaatacatatctacttacacaatattttttatcaaaattacagtgtgcttacatgtcatatcaacctaatatgcacatgtaattttagttatataggactataattttgtattttattttttattttatagtttcaaaaatttgtaaagtgaaaagaaccaggcctaccatccgacgcatggtattatccacgtatgcagcctccaccaattattgcacaaatcctagcgagggatcctatggatagaaaaacatgaaatatcagtcaaaaaaaatcacccgtgagatgtatagcaaaatcgtaaaattagatatggtgtctatcatcgctgcgtttggatgatagtggctggatgaaggcccacggtaatgatcgggtcgtgcctgattaagcttgtgggtgggccgaatccttttgtaagaggagatcagtaaggcccacataaactgcaatgcagcccactatgggagaaggccttgcatgtatgcattgcaggcctgtccccgcggcgtc

SEQ ID NO: 56718 - DNA, 1443 bp, Oryza sativa
ttttcatttttggcctgtggatgtcctcgtttttcctttcttattccagaagacttgtaaatgccaaatggaacttatacattttgtgctaagatcaaatctactgaggtgacatggaaaggcagcatgtgctgaatcacgataagatttgccatgaactcttgatagctaagtgactgcagagggtgattccaccagtggatggaacttacatatggcgctgttccagttatctgcagcctattattactgagggtacgaaaaaattgggcaggaattgagtgctaaagtattgtagttttgtgaatcaaaacttccaagtcaacaacatctcaatctcgagtcaacagcatcacaatctcctcttaatacaaagatgcgctccttgcgtattcctgaaaaaaaaaacatcacaatcttgtagagtaatcgccctacttaatgtggcaaaatcttgttcatccctcccaagagtctatctgccatggcgattcctggagcatatgctcatgccgtgcaagctttagctactggtatcttatttgtggttgtgagtcttgtactggatcatgttgaaggaaggcatcacaagtgtccttctttctcttgcggccatcttaagggtgtatcggctccattccgtcgggcagctgatccacctgggtgcggcagcaaatcttacgagctggtctgcagtgataccaatgctacaattctcattgacaatgcaacataccatgtgaatgaaatcaactacgactacagacgcttttgggtcgtcgacgccaacatagccggtagcacttgccctcttccgcagtggaatcatcttcttgatcagtacaagcgcaaagtctcaggccacaggattgagatcgagttggctcctggtgcatataatcatgcttactttgttagatgctcacgggaggtgaaggacaatggtatatacaggcctgtcacttgcgcaagctccaactattcttttatctatgtgttattatcaagtgattcagacaaccctggttacatcgaaagcctggagccttcttgtggatacctggccatgactcttctgggtgattggagcacgacagtgcctaggaatgcgagctatgaagatgtcaaaaagttcatgagggaaggattcgccattagatttccgcgcatatatggggccgggagtatcaacgagtgcctaatggattcgataaggtgagttgatttgggatccattagatatgtcttatactcgtatatgtattgtgtactccctggctcccctctttgattcctttttctctacctgcagcgaattgcgcaatggaatagaaccaaggtctagtacaggcactgccatcagtgatcggcttattgtcatctctattattgacctccatttctggttctgcttgattggatatccatcaggcatcctaatag

SEQ ID NO: 56719 - DNA, 925 bp, Oryza sativa
ccctaacagatgcacctccaatatcgacaatttctatcgagtttttcttgtaaatttatttcttcttaatatacttggatggcctctttcaaccttcccggcaaattcacacctgtgattacccaccaccggccagtcactctgctactccaagccatgccaaattcacccgttgatttcagtaccaacacgctaaaagcgagtttcttttaatttttttttacagaaatgcataaaaagatcgaaaggtgacatctcaagtcaccaacatactgatgcactgttcgtttggttcattgaagtgaaggcttgcagctgtgcacctgttcgtgctatgctttcagctttcgtgcggtcagacaaacatgacaagggtgtgtacagtgtactggtcagtcagacatgaacaattgctagtactcccagcggtaacaacaggcactaccagtctactaggctgtccgaatcgcggcatttcctcatctcggagagacgaaggcttgaccatcactatcggaatgagctctgacgtgctcatgcgcagcacacaccacagaaattacaacagccaaacaacacatgtggccaattttcacacataacgagataacatcccaatcacaactttatgataaacgaaagcttccatccagttcacggcaaagagattactcatcataaataaatagtgtacaataaaatatatcactgtttacaaatattatttctagcttcagcattttaccacctacctacaagctactgtagctactagcttagctgatttggcatcaaaacatgcacaagttcactcgtcctcctctaagatttcagttagcccagaggagaattggtaagaatccatcataggtgacatggattcatcatcacagaagaatgttcttggaggcagggctgcaggaat

SEQ ID NO: 56720 - DNA, 3363 bp, Oryza sativa
cgactccattccacaggcaatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaaccagttcattaagctaaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgtataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccctttgtgcactagttgaactaagcatgactaagcatctcctaaaccaacatctagtcattttaataccccagctatcaatggcatacggaaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaaccacgaatcgacgaaacgggcgaaatctacgcgacaaacaaagcacacaagcaaaacatgctataagactactgaaacaggaaacaaaaccatttttaatggattctacacatttttatgaatttactgagacttgaatggacttaaacggagctcggatgaattagttatgatttttagaagattatctgtgtttttactaataaagaaaaactcttaatcaatttattgcgcaatattgccccagggctgacgtcagcaaggggtggggcggcgccgacatgcgggacccacgggtcagtgactcaaggagggagaggggcggctggcaagcgggccccaccgagcggcggctcaagagagtgagggagaggcgccggcacgcgggccctactggcagtgacacaaggggggggggaaaaggcggcctggctcggctcggcttcaaagccggcaggccaagcatggcgagcgacggcggcacgcgcggtcgccggcgacggcaaccggcggcacggacggcgacggcagacggcgcgaaaagcggcggcggcggccgaagacaacgatgcgcgcgcggaggacggcgacgcacacggaagagagggaaagggggaggagggggagtttttcaccgaggttggccggcgcgagtggagacgacggcgaacgacgacgacgagcgacgggaggacgacggcgacgggcgaacgatctccgggaggacctagagaaaaggttgggaggggttagagagagggagatggaccacggcgatcggaaaccatggccgacggcggcggtggaggtggtgctcacccgtgcgcaagaggatgagggctccggcgacgaacttcgacggaggaggggtggacggggtggatctcggccacgcgaatcgaacggcggcgacggcgcaagacggcggcgagcctagcgacggctagcggcggccggagtagcgggaagaagcggcggtgggtggttgcacggcgcggggacgatggggagcacgggaggggtcggcgaaatggggaaaaggagagagggggtgccggcgatgcttaaataaggggagagggggccggacgtggccgggagcggcgggaatcgccggccgacgtggggagtgggggaggagagagaggcgggatccgattttcgaatcccggccatctcgggcgcgggcgcgagcgggagagagagggaagtgggcgcgggggacgcggcgcacgcgcgggcgtggtcgacgagggccggggaaggcggagacgtgggcgcggcgacggttgcgggcgcggcggcgcgccgggatcggcgggaggagggagacgggcccgacaggtgggccccacctgtcggcgaccccgagagaggaggcggcgggcggcctgggccgccggactgggcctcggcctgtcgccggcccagcagagaggagggggaggaaaagggaaatgggccgacggcccatttgacaaaaaggaggaaaaagagaggaaaaagaaaaagaaaaagaaaaaggattttcccagggatttaatattgcactttgctcattttaattggttaaaattatttccaaggctctgaaaattccactaaaaatcctgttagcgtattttgacatgtagaacccaagaaaaattccacatgccgattccgattattatttgcgtttattaatttagggtttctctctaggttaaattaaacaatttcttcgaacgatttattttatgaatttagagcaagggaggggaacttcagggcgtgacaccagatctaccggcgcccgccagctggaggcctgcaccgggggctggctcggaagtcggagatgcgcttcgtcggcgaggggggtgtagaaccagtcgctcttccagtcatcccactttttgcggaggacgcaggggatgtagcggttcaacaccggcccccgcggcaggaaatagcagccgccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcatagaactccagaacatccataaagaaagaagaaaaaggaggaaccaacccggccattgcgaaggggagga

SEQ ID NO: 56721 - DNA, 1168 bp, Oryza sativa
  unsure (1)..(1168): unsure at all n locations
attcctgcagccctgcggcatacttttgcccaaacatatctctaaggaaattacatgaaatatcctaattaatagatacaattgcctatccgagagctttatctccatcacggcaatcctcgtgaagtaccttgatcaattctagaagcatcttcaaagtcatcatcatcagaatcggctgcatcacctctatcggctgtatcggctaccctctgtccgatccatctcagtcaatgcagactccagccgatgccttcgcagccgatgcatactccgttcttcgaatctgtcgaggagtgatcctctctagcgggagatcgtgagacccccctttgtgagttcggccgggggaagaggctcgctcaaggagatggtgtatccgccctggactctactgaactgcacactagcaccgagattatacaggttcgggccgctacgaagcgtaattgtcgcgtcccaaaatgaccctaaaatataccctttaaattatgcctagaataattaaaatccttgtgaaagccttcaaaaattaaaatgtgcaaagttaaaagtcaattaaggcttggaggatttttgtatatttcctaaaagcctaaaatgtgtaaataaattttagtggaattttcagagcacaaataataattattaagaaataaacaaagttaaaaaggttttattaagagggggntcgtnggggtccccctttcttgtnttgggcngnantnggcccatctccctccccctctctcctctcccccgcggcccactcggcccctccccgcgcgcgccgctgacgggcgggcccgcccgccaccctcgctggcgggtggggcccacccgtcatccccgacctcccgccgctccgcccgcgccaagcgccgccgccgccgccgaatccgccgcatcccgcggtccccgcgtgcatttaagtggggggaattactccccgtgatcccctccctctttccccccattttcccctctctctctctcgcattcaaacggccggatttgcccccgcaaatctcgccggcgccattgatggcggccggacctcccggccggtttccttccttccccggccgccctctgcccctcccaaccccatttaaaccctccccgcacctccttcgcccatttccaccctttgccgggctgcaggaat

SEQ ID NO: 56722 - DNA, 1627 bp, Oryza sativa
  unsure (1)..(1627): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctttcatcattccaacttcgacttgtttggttgaactaatagagacacccttcctggtggtgaccctgagtgagatagagattgttaatttggagagggtgggctttgggacaaagaactttgacatggctatcgtgttcaaggatttcaagaaggatgttcttcgcattgattccataccatcaacatcacttgatgcaataaaggagtggcttgacacgactgacctcaagtactatgagagcaggctgaaccttaactggcgtcctattctgaaaactatcatcgatgatcctcagaaattcattgatgacggtggctgggaattcttgaatatggaagcaagtgattcagaaacagaggaaacagaggaatctgatcagggctacgagccttctgatgctgagcctgagtctgaatcagaagatgaagattctgacagcgagtccttggtggaatcagatgaggatgatgaggacgattctgaagaagactctgaggaagagaagggtaagacctgggaggagctggaacgggaggcaagcaatgcagacagggagaatggtgcggagtcggacagcgaagaagagaggaggcggcgcaaggtgaagaccttcagcaagtcccgtccaccaccggagcgcagcagcttcaagggaggaccctcaaagaagccgaagttcaggtaaatctaacggtgcttcgccaggcctggctgcttcctgaatgcgcgccctttttgaggggcatggtgtgcttggctgtaagcagaagcgctcctagctgtttctctagatcattacgacactttgtttccgtagtagcgtactgcagttagctgaaagggcggtcggactttggtgaactccatagttgatgaaatgaactgtaaagactcttgccatctaggggaaacccaagttgattcattagttgtatcctcattgatgtaatgttttgtttcctgggtagaatgttgacctccagaatgtataatatttatgttggcggacgtatcttgtgcagatggcaatgctgcagcctcagttgtgtatttctgtcagttgcgtcttatagctccgttccgttctctcgacaaacgggtgctatgttaggttctgtcagtgctctgaaatgtaatgtgtttcctaaaatacggtgtagtttctgtgggacaatattaccatcttcaatgcgacaacggtgcatgcaggaatgtaaatggatcgggcaattgaattttatgctatcacatgtagcaaataaattatcaggaaggtttttatgggggtagtactgggactgctcacatccctagatgcagattacggacaaatgcacttgtctgcctgttgagattacagattacaacttttttttttcattcggaggctcaaaactgttacgactagctgatcttgatgtcaaatcttcttcccggacaacca

SEQ ID NO: 56723 - DNA, 1960 bp, Oryza sativa
catggctgtgaacttcatgtggtacttcaccatgctgtctccagtatcatggtagtactctattcttgcagtatacagttcccatgacccaattaagcttttctgatgtgccattttaacaaggtagttccccacaaagagaagaaagtgaggtgtaaattttaagataaattcaaaatgaaacctttggttcctcgtctatcataccggttccgcgtgaatggcagctcttacatcttcatcatccagccatgcattagcaagttcgtcgctctacaagtacatggaaatgttgatttgttaaacacatgaaacaaaatgttttatctgttgacgaaattaggcacccgaattctaataatttggaacgaaacacagctaaatgtttgatctacaaaatcaaaatgatgaaatttgagacatattaaactaccactccaatttacacaccgtgcaggggagtgatctaccaccaagttcaggccacatcgtcatgcgtccacgagtcacaggagcacggagaggccaagagcggccagccattcgctttctcactggaaatcgcttctctgtctcacctagctttctaaaacttgatggcaagctgctgttcttgaactctaattcttgaatttcagggtgatggtagcagggagcaaggatgttgtacttgttcaggtccttgagttcctgcagttgccagtaatggagcgtttaccaaatttgtaggattgtgctacattgttttgtttacatgtgctggcacagggaagttacccaatgcactctgtctatcttttcttggcacagattattaactttgccccaaaatgtaccatggcatgcagtacttgcatcctgcaagaaagcaactcaaatcattttttagctttgttaactttcatcagatttttttctgtgttgtctatctcctctgacattaccagtgagcacaaccctcgtttaacatattcttttagacagaagtatttagacagattcttttactgttttgaggtgaaagagcacaagagcggaggcattgatttcttgacctcaaacaattcggttgagatgagacccatcccatgtgcaaacggcacaaacgaattgaaatcatagtcctgatcagttgctccattgccaattagatatccctgaaaaataacctttaaattgtgagcccaaagacaattttcgcatgcatgtagagttgttgtatgacgtcatctcccgacaaatgaaaatgggaggaccttaaaattgattcttggcttcagatccttttctatccctgtcaggacataaacaacataagtaggaaacttttgataataatagtttctatatatattttttactgacaaactcaaccttttacaacttcatcagctagtgttggaatgtagatccctgcaaatgactctcccgacatgtagaacggatttgactggaactcagggtataactcaaaccactgcaacaatgcatagaatcaacataaaaattttccgaagtgatattgatattattgcaaccacagtagggagtaggtaccttcagaaggaaggtgtgtgcatcagccgctgtttttaggtcacctgtcgtgtaatctgatttattcaacgagtacgacatcccaacaccagcaggggagtcgaggtacaccacgttggaaacctatttagtgccatatttaatcactcacttgatgttgtatagatattttttgagccaaaaaagagttgatagaacgttaagagtgacttaggtactgctcttttcttcaactccatctcattttctgttaaaacggttttcaaactgttaaatggtgcgctttttgcaaaaaaaagattatatatagaagttagttaaaaatatcaaataaatcattttttaagtttataatagttactccctccgtccaaaaaaacccaacctcatactaggatgggac

SEQ ID NO: 56724 - DNA, 2363 bp, Oryza sativa
cactgagtttgtctccaaataatgtggccggactagggatgaaaacgggttagaatcggtatattattttattatttttttcgaaaacgagcagaaacggtcggggaatttccatatttacgatgaattcatctatttagtgccaacttcgataccatgctgacagaaataaaaaaaacaaaattttgaaaacggtaacatcggtaaaaataatattattatattagttttgcgaaaacggtatcgatacggtcgggaaatttccatactgttttcacccctaggctggactggcaggcgccaccccgttttaacccctatatgcagtactgtcccctgagagcagctataataacaaattataagccagatataaacatatgtcgaggagataaaacagtagagacaagagttgcgtcgcagtgtggggctattaaattgattgttcatgatttggagctagtagttagctatactattaaactggctctgattttgagtagatgatacggagccatggaggtccacgcccaatgcaaagtctgtgtggctggctggttgtctggagctgtggtagagaggatttaatttcgacgagtaaattgtaagttgagctaattatttttatcgaagtttttatagtggagtatgatcactctctatttcatgtttttaattaaagttaggaatatttacctaccgtttgtattttggaccggttgtccgcatgtcagcaaggattagaaggaagaagcttgggagagatgggggctgagctcatcttttccggcacaggtaatgtgttgttcatgtcccgtttaatgccagtagatcaagcaaaggcattaagagaggagcaaggtagccccgatcgagctaaggagaagtagtagctgaaagtgtccttgtggagcaatggtagagcttaagctctaggtaaagggaagggccaaagccgatgttgatggtgtggtggtgatggggaatcagagttggatgcaaatccaccgctgtactgcacctgcagtacgtgtcactggcatgtgggtcccacctattccgggcccatatgtcattggcacttaccgcacatgcattacaggagaggatcccaactcatcagagttaggctgtcttggatactccaacaagagttagggtgtgcttagttcacgttaaaattggaagtttggttgaaattggaacgatgtgacggaaaagttggaagtttgtgtgtgtaggaaagttttgatgtgacggaaaagttggaagtgtgaagaaaaaatttagaactaaactcgggcttagatgaaattttggatactcgtggcacgtttttcaaactgctaaactatgccgtgcgaaaactttctatatgaaagttgctctaaaaatcatattaattcattttcaagtttgtaataattaaaactcaactcaattaaccacacgttattatcacatcgttttacgtgaaacacttaatttttatctttatcttcatcttcaggagattcaaacaccaccttagagaaaaataaacattggatagatggtttttcagacaaagacttcgattaaaaaaaatctggcctagccagcaatttacttaattttattttgatgaaaataatgttattattgattaacactggaatgttttttttttcggggaggaatgtatttttctatggctatgattttgttgctatcattatcttaaaaaaatgattttgttgctatacgagaaattaataataagaaaacacttttggagatcatgttaagtttaaccgtgctttacatttataatcggtgggggcaaggaggggtactgcagttaaggcttggcctttggatggatggattttgggtgccaaaaaaccatggaggggttgccgggttaggtgtgggtcaatgattgatctgatcggatcccatcccactaaaaaaattattttcatgtagcacgtgagaaataaattaagtgtacttaggtgcaccatttaattttaatatttaatagtaactccgttgttgacatcgtaaaatatttgcagtcgatcctcgtagttttaaaacttctgttgatgtaaaaataccaggatttaaaatgtgaaaaatcatattaagtagatttgccttaaaaaataactcttccatatgtttttataaaaataagctatgacaaatacataaaaacaacaatattttcttctataaaaataagaaaatgcagtgttagtatgtctaagattattttgtttttttatttaacaaatagcatccaattagtagagtctccagcaagacgatgctacttaggaggatgttatcaccggatccaagaagagatcatcgaa

SEQ ID NO: 56725 - DNA, 922 bp, Oryza sativa
gcggcggccgaccccgtcgtgctctggctcaacggcggcccgggatgctccagcctcgacggcttcgtctacgagaacggtgcgctccaatctccttgttcaccatcgatttaatcgccattgattaggattcaagtgctccattccattccatccaatccattggattaatttgcatattcagcgcaggccccttcaatttcgagcgtggcagcgatccgggtggcctcccaaatctggagctcaacccctacagctggtccaaggtgatagctctgcactgctctgctccttaatctctgtttctgaaacctcttctccgtaatccccgggggattaggtgtgcacctttgtggtctttgtgctaatttttagtaccttttactctttacaaagataaaacaactagtagtaactgatctagtttcttcagatgctttgttccgctatttgtgtcacaattagttgtcacgtagcaggggtgtttatttttgcatatttcataggatgtctcatgtgtctggttgttgtcactgagctttggtgtgctaagcttaagaaaagaagaaattaggtagctgagagcatcaccgacagaatgtgtatagtcctgagaaaactcctctctccaaaagaaagcctaaatttaattgagtgaagtattccaaaaactaaaaaactaagagtgggctcttatgttaaactaccaaccgaagtatttatttttgcacagaccccgcacaccaaaaaaaaaagatcgctcctacacgtgcgcgatctccctcctcgcgcacaaagagaaaacctcgcgggaaagagagattagggttggaggtgcggtgtcgctctccctcaaatgaagagagcgaagcatgcggggatggggtttccaacaaattaggatcaggatagggctgcagga

SEQ ID NO: 56726 - DNA, 7923 bp, Oryza sativa
tccgattgagatatggaaccctcatcttaatcgggcctcaactatggcccgtcacatataagtgtgatccgtgacgggcttaagttttatgccgatataccatggctgtgcgaccatatctcaattgggcgaaacttcggcccgattgagattacttccttgtgacggctcgcaaattccagtcttgttatgggccgtcacagatggaaggatctgtactggtgttaattaatcaacctatttggccagttagggatcgacgttgcacagtgaaatttgtacggacagaaacatccattagcttttgattgtttgtcatcagttttcatctctgctcactgtcacacatgtacttcagagactagatgactaaaatagaatgctgaatgtacatatttatagcatgaaaacccttcggacaaaaagttactccttccgtcccaaaatataacaaccttgtattggatgggacacatcccagtacaacgaatctggacaggggtatgtctaaattcgttatattaggatgtgtcccattttatacaaggttactatattttgacatggagggagtacaagcatcagatggcatggcacgtatgtaacacaggcacaactatatataggtcacaaaacgtaagtccatgaaagagaggggtaaaaccgagttgcagactggttgtctgctctcggttgtgcctggcaaaaccacacccagattctactcaattctactcaaatcatttgcacaatattgagtttaacaatagaaaagctaaaatgtacgggaaaatcatttgcacattatgagttcaatttctagctttgtgactaactagcttggaaaaaaaatattttctgaaaaggtaaaatgtacgggaaaataatttgcacattatgagttcaataaaagaaaaggacgtcccgcaaaaaataaaagaaaaggacgagatcgatcagtgtctaagaaaagattaattggctaggtcgaaagatcgttgtatatacagtttgccctcggtcgtcagataccatatacaaatagggttgtggtttaaactagctatgtctggtaggcatcaggaacatcagcttgctaccccaggagcagagatgtaggtagcaagttaaatcctgctagcctgcatgatccgcaagggatgttctcaatttggaagcggcaattttgcggtatacaggaacacttccctaagcaagagtgtggtactgtggtatgtcatttagaaaaataaaaagttattgcttccagtttgttctaatcaaccaaactagtagcaaactgtgaaataattaacatatatcaggatttgctgaaagcacaatttaacatggatgatggatgacatttgcccacaagtcctctactgtgattccacatgtacgcttccaagtcagcccacgtgcacgattggggcgtgagccaaatctgacttggaaaatgcccaaatttggccagacctttcggtttgaaagggttgaaatggattgaagggtttgatagggaataatttcacaccacaataaattttgaaataaatcctctccaatccttctcggaacatagccttagccaaattgggggaagatcttagggtgggatcctgtgagaattaggagcccacgctgttttcggcgtaacaaataacgtgctggtccaacacaaattatgtacaaacaaactttataaattaaaaagttcatacataaaaggtgtgcataggaactacgcattcgtgtgtgtataaatttcaaacaaattcattagcgttttatctcagcaaaaagacaaaagttcatacatagacctttatacagaaaaaacttatagattcaaattttgttgggcataaactttcatgtgtacaaaaccattccgtgttattgcgcgatggtgctgtgtccatccaattagcacgatgaggccctgcatgttcttctgggtgtgcctatgaaaaatattaaactaaacgaggaaaagtaagagacggctaaaaatgagagagaaaaatcataaaattaaagcaagttggtgattcctgttctactttccgcaattacttgaataatgtagtccagtgaagaactcaatgtgctcgaacaaataggataggcattcatctgctattctttgcttgcaagtagtttatcaatgtatcataaaaaggtggtggactgaaattgtcacgttctattatcatattacgagcaaattgccggggagatagagtctgtgctgaaaatcaatttcagattagtaacttcggtagttgataattagctccagttcagcagcaattcataacgcacgtggaatacttcagatgataaagttggaaaacactgcactgcagcagatgtcgaaagaaaagtcacctacacggtgtgcaggatggaagaactatgggtgtgtttggttgcttgcataccctcatcctggcccatctcaaggaagagtgaagcgacgaggaagaggaagagtgaaggcccaggtggcgatggcgacagtcctccctcgacggcgttcagatctggcggattcgactgagctcgagcatgtcgcctccgcgcgcgtctggatctggcgaatccgaccgagctcgagcacgccgccctcgccggagaggatggtggtgccatcttaggtcagtcctttgcttctatctcaggtcatcgtcctcctcttccctttctgatttcgttgctactcttcctctccaaatcgtagattttgaattttgggggcaaatgaggagggggcggattgacccctgcttgccccttgcacgcgcggtgcaacgccttgcactcgcgggtgcaacccgctgcatccaccgggcctgcccgagataggaagctcgaatcgagcgtttctcctcaacctggctggggagccctttttgcatcagcggggccaggctaaaaatgctgcacaggcaaccaaacaacaggaagttgcatctactgatgcaggcaaagcctaatgcaggcaaccaaacacgccctatatatttgtgcagagctctgccttcttgtatggccaatcaccgaaacagagtcacgaaaatatcttggatatgactggcctgtgtaagcacaagagagaaataccggcaaggcccagtattctgcagattttttttatctattttagaccttttaaataaataatttaataatagacctcccaataaattattttaaaaaacaaacctcttcgccacgccaccagaactggcgtgggctaactaagttgtcctgtgacggtctaccgtgttgacagggtcaagcaggcatcgatatggcagcggggtgaggtggcgtgacactgtcatgccaggcttggtggcgtgccgatgctgagcttgccgttcttcgcggagcagcagacgaactatcagtacgaaatgatggactagggcatcgggatggagatcggcaacgaggcacgacgaggggaggtggaggctatgagaggcctcatagtgcaccgagctagcgtggatcctagttgcgccagctcggattttcgccgacgtggagcgagcgaccgcgccttagctaggtttctcggcacctaactgagcaacgcagaacctcgcgaggaccaaggcgcgcagcgaggagaagacgtgagacgcgcgcgctgtgggcggcgtagcctcgcgctcgcgtgcccctagtgcccaaaatccccgattcaccctcccaaaatcccctcccgccacagatcggattggaagagaaaaggcaagaaaatcttggggattagaagaaaagaacagatcggattcaacaagagaaaaataaaacaaaagcaaaatcatcacaacaagattcaacaggtcggactcctcctgcaacaccacccccgcctgctctgattccgacgacgaggacaacgacgacaaggtggggactcgtcgctcccgccgccggtggaggactcgaggaggactcgctgccgccctccaagaacctgtacgggaggcgaggaggaggaccagctcaccggtgctccagatccagccgccgccgccaagaaccgcctgctgcccgccgccaagaaccgccacgccgcccccgccgctcccaccttcgggaaaggcacggtgacggaccgggaggaggcgtgacggcggactcggagaggagcggcgtgggaggtggtagtgggaggcgaggcctcgccgccgtccgctcccgcacttctctaagcacgcttcctcctcggcacgagtgagggaggagaagcagagcgtgggatatagagggaggggaaaggctcgccggtgcgtgcggtttattgcgatgaggcggcgccgtcgacgtgggaggcgaggaggcgcggcagcgtggcaggagaggaggaggcgcggcggtgcgggagagaggaggagccgaggaggcagtcgcgccgaggaggggaggggaaagggtggtgcgagtagtaggcgagggtagttgagagaaataaatgtggggtaacgcgcctggggtcacgcccactgtgggcttggtaccctttaccagtgtctctattcaattaagccacacaactagaggtgtttgcactgtgggatgagtgtctctgggccaactttttaggctagggatacgggccccatggcttgcactgtgagaggcctgatacgggagtccatggaggggcagaagaggagggaggtgcgggcatgtgcaggagagtggaaagggaaggttgtacgagtgacgctgtgaggtgggtcacgggtcaccaaccttgaccggttcatccacgaggagctgctgtcctgcaaggataaaacagtcacggtaaaatatgcatggcagcatttaatattgtacagtatttctagttggaacgcagatcaatattagaatattcaaccaagtaaccaagtagccatgtcatgtgttttacttagtactttctctgttttacaatgtaagtcattctaatattttccatattcatactgatcttaatgaatctatatagttttataatgtaaggcattctaacatttcccacattcatatgaatattaatgaatctagacatatatatatttatatagattcattaccatcaatatgaatgtgagaaatacaagaatgacttacattgtgaaacggagggagtatttcataagagcatcaagttcagaacttcagatataatgttggcgttttacatctcctctctgcagctacattatcggaagagaaatgcacactactcctactagaaaaaacgtttttccaggtgggcaaatttctttattccaaacagccaaacgttctgcctgcacctaaaggcctgtgaaaaaatattttttgcaggcggccttcggacccgtctgtgaaaatatttttgcaggtggactcttctttctcgcatgcagcagatccaaccgcctgcgaaaataatcccaatgagccaaaaaaaattccctgccaccaccccctacccgccgtcgccctaccagctctggccaggtctagggttagggttttaggagggagagggaggggagggaacccgcgctgccgccggtcgccgccactgcagggggccatcgccagagctggaagggagggagggaggaagttgcgtaccaccaatgccaccaccgctgtatcttgaagaaagggaggaagccgcgccgttgccgccactgccctaccccctccccctccgggcggatctaggaggtggggagggaggggagccgccgccgccaccgccctcccctctcttccctccagccgaatctgggagagggagggaaggtgagccgcctccacaccgccaccttcgccctgcgccaccaccatcgattgggtgaggagccacctccgtgccgccaatgtcacttggagaggagccacctccgcgccgcctcagcttccgccaccaccactgtcgcttcctccactgctgctaccatcatcgtgtctgcctccatgccgcgctgccgcctccgcgccacctccacgtcacgttgtagtcgctcggaactgggactgggagtgacgaagggagggtagggtagctgcctccacacctccttaatgccaggccaccgctgctctgatctgggactgggagtgagggagggagggagggaggggaggtgagacatggaggagatgaggagacgagggaggtgaggagatacttttcgcaggcagacctcttaagataccgcctgtaaaaatgaccacttcagaggtatgcctgcaaaaatagattttcgcaagcgaacgataatctcgccccacggttctcatttttccagacagccatttagctccaagaggcatgcccgcctaggaaaaaaatgccatcatgtgaaaaaatggtttttttagtagtggcacggggaaaacaatttgttttgcttcaacccctaattattaaaaagatatgtgctaattatatttattttttatctttaccgctgactagctggtaaatcatttaatcacaagagagaagagatgtcagaaaaattatttatcttagtggtgtccaatttgaactgatatattatttatctaagtgatttctgtattagcatgaggatagacaaacaaaataaaataaaaatggccgtaagcccctgactcaatttctttggcttgtcttaagctgccaactaatatttaggtccatattccgtctttggttttgtggaagaagagcgttgaagctccttcaagagcagaaaactttttgcatttattttgttttccaaagccccgaagttcaccgcaccgaaggttggaacaacaattactcccccatactatgtggtcttcctcatgacctaaattaccttcgaagtcgagttcaatggtccaagatggacacaataaaattcccaatgcttcccaaatctaagtgcgacgggtctggtgagaatactgcagggcttgtggccatcggtctatgaatgatatgctatgagtgcagggtagagacgcacagaatatgaaagcatatgcaagagcttatactacatgtgacaacgtgactattgtcagaatcttgaaattgcagcctaattagttaagctaccaccaggacaagctgaaataactactgtacatgatttggggatggtgcttgcccacggtcaagttacagaggtacatattttggatcatgtttagcaatgccacatttatctcatccaggttatttctttcataattaaattgatcagagatatgatgcccatcatttgaacctctctaaacatttctaccttcagctaaaataacatacttcatttcgcctcttatagaaaacggagtggatttgctgacatgtgttctctccattgatagtgtcttacttttataatatgaaataaagggagtaacatttttacgaagctaaaaaaattgtgtgtacaaagacagggaggggatctatccaataatgatgatttcctgttaggacttgccaattaattatctattatatggttaagcactttagtgtaggcatttaaacttccaacaaacactagctttgcggtaccaggtacatgcctttattcatggtgattaccacatcctgagcaatgaatagatggtttttacatgctagcacgttagagcaagcttacacagcaacataaagaaatgcaacgaacgtttcaatggttcggccattccaatagtcgcatattattgttggttactaattttacctctccactttaatttagaatactaaaatgatttatgtagccaactataaatagtaggcaaggaaatattcttgtctatggtcaaaacatataaataggtttctatgatttaccatatcgatataaaatgcctaaaatttatatgtactgcgatgtaatttctttgggctgcaggaat

SEQ ID NO: 56727 - DNA, 2478 bp, Oryza sativa
ttataaatagtaatctatccctcctaatttaccatgtaatacttacccaaaaaatattggctggaataagccaagaaggcatacgcacttacagagttaacaaccacaaacgagaaaagaggaaatgatatacagcaaaaaagaaaaaaaaaacatactgcatatatattacttcacttcctctgttttttttataacggctaatgtcaaatatttagtgaaactatcgaaagaaaacaaagattttaaactgatttccaattatacttcctatggacttctttttattttctttatgatgatcaacgtcaaatatttagtgaaggtggtagtaagaaaaatatattacttcataaaagatgcacacccaaaaatagatcgataatataatagaaaatatcaaataaacctatcatttcacactacaattgttgagtatagataaattttatttgcatcaatgggcctacattgatagttcaagatgaaataatgagtaactaaaatattacttgggacatattgtcagaaacacaaataaaaaaagtattgtttaaaaatcacattttttctcaccaaacacagtcaggattttagccgttaatgactcaatctacgcttttgatttgtacatatttttttaagtacataagtaataaatttaagattgagttctaaagtgcttatcaaattggctctccctcatttatcttgagcatgttccgaactattaaactgtgcatgttttgcaaatactttttatactttttttaaaaaaaatctatttcatgtttgtaatattaaatacttaattaatcttacgttgatgacctacatcgtttttcgtgccctggataagctcaaccaatgagatcgaatgtagcctaagtaggagataaattagattatttactataaaatttaaaattaaagaatcaagtgaactacattattaaaaaatcattactttttttatgaaaaaaacaaataagttttttttgtctcctcgctatttcttagctattaaactaaaacagaaacaaacaataatattggatttttctagaaacacagcacgcgcataccctaccccttgagtatcaccaaaaggctgattcgacacattttgagatacgatgttaccatgggcgtctcgatgtcgatgggtacgtcacctaccactgaaacattttgagatacgatgtcaccataagcatatcgctgtcgacgggtacgtcacctaccactgaaagaataattagttgtaaatatgagcacccgtatcaagtataggacttgaaccaggtgggcaagttccaccacaagaaacctaaccaattgatccgctcactttacaataacgttggatattaaaacaaccataatttttaagttacattgttggaatacttctatgccttttaaaccggtgaactattagttatagctgttagatcaatcttatatataagttaagcatgtattcatggtacatgacatctccaaaatattactgcacaattgtattttatcattatcatatttaagttaggttgcatggagcctctcacccaccctacatgaaatgttcatagatgggtcgcctcacaaactacatcaatcgtattaggctatataaacccatatatttagtggagactcatgtcccactcaattcatcctttaatgaactattacaatagatatgcaattaaaaaaaacaccttactttactttcattgacacgttttctaaaataaaaagtctaccttattttcaaattgtaaagaagactataaataattgcttatagatattacttaagtatgatataatataaaactaatttagaaacttattaagcaattaatgccaatgaaaaaaatttacgaacaaatcgcgacagaagttctttgtttaatattttgctcttatacttatctcaaatttagtatacgatgcatgccggcgcgaatacgcgggctaccttcttcctagtttattaataatgaatataagtcagtctggcctccttgaactgtcaaaagaatagtgtgtagtttactatattaattatcataaccatatttctctagcaatctgcagttgtctgtaccaaatgctaaatataaatgcaaccttttactgtctttgcctctggatggatcatacgtcctttgagtagtaccgtgaattagtgttatgtatatgtttatttcttgcactgatccctaatctcagttacgaaccgacactgatgctattttctatggtagtgacagaatcctatcagacagtggtagttattactttgtacgtatcaaactagtaccaaaaccatattaatttatcaacctatacccttccggcaccaactttgttcgtagcacgtaggctgtgtttgttgtgggtggttgggaaaaaaccttctccgcacagaaaacggcgcggtctattagcgcgtgattaattatgtat

SEQ ID NO: 56728 - DNA, 3621 bp, Oryza sativa
agaacacaaaccttagacataattctatggctttgtatcgatcttttcatagacctgcaaccataaatattgtgcaagatatatataaaatgaatttgcaggaactccatcaagaaaacctcaggtctccgttcaataaaattccttgcagtcatggtcatcctctcctacaccagtaccggtcatccaacacattcggttttgcattgggaggcattgggaatcctagagatactaagcagtatttgttggtttagcttgcggaggctataacaaggttgattagggtagcactagctagctgctgcattgtttacaacatagctagacagagcaagctagccaacaactactagaaaatggatttttggctactgttccacgttttctcgtgatggctaggaaattgctttcaccaaaaatgaaactttgtaacagctaggatcgatccttcatggaaactgctcttttcgtacaaggaaggataatccagtcaacaaaaatgaaatgtaacacgaaaggtatttgctataaattttttgacatatacttatagataaagcattttcgtagacgtggagggtttttttccccagacggatatgaccctcggagctaaatggccgcctacgaaaatataaaccagggagcttgttgtccgcctgtaaaaatacttttttctaggcggaccaatcaagtcctcgtaagtggtccgcctgaaaaaaatatgatttttgcaagcagaattttacgtggtctgcctgcaaaaataatgccaacaaaaaaatatctaagtcctcgttcttaccatctcctccaccatccttatccttatctcctccactcatttccttctcctcctctctctctctctaccagcagagctgctccgcgctctagcctccacctttctccaccaccgcctcccctcttcgccgcgagtgccgccgccccacctcgccgccacggccacagcctccccttctcgccgcgtcgcgggccctccctcctcgccgcctcctccttctccaccaccgcctccgctgtctctgccaccgcctctgcagccgggctcccctcctcgacgcttccaccgcgccacctcgctcctccgccaccggccgtgatgcgcgatgacgacgacgatgatggcgacgcctatggatctgccattggcttggcccgggcgcgtggatccgccgctggctggtctcggggaggggaggggagctggtggcgacgaggaggagaggcggcggctcacctcctcgctctcccttcgtcgcaccgatgacgatggcgacgacggcgccgcgtgtggtaagcccggacagaggaagagaggcagcgacgcacgacgacggcctcaacgatgtcgccgccagctgttggggaggccagcggacggaggaggagagccatcggccagaggggaggccggcggcggtgccttttttttttatttgctgtgatgtttttcgcaggcgggtgaatctaccgtcaggcaggccattgggccgcctgcaaaaatcatttattttcgcaggcctttgcttctagacggttcgttcccccatgcatctttcccactgagttacttgtctcttttgtttacatgagttttacgcgcaaattgcagtctaatttttttttaagaattatacagtacaatgtagacattcacaacacatgcacactcacccctataaacatactagttatattgtaattacttactagttacattgtagttacattcgtactattaaagtaaataaaatctttgtgtgtgtgtctatatatatagtccccaccaaccgagcaagctaaccatgttgggtacgtaataaaatattatagttacaatgtagttatagtataattacaatatagttatactattatatttgtaactacaacataagtaaacaaattctaattataagcctgttatgaattttttggcagcccagtattgtgggttggtccatcagattgaggcccattagatagttaccgtggcagttactagtgagcagatcttatccaagggttaaaaaaaaacgtgatatatggactccaaaaatctgtcgatagacagctatgtagtcctttccaaccagctcttatgtagttttcatcaaatcatatctctcaatccccctcccactcctccactatatctcattcattagggccatcatgttttttttatccgtaatctcttaaaaattttaaaaatatcttatatttatggacagagtgagtacacaacacgaaatatcatgacaatgaataggtgtgagcgtgactacattggtgcatatatataccgatagtgtagtcgattgcagtgccaaataccaacatctgatacacgtctagcatatcaaagccttataccagtatatataccaccagtccaccacatcgtactgcaggtgagttccagcgttctgtctagctaggttgaacaaattaaaatattgagacaatacttctaatgttacagtaccaatatttttttcttccaattcaatagaaaacaggtagctctgctgtcccagaaaacttgaatatgccacccagtttgccaccatttggtcaggcttgtctgaattactgaatagaaaatggtagctatgctttacatcatgtgcgtgtgtgttatatatgcaaggttatattattctcattggtttggtaggcatcaggaacatctgctcgccatgcaggaagcagaaatgtaatttagcagaggattattgcgagttgtagtgatgcaaaggacagagctggaatggccttagtagcactcttcaaaatgtgccacctagaaagaaatagggcatatcgactgctccatctggatcagtatcatcgctatgaggcaggagtggaagccgagatccctatgtaagaatatgaagaaagatgacgatctgctaaaacctagagacgcgagcgtgatcaaactagttgttctagccagctgaggctatcagcttctaatcatgaccatgaattaacatcaaggcatgtattaaacttaattggaatcgatatcgtaattcttacttttgccttatttccagttccattttttttattttgcaggtatgtgttaaacttttaaagctttttttatattcacttaagctttttttatattcacttaagctttttttattttctgaaatttgtgacgcaaaggacctgtaattgacggttatatatgaccactcttatacattttcatttgaaaaatggctttctcacgtgaaactgtctgcgagtactttgacatgcaaaaattcccatttcaaataccacaatgttatatatgtgggagaaccattaaccatctccggctttgaattatcccaacgcgtactgaggcatatatatatatatatatatatatatatatatatatatatatatatatatatatatatatatatatatatattacacacacacactaattaatgttactggactcggtctgaaaagtgtatttacttcattttgttgatcaaacaacagaagcaaccgcgtcatgcatggaacatatggcaaattactatgatagcagcaatggtttttttaatactatcc

SEQ ID NO: 56729 - DNA, 4726 bp, Oryza sativa
agatccaatatgagcttaattcagatagggatccgaataggagtcctacgggccttggaggcccgagtcatggatcctatatattcgtgaggggtgtgacaggcagaggtattgtatcacgtgagaaaccctagccgccactctccttcccgagcaaaaccctagccgcacgcgggtgctagcatttctgcgcgtagtgttctgtccctatatgtgtggataccggtagaggcgctgctgctttgcggtgctgatcagcgtgtgtgtacgacatggagaacgcacgaggaggagaaggtcgagctggtgcgatcgactacttcctctacatcgacgcgcgctacatcgcgagggttccttcgacttcttagcactttcttccgctgctcagcgtgtcgactggtaatgatctatgatctaatgcttgcatggttcctgatttacgcgatagaaaactttgatttatgctgtcgtagcctacgcgtatccaaacacgtgcgtgtgttgagagatcaccgtagggctgtggctgacttaggttggcttatggggactaggattagtttatatattgatgtggaattgcctccagcgaatgagacttgtaattggagtatattttaagtggtaaccatatccagtgaacccatgggtctataaccttgtccccacctccgactccggccctacagggtgaactgcccaacacctgatcggggaaattgccactcctggtaaaacatggtcacaaatatctaatgcaacgtttggctgacaaaatcttggatataattgaagaattttgtgtttccttcgccagaaaccagtcaagctctttgagaaattctcagccatctcatctgccagcgaggacatgcatgcgcaacaaattctctaccatctcgttgacaaatcaacctgtgtgagacgccttcaaattggttctctacattcaactccgtgaagcagctagcatcttaatttttgagattgctgtcgtcgttgatcactacctcctgagatacacctgccatttgatagcaggaaaattgctcggttttgcaatgcacattgttagctttcccatttgatacttcagtgggtaccactctgttttgtcacaactctatcgaaaataccgaaatttgcccctctttaacctctcttcttcgcacccaacccttttccacgtccaaactccagccagcaaccgctgccatgtggaccgcaccaatgcagttggctggccaatgctacacctactctactaccacttgcatctagactctgctcgccatccctaacgtggccgagctcgagctcattccagtcgaaaaatccatcttgagcaattgtcgaccgaaacatgtgaaacttttaggtctccaatttaaatcataatttgaggtaaccttgttcattttgttcaaacaaaacaatcgctatgaaataatgcaaaatgaccgttgtgtaattcatgttatactatgaatgaaaaaattgagtggatggtcgagctggatgtagatgccgcagcagagtgggtgctgccaggcaatgatgggagtggcggcacctgctggacctcaacatgtggttatgctagttatgcctagccaaagttagggacagttaacttcggattggtgtcaaaataaacatttttaaaatttggcaataccaaaattttgataaattgacaacattatcaagatttggtaggattgactcaatataatttgaccaagatttcataggcattaccaatatttggtaacaataaactaaatataaccacatgattaccaattttactaaataatggtatgctgagaaagacccaaaaatgatagagaatcaatgttgaaacagggaaatttggtatttttgatagagttataccaaaagaagaggtaggattgacatttttacaaagccaacgaacctggtggcacacgagcttacgcttccgaacagcatagcgaacgaacaattttccatattgttgtcagtgcgcatgcttttcttttcctaacaaagaacggaggggaagacagaaggtgaaatatccttgacatggagatcagggtggcatagggtagctggtaccagatatatacaaaagttctcaacagagataagacatgtcagcaaatccaccctgtttatgagtctagctaggaagattatttgtaatagatggaatgatatctctgttagttttagcttaaggtagcagagtttagagaggtcaattaagtaatggagatctccatagagcgatttaattatgaatgaaatagctctgggtaagatgtgaatgtgcatttctatacatgactcgaacatgtatactctgaaatcttgtacagtggtttattttggcttgtgctgcaggtggtagcatagttaactaggctgcagtttgatgtttcatacagtagttgtcacttgcagtacatgctcttgcatgtgcttctgtaccagctcagaccatatatataactgacggagcaatggataggtcacgcccagaacccagatggccacaacccctgcactattctcacctcacaagtcatgcttagaattgggaagcattgggaatttcattatgtctaattctcactattgggctggaattttgaggcaattttgaccagaatctgcagcagcatgtacgagaaattatcatttcttacaactggcgaacttcggatggaaaaaagttaattaaatggaatattatttctttttttacgttacatgcttcagcgtttttcttccaaaaaaccacagacggaataggggcgtacacattggacgaaatcatcctgtttataatttgataacccataaaattgcccagaggccacgtccattttatctctaccacatattttttaaaaatagatgatgtcgttgattttcatattatgttcgatgattcatcttattaaaaaaatcggtgtaaatgtgctaaagtatatgagttatacactggtggagaaaccatctttggtcggtcggccaaattctacaatagtcccggttccaataaaaatcgggaataaaaatcatctttagtcccggtttaaaagttaaagggtactttttgatctttagtcccagttggtaacacaccaaccgggactaaagatcatttttagtcccggttaaacaagttgtcagggcgtgtcaggccccaattatttttagtcacggttgatataaacaaccgggactaaagatctatctttagtcccggttgtttataccaactgggactaaaatttaccccaagccacgcgatcttttatctcttcgcgcgtcgatctgtgtctccctcctcctctgtcttatccttagcttcttcccatccacttcttctcctcacttcttctcctcttcctccttctcctcctccccttcccctctcctctgtcttcctggcggcagaaaggggcggccggcgcggaggcccggcggcagcggttgcccgcgcggagggcccacggcggtaggcggcggagacgcgaatggcctcccccggcggcggcaggcggcgcctcgggccgcccggcatgggaattttttttctttatttcctttttaatgtgatgtgaatggctgtgatttgtgccatctgtgatttgtgcgatctgtgatttgtgtgatctatgatttgttcgatctgtgatttgtgaatgataatgggagatatgtgatatgtgaagtatctatgatttgctatttgttatttgtgatttgtgatgcgattgtgatttgttagttttataatgatttggaaatactgaacatgagaaaagaaaacaaaggaaaaaaatctttagtcccagttggttacatcaatatgtatctttagtcccggttgtaagggttacggataaggtataccctctatccttgaatatacgctatacatcgatatggtatatctgcgcgtatacggacgttctatgtatacgctaaggaaattcatcacggagtccacagatggaaagattcctacccggataggactgggtcgtcactgtatcgtgtagggtccgatgtctccgaatcctacttagaaaccacctgacctgcggtataaaagggacccccgggaggacctaaggcatcgaatctcatagccaggacaaccaccacagcctacgaagccggagcctacaggagccaagtcgctggtgatctagtcggaacaactcgactacgatctcgtcggtatcatcgagttccactgtgccctttgtaatctatgacttccatcatataatcccatatcaactggattagagctattacctaccaatgggcctgaactagtataatcactgttttttgtttgcttgatgtcgtactacgtagatactcgtaccagcgtaccccaataccctctatatccggtctgcgggtttcccccgtcgacagtgtcgtcttcccggtttataccacggtgccgatctcgactggtccatcaatgaccggaagcgagaacgccgtggctacaaccccggacgactccatgtcgaaggatcctcccgcagaagtggagaatggaacgtcgacgacatccaagcccgaggaggatcctggtgcggtcaaatcttgtccttccgatgagtgtcacaagccgataaggacaacttccgaggtgacaaggtcatggtgtcctattcacaaaaccaggggctgcaggaat

SEQ ID NO: 56730 - DNA, 11467 bp, Oryza sativa
  unsure (1)..(11467): unsure at all n locations
gtttttctcaacgcacaagctgagatccgcgcctgcaaagagcgtggaattcagcgcacttcgccgagtcgtgatgtctatggttctattcataagacaaagaatcacgacctctcaagctgcaagattcttctcaacgccacgaatctctcctagagatgtgaacaaggaatgaggaacgatggtcatctcagaccgattcgttggggtgatcgacattgatccccacgagccatcagtcctacactcgctcaaggaccagggttcatcgttgacaagcacaccacgcgatgtgtttgctattgaagggaccagcgcgtctgcgcgcgccgatgcggaagcagagaatcaagtggttacaccggcccagcatattggggccatcaacgcaatactgagggaaaccccttatgatcccgttctgaacgatgatctcgcacggtagacagaacgactacgggaatcagtaaccaacctcaacaacgcatttgaggaggccgctgccgcggcacacccagaacaaccgccagctggcggtgcaaatggcgcaccactagaacagcaggcctcaccccgacaagccacccctccacaccacggcaccagcgatctccgtgaccatttaaatggccgccgagaagcacgacgcgcgcaagacaacgagaatcgttcccgacatcgtctctcttcacgacgtcgagagaacgaagagcgaggaggacacccgagcgagaaccgagaccatgataaccgccacaaccaccatgaacgcgatgatcgcgaacagcggatgccgggcgatactggtcccggacgccgccatgacgatgacgatgacggagatcggcgccggaacaacaatggtgtacgacgagaggattcccgagaacccgggcgtcatcctcggaatcgtacaccgaagccgagtgacccatcgtcgtcgtcatcatcctcttcatcctcatcatcagagagacatccgcgaaggacatacgatcgccgacaacccgccgcccccagcgccaggtgtagagctttcaaccgttcgctacgtgatgtccgacggcctgagagattccgactgggagcaatagagaaatacgatgggagtaccgacccagaagaattcctacaggtctactccacggtactctacgctgccggagcagacgacaacgcgttggcaaattatttgccgacggcattgaagggttctgcgcgttcatggctgatgcacctcccgccctactcgatttcttcgtgggcatatctgtggcagcagttcgtcgctaacttccaaggaacttacaagcgccactcgatcgaagacgatctacacgcgttgacatagaatccaggcgaatctttgagggactatgttcggcgctttaatgagtgcagaaatacaatccctgaaatcaccgacgcctctgtgattcgcgctttcaaaaccggtgtcagagatcactatactacccaggagttggcaacaaggtggatcacaactactcgaagattgttcgagatcgtcgatcgatgcattcacgcagacgacgcactgagacgcaagaacgacaagccgaaaacggggggagagaagaaaccagccaaggacacacctgaatcaagcaagaagaaaagtagcaagagtgggaaaaggaaagctcaagcggaagtcctcgcgtcagaatacgagcgccctcccaagcacccagacacacaaggcaacgtcacgaagagaatatggtgccctatacacaagtcagacagacattctctgaaggattgcctagtcttccaaaagtcgttggaaaagcaactggcattagagaagggcaagcgagtacgtgtagtcgagaaggccgctgaggcaaccactcaggactcggactcggcacacccagattccgatctgcatgtctcgcacatgttcggaggttccacggtgtactcctcaaagcgagaatacaagaaagtggagcgtgaagattgttcgacatggcagggggctgcacaaaagatgaagtggtccgaacagaagattgagttctcagatgaggaccatcctaaggctgctgtcatcccaggacgatatccgatcgtggtcgagcctactattcggaatatcaaagtcgcgcgagttctcatagatggcggcagctccatcaacctcctcttcgccagcaccttggacgcgatgggaatcccatgaagcgagttgactcccaccgatcaaccaggtgcacaaagactacaagtgctctagcccagagttatccaagtacctcgcggaggtcaggaagctggaaaaaagatttgatggaatcgaggtccgacatgtataccgcaaggacaatatcgaaccagacgatctggcgcggcgtgcgtccagacgggagccactagaacctagcacctttctggacgtcctgacaaagccatcggtgaaagagtcaaacgacgaaaataacacagtcgcctccgacatcagctcgggggctacataggtagaacgcgccgttgccgacatcgagaccacagacgactggcggatcccactcgttaaattcataagtagcgatgagttgcccgacgacgatgtagaagccgagaaaataacccgctaggccaaaatctactgtatgatcggcaatgatctatacaagaaggcgccaaacagggtacttctcaaatgcgtctcgtccgacgacggcaaacacctcctcgtcgacatgcacgaagggatctgtggatcacatgccgccggtcgtacattggtcagaaaagcctttcgacaaggatttttctagccaactaccctcaaagacgcttgtaacatggtacaatggtgtgaagcttgtcagtttcatagcaaacacacaaagctaccagcccaagcactgcaaaccatccctctcacttggccgttctcgtgctgggggctcgacatactcggaccattcccacgaggacagggtggctacaaattcctgttcgtggcgatcgacaagttcaccaaatggatcgaagcaacactcacaggggaaatcaaggccgacaacgccatcaaattcattaaagggatattttgcagatatggattgcctcaccgcatcataacggacaacggcacccagttcatcagtgccgacttccaggattactgcattggactgggagtcaagatctgcttcgcttcggtctctcaccctcagagcaatggacaggtcgagagggcaaacggcatagtactacaaggaatcaagacccgtgtctacgacagactcatgtcacatgacaagaagtgggtcgaagaactcccttctgtactttgggacgtgcgcatcacatcgacaacgtccaataaggagacacatttcttcctcgtgtacggctcagaggccatgctccccaccgagctacgatatcagagtacacgagtacagaagtactccgacgaggatcaggaggaacagcgaaatgacgatgtgaacctactcgaggaacatcaagaacgagttgtcgtcagagcagctagctaccaacaggcccttcgtcgataccacaagaagcgcatccgagcacgtacgctttcgatcgacgactacatcctccgacaggttcaaagccaagcagggcgaaacaagctctcacccaaatgggaaggaccgtacacgatcacgcaagccctacggccaggcgtattcaagattgcagacggcgatggtcgcgagttggcaaattcttggaacattgatcaattacgtaaattctatgtataaatcaatagcatccattcttgtaagacatcttacagcttcaataaagccttttttcaggaaaagattacaatcaaagtgttccttcccgatgatcccttaacccgatgacacctagcgttgaaacctatcctcatgtccctttacgccatcttgacaaggcctccaaggaacctaagggaacttcggcttgggacgcccagagccgataaggccttgtcggatcctgtagagacgaaagaccatgtaagatctggtcgtgtaagagttctcgccgtgcatattaaccaagccgtgtaatcggaaatcgggttttccaacttcacggctgggggctaggatcagtgcttgttcaaccaaggcaggtcaaaggtccaagagccatatcttccaagaagaattctccgatgacaaggctgggggctagggagagtgtatgactcaagtgactgatcgaagtcacaaagtgagaagacactcgtacacacagcatccagagtaagaaagcttagttagatagatttcctttctatttcacaagtacttcttacaatccgcaaaaaattccaaaatatattacactttttcctaagatatttgtcacagatatataaagactaccaggaaggccaatgccaatccatcgactggaagactttctccgccagcggcgccatcgacttcgctaggttgtctatctctgcgggagtcctccgagaacgagaaaacccttcgcggatgaactcgaggtgcagttgcggacgacgatctcgtatacaggccagcacgtgccctccgacataccggctcgatcgacggcactcctgctttaggcctcgtcgatacgcttgccgatgccttcgagctgagcgcaagccccattcagccacgagatgtatccggccgctgactcctcgggatcaccgcgaggtactcggagttccttgcagactatggccatggttttgcaacaactcctgaggtacgagttgaaccacacctcgcgacctcggagtgcttccacggcccgatgcttcttgacttccagcatagtcctctcgagttcggcgacctcaaacttcgtcctccagtactagatgcgacgatcacgatcggcaagcgcactctcaaggtctgctcggcatggaaacgactaagttaagctgttctcctctttcgagaacacagcaaattaagccaatccagacagaagagcaaaggggatggaaacaaaaagaaccaacctaaggaaggcgtcgccatgcccatttccacgggcagattctggtccacgtcgtcctgcggcacatatggctcgagcgcaagtgccggaacgattacaggcaactcaggctgcccgcgctgctggacatcctcgacatctacatctgtacaaacaacaacaaagtacccggaatcaaaatgctaaagaaaactaaggtgatgactgcacacacaaaggcagttggaaccgacaaaagttttacaaagcataattgattaaggagtacagccgaactgaagtcctactcttcaaaaagtgggagaacagactctcctagatcactgacttcttccatcacgtccttacgcgcgttgttagctgccccctgatccaagatcctctggaaatcgagttcagggtgcgacaaccttacgcacgcgaggaagtggcacgccccggtgtagatcccgttagacgtctcctccccgatcctggccgcatgcttggagcgaatcgcctccatcgccgtcgccagtttcgcgagcgaagtcgtcagcgagaactcgtcgggattcgccaggatggtgctcgtgacaccgcactccccggcgagctggtgtaggcctgtgtaggtaacccgcagcgaaccacggatctccgacaggttgttctcgagctccgacatgcgctactcgagcccctgcccttgtcgctcgttgccggccaccagctccctcatcttcttgaggtcctcgcgaacctctgccaggtcacgcgccagcttgttggcacgttcattcgccgacgacgccgccgccgccctcgcctccgcaatctcgcgacctatgccgcgagcgccggcctggaggatgcgccccatctcgacttggagctcctcccaggtgaggacgtcagcaggcgggcctcgagcaggcacaagatcgcctgcagggccgctgggcgtcgcctcacggctcctgggcatgactatgacatctgtcgaggccactgcaggagacgcactggagttccctccggacccatcttgcgccgctttcgcccgcgccgccttgcaaaaaattgccataatggctatcaagacaagctgccagaattcgatcaagtgaaggacctcaaatttgtccacttacttctcaccaagtgtcaccagcctctgccgtcacggaggcgggggagacgcatccgatgcctaagtaaaacgagtacggtgtgaggacaacatcttccgactacgcaataaatgaccaaaggggctcaccgatggagtgggcgccttccgatgattgccgagcacggaggagaacttcctccccttctccacatcaatgccacctaatggggaggggaggggggcggttggaagatctagcacctatgggccattactatccaacaccaataagattgtatgtagtagtgtgtaccctgacccatctattccttgttgatagcaacacctcatggatgccctgtcaatatatctatgtatatattataatagaaaatagttgtcaattttttttaattgtgtcctcgtactatcaacttggagtgaatatgtcagttttgtatgatttgactctcctccacatacaccagaggacaaatatctaatgccttgtttggttcacataattcttgatagaattaaactcagcatatatatggtcttgcatgtgcttccatagtgtgcttctgtaccatctcgtaccacatataatcaaattaagaagcaatggatggaactctctcataacccgatggccagaagcccagcactactgctacctcacgaatcgcgcttagggttaggaagtatcaggaattataacatgtccatttctgatcattttgacaacgatctggactggatagtacgtaggggggcattgttttttcaaaccaaagagttttttcaacctttggtatgctgaacttcggacttttggaaagaaaaagataaacacaaaagatttctgccatcgagatgtctagcttcaacgttgttcttcgatcgccaaatccaaagacggaatgtggacctacatattagcagaagcattggcagcttaagacaagccaaagaaatttcatttttattttatttctctatctgaatgccaactcttctctcttgtaattaattaattggcaattctcctgctaagttacagaaatcatttccacaaatatactggttcaaactgaacatcagtatgataaatatattttttttatgatgtcaacctcttctccatcataaataactgttcagcgtaagaaatatattcagacaagtatgtacttttaataattagggtttgatgggtattggaaaatgtcatgccagcgcccatagcatcagcgacaatacatgatgaagcccaacccaggcgatccatgcgagatcggcggcccacgagcaagtacgtgtcgaatgagtggacccggtagctgtcgaccgggccactgccagagagggagcgagatcttttggcacatcgctatataagatcggcagagtagagagaaaaggaatcgaacattgtagaaacaacaaaatcctcaattcaattcaaatctctctctctctgttctactgcttcttctgttctttctctgttcttcctcaattcctcttctcaattcacaaattcctcttcgatttcccacggattcgtcttcgtctcggcgtgaattccacaagtgccgtgacatttggtatcagagcagcgatcctggagaaaccaaggtacacttctcgtttgcaatcgcaggttgaggcaatggagaagcagaatctcgatttcggcaagttgctcggcgacatccaggagtcgctggtggcgttgaacaacaagcaggcggagatgcaggtggcggtggcgaagttggacgaaggggttagtggatggcgaccccaagttgaagccgcgatcaaggacttgcgcgctgaggtcgacgaacttcgacagcagcatgatgccgccagcaaggagaagcaagctccatcagcggcgctttcccctcgggtcccgttgacgggcgaggaaaggaaggtgccgttgttgccgactccgccaccatcgtctcactttggcgcggcggaaggcgggagcaaattggccgatggccacggcgttccactacatcaccggaggagggcatctagagtggttaccactctgatcccaactccgggcaagggtacgttcaatgtttctcctgtgcctttgcattcctgtgaaaattttggttcggggtttggggaaatggatggagaggttgaggaacgccattatagccatagagtgcctaagttagattttcccaaattcgatggtaccgacccacaggattggaggatgaagtgtgagcattatttcgatgtgaataacacgtatccggggttgtgggtgcgtgtggctatcatctacttttctgggagggctgcgtcttggttgagatccactaaagctcatgttcgatttcctaactgggaggatttctgtgctgcgctatctgataagtttgatagggatcaacatgaactgctgattcggcagatggatggaattagacagtcgggaacagtgtgggagtattacgaacagtttgatgaactcatgaataagttgcttgtgtatgatccagtagtgaatatgcattatctgacacaccgtttcactgagggattatataggaaaattcgtaatgttgttttacttcagagaccccgagacctcgagtctgctttggctgttgctttgttgcaggaggaggtgctggagacagctgatgaagtgactgggaaggaagttaagaagagtgaaggaaattctctgggacgttcagttgcaaatcttagaggggcatatcctttgcctactcctccaatgaggtctgggggcatcaacatgggcattaaatctgaagaaaagaaggagtctgaagtaagacgttcatcagggacgaatgagagattatcttctctgaaggctcaacgtcgtgctcaaggtctctgttacatatgtgcagagaaatggtctcccacacataagtgttcgaatactgtgcaactgcatgctgttcaagagttattcacagtgttgcatgaatcagtagaggacgggttgagcacaacagatcatgttgttgagcaaacattaatggcagtttcactacaggctgtacagggaactgaaactggtggttgtatgagaatgctagggcagatccaaggcaaagaaattttgattttagtcgactcaggcagctctgccagtttcatcagtaaaagggtggccagcagtcttatgggggttctagagcaacctgtgcatgtgcaagttatggtggctgggggagcaaagttacattgctgttctgagattctgaattgcgagtggaccattcaaggacatgtgttctttactaatctgaaagttctggaattgaacaactacgacatgattttgggcatggattggctgatgcagcacagtccaatgacagtggattggaccacaaaatctctgataattgcttatgcaggaactcagattcagttatatggtgtaaggtctgatactgaacaatgtgcccacataagttccaagcaacttagggaacttaatgacagaacagcagtgtccaacttagtccaattttgttcagttttcgccttggagtatcaagagcagattcctgaggtggtgcagacagtactgacagagttttcttcagtttttgatgaacccaaggggttaccaccaatcagacaatttgaccatactattcctttgctaccaggagctgggccagtcaatgtgagaccctatcgatacactcctatccaaaagaatgagattgaaagtcaagtgcaagagatgttgagtaaagggataattcaacccagttcaagtcctttttcatcaccagttttacttgttaaaaagaaggacggttcatggaggttttgtgtggattacagacatcttaatgccataacagtgaagaataagtaccctttgcctgtcatagatgaactattggatgagcttgcgggagctcaatggttttctaagttggacttgcgctccggatatcatcaaatcagaatgcatccagatgatgagcataaaactgcttttcaaactcatcacggtcactttgagttcagagtgcttccttttgggttaactagtgcaccggcaacttttcaaggagtcatgaacagtgtgcttgctaccttactcaggaggtgtgtgcttgtattcgtggatgacattttgatatatagcaaatctttagaagagcatgtgcagcatttgaaaacagtttttcagattttgcttaaacaccagttgaaggttaagaggaccaagtgttcttttgcacaacaagaactagcatatctgggacatataattcaacctaatggtgtttccacagatcctgagaagattcaagtaattcaacattggccagcacccacttctgtaaaggaattacgtagctttttaggcctctcaggatactacaggaaatttgtgcgcaattatggcattcttagtaaacctcttacaaatttgcttcgcaagggccagctctatatttggactgcggaaactgaggatgcttttcaagctctgaaacaagcgctcatcacagctctagtccttgcgatgccagatttccaaactccttttgtggttgagactgatgcatctgacaagggaattggtgcagtgttaatgcaaaataatcatcccctcgctttcttaagtcgagcccttggactgcgacatccgggactctctacttatgaaaaggaaagtttggccataatgcttgctgttgatcactggcggccatatttacagcatgacgaatttttcattcgaactgatcaccgcagtttggcttttcttactgaacagcgtctcaccactccatggcagcacaaggctcttaccaaactcttggggcttcgttataagattatttttaagaaagggattgacaacagcgcagccgatgcattatctcgttatccaggttctgatcgggtggaactttcagctttatcagttgcagttccagagtggatcaatgacattgtggctggttattcctctgatcccgatgcctgcagcaaggtacaaactctctgtatcaattctggagcagtaccaaatttttctttgcgcaatggggtgctttattttcagaacagactttgggtgggtcacaatgtagatgttcaacagagaattcttgctaatcttcacacagcggccgttgggggtcattcaggaatacaggtcacttatcagcgcgttaaacagctgtttgcttggcctcgtcttcgtgccactgttgttcagtatgtgnnnnnnnnnnnnnnnnnnnnnnnnnnnnnnnnnnnnnnnnnnnnnnn

SEQ ID NO: 56731 - DNA, 884 bp, Oryza sativa
atcaaaagcttcccctaaaacccccgaatccgcgggctaaacaaccattccccaactcaaaagcaacgctctgcagcaacaaaaacaacaaaatcttagatccattccgtgaacgcttcccacagcccaggaagaacaaatctccaaacctggaagcgcaacttggcgaagcagcagcagcatcacgatttcaccgaccaaaaaacattggatgccacacaaaaacgatgagacaaactaaacaaaactacggcaaccaacgtctccggcgagctttccatcatattacatcgattcaaaaacaactaaagccgagattgaaccctaacaaaatttgaatcggacctacactgaatcaaatcgaacaaaaacaactaaaaccgagattgaacccgaacacaatttgaatcggacctagactgaatcaaatcgaacaaaaaaaaactctagacactaaatctcgccagcgaccaacctctccggtgagcaaatcggacctacattgaatcaaatcgaacaagaaaacaactaaaaccgagattgaacccgaacacaatttgaatcggacctggactgaatcaaatcgaacaaaaaaaaatctaaacactaaatctcgccagcgaccaacctctccggtgagcatgcacaccgacaagacagtcctctccggcgagcacttataccgacgagacaaacctctccagcaagcactcactccgacgagatctctctctcgcctcgcggagaaaacgagaagagaagagaagaaaaggggaaagcgagagagagaaatgcgaggagagagcgggatcagcgaggggaaataaaaaacggctacggacaagcgcggaaatcgaaatttgcacagtgcaaagtaatcgggc

SEQ ID NO: 56732 - DNA, 5070 bp, Oryza sativa
ttgtgacacaaatcccaaggtttgattgtgacacaaatcccacaattctcaatcaacagccatttaggttgtgttcgtttgtgctgattgggaaccttcccttccagcatagaaaatggaaaagcacattagcacatgattaattaagtattagctcttgtacataatttccccccttttttaatatagcgtagtaggagcctctcctgctgtttaaccgtaaaaaaaattaagtattagctaaaactaacttgaaaagtgaattaatatgatttttaaaagcaactttccaatagaattttttttgtagaaaacaaaccatataattgaaaagcgtgcacgcggaaaagaggatggagttgggaaccattgcaaaagaacgcagccttattaattccattttgtttagtaattccattcacggtgctcagagcggcccaattagattcacgggtattcaaatggagacccaattttttttgttatatgtatgtttataaaaaagttaaaaatatatataattagtaaataaacctgtctttctaggcttggcttcctctcctatgagggtccaattcacacaacttttatggcctaattctgtgattcgtgaaacaacatacaaactgtcaaagataaatttcttttacccctttctactttgagtacgcttatacgcaacctcaaaatcgtgggccctcccctgcatgacgtgatttttttgctgcttgcattgtaatgattttccctgggaaaactaattaagaggcagataaacaaacacacacttctctaattaaacaacactgatacactcttttcccttcattttatcacaagtgtgcttcaatggggcaaaaagttataagacaacaacttgtgttaccacatgtgtactctagtacgttttaagtggatggtttctagctacgaaaagaattggctatagttttaaggcagccagagattattaatggctgagatatgctatgcatgttgctagcttctctcagtccgtttcaaaatgtttgacaaagttaacttttgagtacgtatttaacgatttgtcttattcaaaaaatttaaataattatttattctttttatatcatttaattcattgttaaatatattttcatgtacacatatagttttatatatttcacaattttttttaaataaaacgaacggtcaaatatatgctaaaaagttaacagtgtcaaatattttgaaacggagggagtatatatttgttggaagtgaagcatttccacttatgattcactcggtcattgcatccatcctaccatacattctatatatctatgtttggactgggaggtcccaggaattgttgtgctgcagtgacgccacgaaatctgtcagttttcttctgatagtttacaaagttccgtggtttcaccactccgccaatgagaatgtcgacttaagggcagggtttgcaatttcgttttgaaatttcggtaattttgtcccctaccggaaagctcacatctcgcccgaaattttcggtttttttttttttgtaaatttttctgattttggtcaaatttaattaaaattcattaagacagaaaatttcaaataatttcagctaaaaaaaattcaacatttccaaaattttggtaatttcggtcccccgggaaagaatttcgaaatttaaagctccaacggcaccggcgggaaagaagtcgcagtctactccagctgctttgtgcaactctgccgtgtactagctagttgcacattttgttgctgcgctgcatagttgctttttacaacaaagatagacctcaaattaattgacatgattcagtgtacatactcgaagtaagaactgatgaatttatattttcggaagagtatttttttacccagcatatacatgtaaccggatatatacagccatatgcagccatttaagttagaacttactacttcaaataacccaatctaaaattcactcctacgtagatttgaactcaatatgttggggtgctacgcaggtcattacgactactcaaaattaatatacatgtatgtatatattgtactatatctgtgcctgtttggagcaatgaactagggtagtatatatgctgggaaggttgtgcatgtacttaaatcaaacggttgaaatgattgttagtaaaagtttagcaagaaaaaaatttagtacatgtagcattgctctttgtataataagtccgaaatacatatctaaaataaatgtgtcttatgttacctttttgtttatgctggttttatttagagcaagggacatcgacatagtaaacatacttatcttgatttcatatatccagttattctaatgcagctcagctggttaggttccatgcctatacaggtttaggtcatagacttattctaatgcagctcagctggttaggttccgtgcctatacaggtttaggtcatagacttagtacgagttcttacattttacgactatttgttgtttcaatgataggcaacctatcaatcagttcaaatatatgcctaacggcccagtcctaaaaggtgcccgtgtgtatatttataggagtgagtaatatacgcgcgtacatataagcatctataactatattgagtttcacaaacaaaaaatatagcaaaattattgtctttacttacccatgttccaaaataaatggattcctagtatctagaaaaagtataatgtgaggattataaaagaaaaacaaaatgctccgaattaataggaaagtagtgctgaacttgtcggttaacagagaatacatatctgttcatctaatttcactttttattctttccattctatagaaatttaggtattaattttccttgtttgaagtaaacattctagattgtatttatctagagactttagattgtcctaacgcaatccttattgctgctatattttttttccatttaatttcactatttttttctaattttctagaaacacatgatgctaacatgaagtgacttttcctcattccgagtaattgtagttgattgcataatcctattattttcttttttttctccttttctttttattactattattttgttctatactggctctgtacacttcagttcttcacgctgtttttcttcccttttcttttgaacgaacgtgcttagcgctgcgtgaagaggccattcaccagtactgcggactgcggtacatattacatattacagaaaggccgtggggcgccagggacaggcccaggcccaaggttgcacagcctagctagatgcaaagcccaccccgcacacacacgcaggcaaatgtttacgtttttttttcccgatctctttcagtccggatacttcacgcatcacacgtggcagtttttcagtgagccctaaccaaatttgtagggcgccacgtggcccaatggaaaacaagagtctggacccaaaaatcggtattagagattatatgctgggaaggttgtgcatccttttacgatgtttatatatattatatttgcgccatggaagcctattcttagtttgatattttattggaatcttaatttgaccaaagaaattgtcgatctccatcatagtttctctctgaaaccgttccagagtaatcgctttcgtaaggctgtaaagcttagggaccatcttggcatagttttttgacgattcagattaattcctcacaagttaccaattgctaacacttcaattgttttcattgacactgtctttgttcagaatcagcaatcatgcatcacattaactgatgaattacagaaggggcttaatccatttgcgagctgtcttgctcaagtacaatataaaacgtccccatttagtcatttccaaatatttaggaggctttcacactaaaaaaacatcatatatataattacgagagtccctaaaatagtggttggcaaatatgtttctccttatgtactacaataatgttacaggttaagaatcctgcagtaaaggtaaaaggacaaaaagataaaactaacaggagataaaaaaaacacactctcctatttaaagaaacacactaatacactctttttcccttcacttttgctaggtgtgtattacaatggggcagagagttaattatgagatgacaacttctgtactacatgcatataataacgttctaattgcatggtttctatctctcttcgtctttgtacccgatgctgcatcttttgcatcgcccctactaggatgaggaaatggggttatggaggcatgcttagacggtgcagttgctgtggcagaggtggtgctcaagttcgggagggacaccagcagaacacaccggagttcacggcagctcccgccggagattcaagtggcagaacggtaggaagaggaagaaagagcaagaattctacttgtagtataataatacaagtagagagcgccggagcgttgcagggaaggacgctttccatttataatctataatttgggaggccagcattttgttttccgccgaacgccttgtgtgcgaaataaacagaaaatcatttgcaatatgtttgctgacctccgccgtctgagagatctccgacgctatcgaccaaccacatccaagacgtgcgaaataaacagaaaatcatttgtaatatattcgctgatctccgccatctgagagatctccgtcactgtcgaccaaccatatccacatggtctccccctctgacgtactagcgccgagagggtggcaagaggtctccaatcagcgtctttgcaagctcgcggaagcgcatccttaaccaaatctggcaccccaacctcagcggttggatctggcccaacgacatccacatggggcagggccgtagggggagagcatcaaaggatgaggaagagcggagatgatggtggccggcagtttcggcattcaagcgggagtggaggagacagcggccatccaagttcgagcgcaagacggaaggggggcacgacgttcgaatgtggagatggagggacgaagagagttcgctgaatgcttggatcgggagaaaggattgattcgaaa

SEQ ID NO: 56733 - DNA, 2825 bp, Oryza sativa
taaccatcaacgattggcgtgcacttatcaacctatccgggcagtcaaacaaggggtacaaggcttacactcactgtatggatgaaacagaaagtacgcttaagcactgtcggaaggttgtgtacatgggtcatcgttgattccttgcagcaaacaatccagtacggaagaaaggaaagcactttgaacatacggcggaccaccgtacgaagccaaaacatcgtagcgggaaaacagtgtttgctacggtgaaaggtcttaaagtagtgtttggaaaggggcctggtagccagcctatagagtgcgaagatggtcacgtggcgatgtggaaaaaaaaaactccatattttgggagttaccctattgggaattcttggacgtccgccacgcaatcgacgtgatgcaccttactaagaacctttgcgtaaaccttcttggcttcctaggtgtatatggaaagtcgaaacatacactggaagcacgtaatgatctgaagcatatagaacaacgtggcgaccttcacccggaaccaaaggagaaaggcagccattacttgagtccagccagctacactcttagcaaggcagagaaggaaagtatgtttcaatgcttggagagtatcaaggtaccatctggatactccacgaatataaagcgaataataagcatgaaggagaagaagttcacaaacctaaagtctcatgactgtcacgtgttgatgatacagctgctaccagttataataaggggtatcctcccagacaatgtccgggcaacaataacaaagctatgttctttcatgaacacaatttcgcagaaggtcatcgatccggataggttagaagcccttcagaatgatgtggtgcaatgtcttgtcaggtttgagttgatatttccaccttcatttttcaatataatgacgcatctgctttgtcacctagtgaaagagatcggtattctcgggcctgtgttcctacacaacatgtttcctttcgagaggtacatgggcgttctgaagaagtatgtttgtaaccgtgctcgtccagaggcaagcatcgctaagggggtatggaacagaggaggtcattgaattttgcgtagaatttattgaagaccttcgcccaatcgagttacctgaattacgccatgaagagagactacggggaatggggactctcgaaaggaaagcaataatgacggtagacaacaatttattccgtaaagcccatttcacggttttacaacaatcttcattggtggctccttacatcaaggagcacttggctctagttcgcaccagaaacatcggtaagtccgatgcatggattacacggcatcacattgatactttccccgcatggctgtgacaacatctcatgggtaacgagacgattaaccagcaactggccttcctggcgaggggtccatctggctcgatcgcaacattccaaggatatgagatcaatgggtacacattctatacaagagcccaagacatgaagagcacgaaccagaacagtgctgttcgtatcgatgccatgggacacgatggtacaactggcacgtattacggtgccatcgaggagatatgggaacttgactatggacctctcaaggtccctctgttccggtgtcaatgggttaggttgactggtggaggtgttataattgatgacagtgggatgacaacggttgaccttaacaaggttggatactcggacgaaccttttgtccttgccaatgatgtaacgcaagtttttaacgtgaaggacatgtctagcaaaggaaagaagggcaaagggcctgacgagccgatgcgcaacgtggttctcccaggcaaaagaaaaatcgtcggagtagaggacaagactgacgaggattacgatcagtttgatgggcaacgccctttcacggtgacgattgaccctagcatcctcctagcaaatgaagacaccccttactcacgtagcgatcacaaggaaggaacaatagtgaggagaaagtacgtgcggacaaccgtcaccgccgatgtattgccgtaaatgttgtaaactattttggatgtattgaatatgctagttatatatgatgattaacaaatttaaatcatgcatatgctaggtacatataattattagaatttttaaaagttttaaatcatgcatgtggtatttacatatgttaattacaatttttaacaatttaatataatgcatatgctaattatatatgattattagaatttttaaaagttttaaatcatgcatgtgggatttacatatgttaattacaatttttaacaatttaatatcatgcatatgctaattatatacgattattagaatttttaaaagttttaaatcaagcatgtgggatttacatatgtttattagaactttaacaatttaatttcttgcatatgataaataaatataattattagaatttttaaaagttttaaatcatgcatgtgggatttacatatgttaattagaatttttaacaatttaatatcatgcatatgctaaataaatatgattattagaatttttaaaagttttaaatcatgcatgtgggatttacatatgtttattagaatttttaacaatttaatatcatgcatatgctaattttatatgattattagaatttttagtaattttaaattatgcacgtgggatttacatatgttaattagaatttttaacaatttaatatcatgcatatgctaatgatatatgattattagaatttttaaaagttttaaatcatgcatgtgggatttacatatgttaattagaatttttaacaatttaatatcatgc

SEQ ID NO: 56734 - DNA, 6668 bp, Oryza sativa
aaccgggagtaaggttgttctcatcaaccggaagtaaagatctggggggtatatatattcccggtgcgccctcgtcttctccaccaacacttagacgtttttccatcgagatcgagcatcggcttctccttcgccgccactgcttagggcaaccccgcgccgacgccggcgtcgtctctcaccgttgcctggcggtcctcgccgcctccgccgcagacgccgccgccgcctctcttgggtgagagcccccaccctctctctctcgatgtagctctctctctctccaaaccgccgccgcgtgcctagctatagcttgttgccgacgccactacgccacgccacggtcaaccgccactgccgacgaacgacttcggcgtggccgccaccgccggcgacgctgacgccactgccacgccgccgcccctgtctcgagatcatgccgccgccgcgcccccacgccgcgggcccccacgccgccggaccgcgcccccaccgttgcgagatgccaccgccgcgagacgccgccgccgccgccacgctgccgctgcgcccccacgccgccgggccggccctcggcaccggaccgcgcccccaccgccgtgagacgccgccgccgcgaacgaacgcttaacgaacgtgaacgaacgcgaacgaacgcttaacgaacgtgaccgaacgcgaacgaacgcgaacgaacacttaacgaacgcgaacgaacgtgaacgaacgtgaacaaacgcgaacgaatgcttaaagaacgtgaacgaacgtgaacaaacgcgaacgaacgcaaacaaacgcttaacgaacgtgaacgaacgcgaacgaacgtgaacgaaatgttaaagaaatgttaacgaacgtgaacgaaacgttaacgaacgcgaacgaacgtgaacgaaacattaaggaacgcaaacgaacgtgaacgaaacgcttacgaaagtgaatgcacttgtactaaaagtgtgagaacgaacgcgagcaaaacgtgtacgaacgagataattaaacgattattaaacttagcatacatatatgattatatatataggttaaaacgtgaaatacaataaatgtaacttggccctgtttagactaatatattttcctagtaatgttgtagagaagacgtcgttgtcgtccctcaagccgaagtggtagctagccatcgaaggaattcgcgcaggcaagtgttgtaaagaagtgattgttagagatttaatataagattattagagttttaatataagattattagattattagaattttaatataagattattatattattagagatttaatataagattgttagacttagcatatatgattattacaattttgatataagattattagagtttgaatataagattgttagacttagcatatatgattattacaattttaatctaagattattagagtttgaatataagattgttagacttagcatatatgattattacaattttaatataagattagtagcgatttaatataagactgttagacttagcatatatgattattacaattttaatataagattattagagatttaatataagattgttagaggtttaatatacggaacttaattagacttagcatatgtgagtgtcagagattgttagagatttaatataagattattagaggtttaatatacggaacttaattagacttagcatatttgattgttagagattgttagagatttaatataagattattagagatgtaatattcgaaacttaattagacttagcatatatgattatctagggttctaatacacgacacttagacttagcatatatgattatttgagttttaatacaagattaattagtagagttttaatattacgcttagcaaatatttcttctatgaacagatggctgatcgcgatgaggaacagatactgtatgatacaatcgcagagggaagcagccaatactggaacgaagaagaggggaacgaggatccaaaccagtacttgaacgaggagcggaacgtggagagggatgcagaggggaacgaggaggggaacaaggaggggaacgtggagagggatgcggaggggaacgaggaggaggccagtggaagtcatccctccgctggacagaagagggcacgcggacaacgaggtgccacgaagaagataaagggtcggcacatcataactgaggtggacgaagacggccgacctagtgccccggcagaagcagccaagaattttgtacaccacatcggttgggttgtgagggataacgtgcctgtcagcaaggtgtactggcgcaaaacaagggcacgcggggatgatgacagctttgtcccggaatcagagaaagagatgctgtggactacaatgctcgagacgttcacgctccctgcgggtacggagaacatagtgaaacagtggactcttaagaaaatggcagaacagttccagactgtcacgtcctgataaattcatcccgaaataaaaatcatcttctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattgagaagaaataaacaaagttgaaaaggtttataaaaagaaaaatccctaaaaagtctttttcccccctttttccttcttgggccggctcggcccattccctccctctctctctcttcccccgcggcccatcggctctctccccgcgcgcgcgccgctgacgggcgggcccgcccgccgccctcgctgacgggtgggtcccgcctgtcatctccctcctcgcgccgcgccgccgcccgcccgtgccctagcgccgccgccgccgcggattccgccgcatcccgccgtccccgcgcgcattaaagagggggaaattattccccgcgattccctctcccgtttcccccgttttcccctctctctctccctcggattcgtccggattcatcccgcaatcgtcgccggcgtcttcaatggcggccgagatctccgcgccggtttccttcctctccggccgcgctctccccctctcggcgctatatatttgctccccgtgcttcgctcttccgtttccgccgctcgccgctcgctctccccgtcggattcgtgctcgcgccgtcttcctctctctccgccgtcgccgacgagctccggttcgccgccgacgtcgctccgcgcttcctcccgactcggcgccacctccgtcggcttcgccgcgtcgccgccgaccccgtccacccctccgcttcgctcgccgaccgccggagcaccgtcgccctcgccgtcccgaaccgcgccgccgcgttcctccgctccgttcgtcgtctccgccgtcctcgtgtctcggggtgagccgtggaccgtccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaatgagttttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgctgttatgtggaggttattagagtaaaagccgtttcttttccgttggtcgtgtagacgctgcagcttcggaagatccgctcttcgtggaagtcgaagccgtcgtttgggaaagcgagcaaggcaagtcacatcatccttgatcatattgaatcccagtttgtaaaattatgttgatttaaattattgcattaccgctttatttaaattcccgcgttatcactgttttatctagccatacctatttacctttgttatgaccttattattattgttattgttattattactttgttcaccctaggttaaacaaaaccccaactagtgagtactctatttatggttccactagtatgaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaatcctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcagcaactaaaatgtggaatggttggcctgggttggcttgggacgagctggaacccaggtcgggttgccagttcggtccaaatcatcgtaggccttgggtcaaggcaggttcgtgagggttcacggccttgtttaataatactgtgtagctctagaatcgtctttacaaaatggctttgggcaactaagtgacttttaaatgctgtttactgcaaaacttaatccctattattattcccttgtacctcccttgcattaattatgcatccgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacagaccttcaagggagatctatacaagaaatacatcctgaagggactaacaccgaacttcgacgtattcccaaagctaagggatcattgggacgagttcgttgcttacaagacagggcaacaagggcaagcgatgatggtcaaaaacaaggaaaacgctgccaagaagaagtaccatcatcacttggggtcaggcggctatagcgtcgcaatgccgaagtgggaggagatggaggcaggcttgattgagaggggtatcgaaccggccaccgctaaatggccggatcgatcgaagttctggtactatgctcacggtagaacgcttaacccagttgatggctccctggtcttcagcgatcagatacgcgaggctgccagtcgactaacagacgcagtggaagcctcttctcagggcacgttccgacccgacagagagaaggacgagctgtcactcgccctacagactcccgagcatccaggacgaacacgagggaaaggcgtgattccctagaagattgtgacggagctcgtggctcctcaccgggagaccgcgcaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatctgtgtatgaaggagctacaaagtgtgagccgacccctccctcgttctaggctctgaatctggaaaaaatcaacccccttccctatgggcagggtcctccttttatacttcaaggggataccacatgcacccctctctttccaaactggacttttcttctcttcataaatggacggagatttgcacggttgtcctccgaacatcctcctgacgggacggcacacacctacctccacttctgccgga

SEQ ID NO: 56735 - DNA, 13055 bp, Oryza sativa
cgtgccatctctaagaggtaacacgctagccccggctggagacgtgtgcctagaggctctcgtcttgacgggatggggcaaggcgtgcgtcagaccgccagtcgccacctaacccgtgatctgaccggtctgtgactggtcacagaccggataaaggaacgcactgcactacgctgcatgcagggcgacacgtttgaccaaaccgcaataaatgtggttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagtagcccccggcgttatgccagggcgatcgcccttctcaagggaagcggtcgggcgtgacgccactcctaaagcttggtgacaggtgggaccggtctccatggttgggcagaaacccaacggtctcaaatcatgcacatcggtaatggtgacttggctgtccataatgggcggtctcttcaagactgccacattacttgagcgacgtacgaatctgggtaaaccgatttgcttcgcctggagatatggtaacgttgcttcggtcggcgagcgtaattaacgcgcgcacgatacgatctatctcgactgccacaaccgcatatccacctcatgcgccgcaagcgggcgaatgggattagtggaagcgtgggcacgagaaacgagggagcgagatagtgagaaacgagggagcgagatagtgggcgcgagaaacgaggagccgggcacagcgatggcaaaggtataaagacactgaggaacggatttgctcccttcctttcgccactattccccttgccttcgccgcttgagctctaactctttctctgctgcgcctttccttcgccacacgcgctcgttctcaatcatcccttcctccggcgccatggcacggggttccgctctgctcgacggaagcgtacttccgccttctcgcatcgtgagcgagaggcacgccgggctgccgcgccgctttatgccggaatctgccaccggcagggagatagtgatgctgggcgagggacgcccggcaccagactacccggggcggtccgtcttcttcctccccttcgcaatggcagggctggttccgccattttcttctttctttatggatgttctggatttctacgatctccagatggcgcacctcacccccaatgcagtgatgacattggtcatcttcgcgcacctgtgcgagatgttcattggggtgcgcccatctcttcggctgttccggtggttcttcaccgtgcagtcggtgtcgccgccgtcggtggttggtggctgctacttccagccgctggggccggtgttgaaccgctacatcccctgcgccctccgcaagaagtgggacgactggaagagcgactggttctacacccccctcgccaacgaagcgcgcctccgacttccaagtcagcccccggcgcaggtctccagctggcgggcgccggtagatctgggggatgactatgacgccgtcctcgacagcctggcgggcctgcgatcccaggggctcacaggggccatggtgtacggcgactacctccgtcgccggattgcgccgctccaacggcgcgcccggggcacctgggagtacaccgggtccgaagactacatgcggacccaccagggagtcagatgggattgggctcccgaggacttcaagatcgtggtccaaagggtgctgaatctcagctccgtggaggcgtctctcattcctcaaggaatcctccccctctgcagcgatcccgaccgcgcctccattctgaccattatgatgggggtcggggcctcagaggaggaaactcctaagggccacgacggcgcgggcgagagccgccggggggaacaatctaccccaggagggggtcgtgcttctgggccccgcgtcgggggctcggggagcagccgccctgccgacgcccaggggaagaggaagctgggaggaacacctcccccatctcctccccgagggggcggggcggtgcgtgccagcagtcggcgcccggagggggccgcgctgacatcgcagcccgagggggagcgcaagaagaagcggccccgcaagatgggggagacggaaccatcccggggaaatctgatttcccctccaaggtggtcatttaaccgaccccctcgcaggttcgtcccactctctttgcgaccgcctttcttttacccaaaagcaagttttctcttacccatcttgtttgtcttctggttttttcttttgcttcagcgatgtcccgtcacgttcctcccgccatcccaagtctggccagtccgaggccgaagatccggcggccgcagaggaacggaggcgagaatctgaccggcgagaggccgcagatcgccttcgggaagctgaagaggccgcccgggaggccgctcgggctcgccatgcagaggataccgctcgggaggaggccgcccgggctcgccaagccgaagaagctgctaaggaggaggccgcccgggctcgtcaggctgaggcgatggcgtcttccgaggcagctcacgacgaagctgctggcgcgtcgcttgggcccacttccccaggcgacgcccaggaccaaacgggtctgggggacatccccgagcccagcgcgtcctccggcgggccgagccgcgtcgcattctctccaaggcggctcttcccctcgtcttctgtcgccccgctgagcgccgagccccttctgcaggccttggccgccgcaaacaccgcggtgctagatgggttcagcgcccaagtggaggccctgcgagcggaacgagcggagctcgaggccgcatgggcgcgtgtcgaggaggggcggcgctcggtggatgtcatggtggaggtgggccgtaaggctcaccgccgtcacgtctctgagcttgaagcccgcaaagcggcgctggcagagatcgcccgagaggtggaggaggagcgggaggccgccctcattgccaccaccgcgatgatcgaggcgcaggacaccctccgccttcaacacgggagctgggaggcggagctaaagaaaaagctcgacgccgcccaaggggtccttgacaccgccgctgcccgagagcggcaggcaacggagattgaagcggcgtcccagcggcgtgaagaggccctcgaggcgcgcgccatggcgctggaggagcgcgtctgcgtcgcggagaaagtcctggcggaccgcgaggccgccgtcacctcccgggaggcaacgctggcggcgcacgagtctgcctgcgccgaagaggagtccgcactccgcctccgcgaagacgcgcttgccgagtgggagcgagctctcgaagaggccgaggccgaagcgcaacggttggcggactccctgtccctccgtgaggcagcgctgacggagcaggcccgccgcaatttggaatccgtccgcgccgagagagccgcactggagcagcgggctgccgatctcgaggcgcgggaaaaagagctggacgcgagggcgtgcatcggcggggcggctgcgggcgaaagcgacttagccgcccgcctcgcagctgccgaactcaccatcgccgacatgcagtgcgcgctagactcatccgccggggaagccgaggccctccgcttggcgggcgaaatagggcccggcatgctttgggatgcggtctcccgcctggatcgcgccggacggcaagcgggcctctggaaaggccagacaaggacgcactccaccaacctggaaggcctcgcttcgcacctcacgaggatggcctgggctcttcaacaactccccgaggagctcgagaagaccatcaagtcatcctcgagggacctcgcccaaggagcggttgaactcgtactagcgagttaccaggccagggaccccaacttctctccatggatggcgctggaagagttccctcccgggaccgaggacgacgcgcgtgcgcgggtccgggatgccgccgaccacatcgtccacagtttcgaggggtcggcccctcggctcgcgttcgcccccaactccgacgaggagggcgatgccagcggtgcagacgatcgtgacgacgaggccggcgacccgggcgcatcggactgagcccccaggcccccgcctgactccagtttttcctttttctttcttccaaggccttcatgcctcttttttgtatagatcaacttaatctggaatcaaaaatgatgaaaaaattcgtgtcaattttattttgctatgcgtatgagatgaggatgatctgtgccgtggtcctcttttgtgtcttagcttgatttaaggactcgtgcccaagtcccagtcctctaatggctcgggtcggggctagtgcctggggagatccacatgtcgaggctggccaggccgggaacgtggtgaccgagggttatgggtgacccgattgtgggtttttgccgattcccccccgaagttcaccacgccccggggcacggctcggttctgggccccgtttggcgattttagctgaccgaaccgagcccccgagggcaaggttgagtacgagtgaccttatttcaagtcaagattctacaaaaggaaaaaacggcacagacacaacctttaggaaattgaaactgcttttattgaaatgctgaaataagagaaataagaatgtgcatgcgtggtagcccccggccaaccctgcacacccgaggggggtgcggggttggcccgagccaaaacctgacactcgacccccccctcaggggtagaagcgacgaaggtgttcgatgttccacgggttaggcagctcagtgccgtcgcccgtggccagccgtatggagcccggccgggggacaccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtagcgcgcggctcggagggccgcgcgcctccttcgctcttccaagtagtcgaggtcatctctgcgaagctgatcttgatcagcttcgcagtacatggtggcccgaggagacctcagggtgagctcggatgggagaaccgcttctgcgccgtagacgaggaagaaaggcgtttccccggttgctcggcttggtgtggttcggtttgcccagagcaccgctggcaactcctcgatccacgaatcgccatgcttcttgagaatattgaaggtcttggttttaaggcctttgaggatttctgcattggcgcgctccacttggccattgcttctggggtgggcaggtgaggcgaaaagagcttgatgcccatgtcttcgcagtagtcgccgaagagttcactagtgaattgggtgccattatccgtaataatacggttaggcactccaaaacgggccgtgatgcccttaatgaatttaagtgcagagtacttatcgatcttgacgaccggataagcctcgggccacttagtgaacttgtcgatcgcgacatacagatactcaaacccgcccggggcccgcttaaacggtcccaggatatcgagcccccagacagcaaatggccacgaaagtggtatgatctgcagggcctgggccggctgatggatttgcttggcgtgaaactgacacgctctgcatcgccggaccagatcaactgcatcattgagagctgtcggccaatagaacccttgacgaaaggccttgccaaccaaggtgcgcgaggcggaatgggctccgcactcgccttcatggatatcggcaagaagctcaacgccttgttcctgaggaatgcacttcaggaggattccattagccgcgcgccgatagagggtcccttctaccagcacgtagcgtttggaaatgcgttggacgcgttcactcccttcacggtcctcaggtagagtcttatctgtgaggtatgcttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaaccatgttatcccgtctgggtacatgccgaagctctatcccgtcaaaatggcgctccatacgccgcacttggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattagtcgctcgaaagtcgagacggaccaagtatctgaggacgtctccgttcggagaggtcaacgtgacccccgcaccggcgccctggagagacagagaaccgtcgaactgcatcacccagtgggcggtgtgaggcagctgagaggggtccgtgctggcctcggggattgagacggtctctggagccggggtacactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgatcctcttcgctaggggccgcatccccggggcgttcttcgtccaagtggcctctcggggcgcactcgtcttctgtgccgatgacctcggggtcggaggatgacaggagcggccttcccacagtggcctcggggccgtcctgggggtcgggggctcctggcgtcgtcggacaagcgggcaaagggcctactccggtcgtcaggggcctcaggcctccgttcggctcgggggcctcttctccctgctttctcccgggtcgagtcagcacagggttagcctcggggccaaagggcgataggtgcggccttcccgcagtggcctcggggccttcctgagggtcgggggcacccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtagagtagtaggggctcgtttggccccggggcgactagaactgggggagagctgagatatgtcttcaactgagtgagggcacgttcagcttcctccgtccaagtaaacggccccgagcgcttgaggagcttaaataagggtagcgccttctctcccagcctcgatatgaaacgacttagggcggcaatgcaaccggtgacgcattgcacatccctaagtttgctgggggggcgcatccgctctatagctcgtatcttctcggggttggcctcgatgcctcgggcagagaccaagaacccgagaagcttgcccgcaggtacaccaaacacgcacttatcggggttcagttttatgcgggcggagcggagattttcaaaagtttcctctagatctaagagtaaagtctcttggttgcgcgtctttacaaccaagtcatcgacataagcctcaacattatgccctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgcctttggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccatccagaagaccaccgatccgtgtggtcttggatgggccgtcgcccagggcaacctccttgaccgggacctcggcgcatgtgacaatccgctgcctcggggcggtgggggcggaggtgccaagcctctcgtcaccaccctcgggcttggacgcagcagcgaggtggtccgcgcgctgctccatgcaagcgagcgcgactttcaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggctgatccaccaaaggtgaccggtaggtcgatgtgacccaacggccatgtgtgccccggcgtcacaccgataatcggttgggacggctggagcaccatccccggggccttgatggcatcaaaagccgcgggggaaatgatgttgagggccgctcccccatctatgaggacacgccccaacttcacgttgcagatggtgggggaaaccaccatcgcaatctgccctccccgggcgacgcacggtgggtggtcggtctggtcgaaagtgagggcaacctccgaccaccgcgcccggcgcgtcgcctcatgagtaggggccgcggccagaagctctcgcttcatggccttgaggctccggcgagagacgtgagcacacgctcccccatcgacagtggcaatggtggccccaggttcttggaaacctaggtcatcatcaccgtcatcgatgtcaacagcaggggccttctgtttggcctcacttcgccgtttaccggagggagttgccggcgacttgccctcacggcgttccttcctcctgtcctcctcccacttcctcgttcgctcagccaagtttttgaccgtgcgacagtccgcgagatcgtggagggaggtgttgtggacggagcaccacttgccgactgggcgctccctggtgggagtaccagcctctttctttttgtcgctcgcaggcctcccctttcgggtggcccgcggagcgccctcgacggcgaggacatgaccctcgtcgccggaatggaccgaccacttcttcctcctcctgtcacgccgccctgtctgagcggcggatccgggggcggccgaagctgccactccggaaccggaggggttccaggtccatgcttcctccttacgagccactcggtctgcgagctgaaaaagctccgcggtagtctggggctctttggaagcgatcttttcgagcatgcggttgtgccgcacaccccccctgaacgcgtagatcaccgcgtgtgcagggatgcatggtatggtattgcggacttggcaaaaccgctgaatgtacgagcgaagtgactcatcatcccctcgctgtaccgcgtgcaagtccgcttcttcgcctgggcgcggataagtgccttgaaagttcatagtgaactgttggcataaatcctcccaagagtggaccgacgcaggtggcaggttcattagccaaccccgcgcctgtcccttcagggccatgggaaagaaattcgccatgactctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccgacaccaccagccgggggcacggagggctggtcctcacgtccatgtcgaggtgacactctggacaaagaggcgccctccgttgcgcggggagtacgccggctattacgccggcgctcgatgtcgaggcgggcatccggctctccacgctgatcctcccgagtcggaggtgccgacgagggagtggcagccgaatggcgtgcaacagccgccgctcgccgcgccctccgtcttgacgacacggagccggtagtggcggcgccggaggtcttggtggtggcggaccgtccaccagcacccaggcgctgctgtgccgtcatgaccaagttggccacgtcgtccagccatcgctgggctggagactccgggtcagggacgacgggcgggtgacgtaggagcgcgccagcagcctgaagcgcgccctggggcgtgctgccgtcgccatagacgaggaggcgacgctccccatctcgccgttctcctccatcgcccgcgatcggtgaagccgcggatctgtcgaccctctcgagggcctccccctgcttaggactttggtgtggaggaggcggtggagtacgagctcgacggcgtgggtttggctccccgtcgtcgccgctcacactcggagagaggtcgtgcgcctttgcttgcccggccattaggctgaacaagaaaaacttggcgcacacggaaaagtgcgagagctcagaaaacacacgctgagccccctacctggcgcgccagatgacggagctcgtggctcctcaccgggagaccgcgcaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatctgtgtatgaaggagctacaaagtgtgagccgacccctccctcgttctaggctctgaatctggaaaaaatcaacccccttccctatgggcagggtcctccttttatacttcaaggggataccacatgcacccctctctttccaaactggacttttcttctcttcataaatggacggagatttgcacggttgtcctccgaacatcctcctgacgggacggcacacacctacctccacttctgccggaggcaggcgcgtcgtgggaacgtggctgtctgccgacgacatgaccggtgttagaccggtcacaaatcggtcattcttgcccaccacgcgtcagcctagcaacgtgcatgtttgcccttcttcatgtagcatcttgcctgtaatggttgggatgaagcctggtataaatctaaccagggctaacgtgccatctctaagagattacacgctagctctggcttgagacgagtgcctagaggctttcgtcttgacgggatggggcaaggcgtgcgtcagaccgccagtcgccacctaacccgtgatctgaccggtctgtgactggtcacagaccggataaaggaacgcactgcactacgctgcatgcagcgtgacacgttcgaccaaaccgcaataaatgtggttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagattggattcaaggaggacatccacacatacaagagtcagatgaggagcaagagagataccgaggcgaagattgcagatcttgagtacagggtatcgagctacgagctcagcatgcaagaggaggtggcccggaaggtggatgaacgcatggcagcatatcggtcacacgatccccagccgtacatacctcctccaatggtcagcccatcaggcaatcgtagcagctgcgcctcaatggggtaggtaggatcatatagcatggacgtcatgcaaacccaggacgaaaccacctgccccattgatgagatcacgcaacggacaccatgtgagctgcatattcccttcaagaacttatcaatcaaggtatgctcgatataatatatgatttttgacttgtacgttccgcaagttgctgcttaggttgattactaatagataacctctcatcacgtgaaggtggcatcggtaaaggacatcccaacggacatttcagggacttaccactgtaggccgattccagcaggatactcgagggtcgaagttgagctggtggaagccgtgtacgaggacctcgagttggactacttaggaggagatggtgagacgcatctacgagacacaagccacgtccggttcatcatcctccctgggcgacaagcggcgtctcgtgcaccatctcctctggctccgccgtctcctcctgcaccatctcctccagttccttcgccacgtcctcctgcaccatctcctccggctcctccgccacctcctcctgcaccatctcctccggctcctccgcctcctccgcctcctccacctcccctccaccgtgtccgcctgcacctccca

SEQ ID NO: 56736 - DNA, 5006 bp, Oryza sativa
ggctcagttggttggaggcacaccaatcctgaaggcggaagtggcatacaagtttgaactcggtaaactgcttgtcaggcctgagcagctgcagtccctaccgacacaaatgtacaaattccatgaacgatacatggaaatgagcgccaatggtagagagatgttcggagcgaggatcagaaaccccgacttcttgcaaggagaagatgttctatggatccatttcaaggatgtcttcgatctgtaccatcgggacgccctcgacgtctctcttctgagcgcatggattttgtaagtatctttgagttcgatttgtttcgttcaataattagctcctagcatatatgtaagcaataataatttcctttcaaagggcccgacggcggggggtttacgatactgggttcattgaccctcggaaaatcaacaccgaaatgctcgacaagtacgagaaagacacagaggacaatctcgtccatctcctaacgcagcagcatttcaagacgttcatactattgccgtacaacacagagtgagtttttattgtcgttcgaccaaatttcattcccatacatataacatgtacattctgatatttatctcatctcacgcatattccagattccactgggtcctgttctctttcgacttggacgcatgcagagtcactgtgtacgactcaatgaataaagaggagaaaatgtgcacatgttctacattagatttattttttatatatttgaacaaacgttgttacacaataaattttgtgtattttcgtttgcagaggtacttgcttgggcgaaggaaaagagaccgagtgtaacgcatgcatggatgatcaaagaagttgattggggactaaaccaagaccttctccaagtctacttctatttcaccacgtcacttttggtccataaaagacgagagatcaagttttacacgttttggattcggattcgggcctcctgacagcatcaacttcaaatggacatagccgctgatctagaaggaatttcggggcccatgagtacttgttgaaaagcttatggaatctactttcagatggttttggtcccatgtcaaaatttccaccgagctgccgggaaactacaaaacaagtcatgtatctcatctggtctgaatctgatttgggttttaggccttgtaattgtgtctaaacgtgctgatgaagcctagagggggggtgaataggcagtccctgaaaacataaaaacaaatcgcagcggtaaaattcaaacagacccggaacttcctggtaaggaacaccagagcttccggtctgccaggcccagaacttccggtgttcagaacaaagaagaaattcaaatttcgaaacaggagactaagccaatcttcataagatgatgcacaggtattctaagcagaagatagatcacaaaatcatccacagaaacatcacagaaatagacaagagcgattttttaccgaagttcagatcttgcgatcctactctccgttgaggagctccaaagagctgggtctcaattaaccccttgcctcacttatgcaaaaacaccagaggaaatccacagccttcaaccccaaacacccctaggcaaatttctagaattgagtgactaccaagatccaactcaacctacttctagaaattcgccacaagtgtgggttgctctacttggaaaacctctagaatctcagcacaagaacttcattaacttacctcgttctctttcggaggagaggagatccttcacaaacttactcgggacatccacaatatataacggattctcgcgggcgacacctaaccgtctaggagatcatctccaagagtaacaagcaccgagatgacagcccacaagatattccaagtgctcacccaatatcctagtcttcacacctctccaaatcttcttctctccctctcaatctctctttctcacaagaattaggctcaagattgagtggagaaggcaataaacacttaggagaggctagcaacagctctaggttcgaaaagtgaaagtagaatagccaaagaatgagctgcaaacgagctggttatatataacggctaggtgacgtcatctagccgttactcacaattttgaacttgaaactagacaggaagttccggacctggaagacaggaacttctggaaaacagttaggaaaatctttttcaccagaccggaacttccggacctgaaagacaggaagttccagagttgcatttttggacagacggagtatttgcaaaaataactcctagggaaacttgtcacttggttcacactaagagtacttgacatatctcagagcaccacctggaacccctcttaatagtacggttttttctaaaactcgattgcaataaataaactatcctatgcactcctcaagttctggtccgctttgattttatacttttgggtggtctccaagcatccatcttccacactttggactaatgcacctgaaagtagctcaatgaactcattagtcccttaaccacatttgtcattaatcaccaaaacccactaggggggtaaatgtacttttagtgtcgtgggcttagcccaagggggtgtgcgccctaaggcaaccctaggacgtccctaatcatatttattcagtagccgtcatcgtttagagtcaggttttgcttagattaatctgtcaaaaacagtttcgccgctagatcggtttgtggaaccccaaattcgagtgcttaatatattttccttcacctaagcaagtacctctacaaacgaaaacacacaaaactcattgtgtagcaacgtttattcaaatatataacaagtaaatccaatgtagaatatatacacctttggttgattaatatataaggtagtcatgattatatccgagctagttatgtcctcatcaggcgctaccgagaggataagactgtgagagactagagagaaggaggaataggaagataagaagaggataagagtgtgtgagagagaggaggaggaataagagatggaaattaacttttaaggataagagcaaaggattatatacgtatattgatgtttagttccggttgggaacaacaaccgggactaaagttaggattttagtcccggttgatgttaccaaccaggagtaaagatctccggggatctgatagcctctaacacaaggtgaaccaggactaaagatagcatagtccccttacacttataaactgtgactaaaaatatttttatccccagtttttaatgaaccgggattattgtgtattttaggcaaccaacaaaaatgatttctccggtagtgatgctcactatgaaaattatgttttttaattttaattttgaaataacgaatataaattgatcaatatttctctgcatacacactagcagctaatagttttttttccatatgacctgtttttaaagccaggatagactttatagccagatgaacggatatgggttttgaagaaaaaagtggctcacaaaacacgccccttgtaacaggaaggttttgaatagattgatgctctatggtaggcaagaagaggagggaataaaataaaagaaaatatacgaggatgaactaagttcaaagatgacatagtactttattaaagaagcattcactgaggtattcggacgttgccttcactctctatctattttcaccatactattaaattgatgcctaagatataaaagtgaaaattaaatttgaaaatatacattttttttcaatattttgcgtttatatacctgcatagaaaatatttgcacaaatatacctctccgcacgatggggacgcaggaccgaaacggtgccgcgcttccattccatgggaccggcagtcctgcaggatggctgtgcgacaccgcctcactcccgcagcccaggagagcggtagcgtggtagagggcggctgcacgcgggaccgagcaggtcgcgtggcgccgtggcgcgggaccatgcttcccgtcccgtcccgcgcgtgcgcgtgtcgcggtcgacgcgagccatgcaaagcatcacctctcaagcacgcatgcacgcagttgatctagccaaaccccacaatatataggtactccctccggttttattttaattgacgttttgaacaatgacacagtctacaaaatatatgtttgaccttatttttctattataatatataaaattaataaatgcatgttaacttttactatatatgttttgaaagataaatctatatatattgttctagtttctttaaaccaaatatttttaaagttatttatggtcaaagttatataagtttgacatcaaccttgtccaaagcttattatagaaccggagggagtactagcttagcttactaattattccatcctgatctcctcagctccatccatccatcattgccaacttaattcttctaagagaaagtacaagctagctggttaatcatattgttaattttggcctcaattaggtctagaattaatcaaggcacagctagcggcgcagatgggcaggagcagggcggttgcgcggcaatgatgcgcgggaccgagccggtcacacagcgccgtgttgcaggaccgccctccagtgaggccatgcgaggcggtgccgcacggctgtcctgcgcgaccgccggtcccacggaatggaaaagcggcaccgcctccatcccgtatccccattacgcggaggaggtatatttgtgccaatattttttatgcatgtatataaacgcaaaatattgaaaaaaatatgtattttcaaatttaattcataaaagtgagttgcactccactttattgtgcattttagaaatgagtgagttcctccttttatagggcaattatgacggttatggatgtcggttcacccacaatcgccattctccatggacctccacgtgaaaagtggagatgagggggtctaaggtcggtttgaccaaatccctggttcgaccgacctgtgggttttaccactctcta

SEQ ID NO: 56737 - DNA, 2061 bp, Oryza sativa
cggcgtcatacattaaaatatacggagggagtataaaagaaaagaaaaaaacaagttagtactactacttaaatctctatctctactactcttattttaataccgaacgaaaaataccgggcgaaacaaaaagtccgatccagcaaagggaggaaaaaaaaccggaagaaaaaaatgtcccatccaaaaaaggagcgaaaaaaaccggcgaaaaaacaaatcagtccgatcaataaaatatggggcaaaaaaaaggaaaaaaaggaaacgaataggtaaaaaaagagcgaaacaaattaaaaaaactgtctgattccaaagaaaaggaaattaaatgtgacacggtaaaaaaatcgacaaggcgaaaaaagccaagcgaaaaaactgggccaaaaaatcaaaaaagtcggataaaaaaaggggcgaaaaaaaaatctgtccgataaaaaatagggaaaaaaaaggaaaaatcgaaatgaatccgactccgtcgccgcggtaaaaaaagggcgaaaaaaattgaaaaaaaaatatctcattccaaataaaaaggagttatatgtgacacggtaaaaaaatcgaatcctattatatctagaaaggtccgacactaataaagtggcgaaaaaaaccgttcgtaaaaaaatacacgagaaaaaaaataaagaagggcagaaaaaaacgcggtggaaaaaagtctaatttctattcattgttttagtagtccttttatatctcttctttatctctaatctaatctaatgtaactattaaaaaaagtttctaccatatattaaaaaggaaaaaaatgcgcgagaaaataaaaacggtttaaaaaacgcgtgaggaaaaaaatgtcagaaaaaagcgcaaaagaaaaacgcgttagaaaaaagttccgtagtcagtaaaaaaacgcgcgagaaaaaaatatttccatcttctgtaaaaaaaaaaagcatatgagaaaaaactgttagaaaaaaggttaagttgatgaacatttggtcggatagactccatcaatttttttccatctcctacacgacttttgtttcatcatctattctcctatgttggagaccctgcacatctttgtagacaattatcatattatttttgtgaagtatagctattattcttgataacatattatatggaaataatcttagaaaataaacatattttaattgttatttagagaaaagtgcacagtgactctattttgtgtggacttgatcatacgagtcagtgtaggatttgattggttgcaataatgagattaaaagaatattttagattatatgtatttcattggttgcaataataagattaaaataatattttagattatatgtatgttgtcacatgaataatccaattattttaaaacaaacatcgtaagcttgccatcatcgagattgggctattgcatttaagatattccaattttttgattttttgattgtcatatatggttatgcatgaaaaacgtatattatcattaagtttttttatccgttgcaacgcaagtaacagaaaagaaaagaaaaaatctcccgattcgtccctggtccacagccgcgaggccacacgaaattcgcggatatcaactccccgccccgccaccaccgcttccttttccaacgacttcttcttcttcctgctctaccttcttggcttttgcctctgttcctcttccaagatttgcgagatggtggcggtgacgccgggcaggcgccgccggcctgcaggatgcgccgcggggcaccaccaccagcaccagcagcagaggctgctggccgtcgccgcccgcctcgccgcggcgaagccggcggccactacggaggccgccgtgtacggtggcgtaggaggaggaggatgctgcctcgagttcctcgactgcgtgctccgggcgatgggcgtcgccaccccggccgagatcatgccccccgcggacttcaggtgggccgcgcgcccgatgcggcggcgccgccgcgggggctcctcgtcctcctcctcctcgccgcgcgaccgcgagccgagggacggccggatcgc

SEQ ID NO: 56738 - DNA, 3263 bp, Oryza sativa
tactgttatgtggtcgacggcgctgtcgaccgatgttggattttccgccacatcagttgatgcgcaactgctgcgtttttgggtgggacttcctaactcttcatgcgcagcagcagcagcggcctgggtgttctgttgctcttctcggatctcttgcctaatcttggccctcatcgactcgagctttttgtcgaattcagatgtcagctcagctcttatcgacgcccggatcttggcttcaaggcgtgcatctttctccgccttgttggaagaccgcttcttgtactgccacgcgtagtctggtaatccatacttctagggaacagaagacccaacgccccgtgtccgtccatggtattccttgttgcccaacgctttcgtgaggaggtcgtcctcgcgtctttgagagcaggcctcttgtgaggcttgttgctcggcaaccaactccttctgcattacaatttagtggggttaaataaactgcatgatcggaaccaatgcaaacatctagtttgactagacacttactatagcttcgtacactcattgatcttctggatttggcatgaagattgtgccatcatccttcttctggtacctggccctggcccagttcctagccggagggtgtgggatatcaccaaacacgagcggcgtgttcgattcctccgcttcttcatcctcacgctgccattcctcttccttaccggcatatccggcggtgccaagccgatgcagatgctggttcttggtctggagcaagcgatatgcctcgctactagctctggactcggaggtcgacttctttgcatggaattcctcccagacctgttccgggatccaaggaaatttctctcttggatctggattcgccgggttgtagacgaactcgctgactagcttagtcttgaagttcttccaagcgttgcccataaccttgaaagcagcccgcctgagatggtccgcatgctccgcaggataatcgaagctctccttgaacgttagccaagcaatgtccttctctgcgccgacacgtgcttgatgtcatcttgcagaatactgaacttctgcctccctatgaccgatagacctaaatcggctcaatattttccttggagatgtcggcaaccctacggcgtccaccgctgttatgcggaaccgttccttagggattttgttccctgtcctaggagtacgtgcccttgaggacccactagttgtcgtcgatattggttcaccttgctgagacatcgtctacttttttctaaataacgaaaatatactattcagtgcttcaatggctaagaatcgaaagttctaaaatctattagtcacataaataaactaaattacacatctcacagtaataaaatgaattgaatgtcacataaaaataaattaaacatttcatctattcatctattcatccacattcatctcgaatcatctattcatccacattcatctcgaatcatctattcatccacattcatctatccataaacattcatctattcaaacacattcatctaatcatgtattcatccacatgtaaaatgaattgaatatcacatataaataaattgaataattcatctattcatctattcatccgcattcctctctaataatctattcaaccacattcatctatccatacacatgcaagtattcaaacacattcgtctatccatacacatgcaagtattcaaacacattcatcaatcgaaccacattcatctattcatcattcatgcgcgatggaggactcacctgggggtcggcgtcgggcgtcgggcgtcgcaggctcggtggaggcggcgtcgggcgtcggaggttcggtggaggcggctgcctcggtggcggcggcctcagactcagcgagggaggagtcggcgaagggcggcggtgccgggctcggtggagggcgtcgccggggtcggtggaggccgcggtgtgctcggtggaggcggcgtcaggcgtcagagaggagtaggcgacgacgatgaggaaggatgtcgccgggctcggtgggggtcgtcggtgaggaggcggcggcggtccgaatggagggcggaggaggctcggtggcagcgaccgcgggctagtggcgacggtggcgggctcggcgatggaggacaacagcggcgctagggttctaaggaggcgggaaactatagcgggacttagaaaaattttcgatctgatctgagaaaccctagttatagtagagtgatgagtcatctcaaacgggcattgccgtagggcccgtcacagatgactcatcggtgacgggctccatcacggagattgagatgacattcaggcccgtcacggatgactcatctatgatgggccctaagataatgcccgatagagatagactaatctctatcgggcttaaactaaggcccgtcaccgatgactatttttctatttttcccatcaagtctttatatttgtgagtgcaatatatatagctgctatataataattcaatttattagtcataatacatttttggatagtaaatgatttcaaatcaaaatatggtcaacaacaaaattgtagagcttatcaagatctacaacttttattttggtcatttgtctatataactttgttcccaagagcttgaaattgattttgaaaatatgacaaattaaaacagcatttgtaaatagtaaatgatttcaaatgaaaaaggcaacaacaacaaagttgatcctctcatcaagattggcaacttttattttggtcatttgtctctataactttgtttctaacagcctgaaattgaatttgaatatatgacatatttaaacaacatttaaaaatagtaaatgatttcaaatggaaaagccataaacatcaaagttgtacaacttttatgttggtcacttcttcatccgacaaagtgatagtaccaatgtttacaaaattgacatatatgtgttgatgtttataaaccagatgagagaaatgtggtttttgtgaataatgtaactatcaccttgtcggatgaaaaagtaaccaaaataaaagttgtagatcttgatgagaggatcaactttgttgttgaccatatttccatttgaaatcatttagtatttacaaatgctgtttagatttgtcatattgtcaaaatcaattttaagctattgggaacaaagttatatagacaaatgaccaaaataaaaattgtatatcttgatgagaggatcaacttttttgttgaccatatttccatttgaaatcattta

SEQ ID NO: 56739 - DNA, 2158 bp, Oryza sativa
ttcctgcagcccgaagcatttttaatgataatttcgtataaaaaaccatctgactaaattctcccctcagttctattatatttcttgacgtgttggataataatacggtctcgagaacatatttttaactatatttttattatattatttaaatttattaatgcatgtttcaaaattaatctatgcataatgttgtagtttcttcaaactagatattttaaaagttacttcctccgttttacaatgtaatttattctagtatttctcacattcatattgatgttaatgaatctagatagatatatatgtctagattcattaacatcaatatgaatgtgggaaatgttagaatgacttacattgtgaaatgaatggagtattgatagttaaagttttaattgttgatctcaatcttatccaaaacatcaaggattacggaacgggaggaagtaccaacatgaaattgataccaggcacctaatttccataaaaaaaaattttgtgggggggtgaaatgtttaagttgtccacgggtgaaacattgaaaaaaaatagtgattgaaatactgaaagattatgtgaaacatatgttgaaacatttcagtatcgcgtatgaacatgaattttcatggttaaaacataagtttacatatctttcataagaatataattatgtgatatctttttttacatatttaataacaataaattcaagatataatcggattgtaaattgaatataaataatttaaaagaaaactcatgtcaagctattttaaaaacgtagaaaagacatcggaagggaggagaatgctagtgagtaggaagataggctactgcatgcacatatagcggccatgtagcttagacataggtaatatgatgccctatcttttctatttgattggacgtctaactgaaagctttgtcgattattttagcttttttataggtgatggaataaaacatctcgatttttgcttaatgagctatatccaattattacagaattcacacaaaagcaatcttacacagtgagtttagaagcgcaccaacaaaatattaagtaagcacaaactaatacacaccaacacaagataaagctcccacaactactgaattttatttgtgaacctctacctgaagttggcgaagagctgcatatcaattattttagttattgaaccgttgtaaatttggttttaactggatcgatgtccagatttattcactaaaatttctcgggtgaacgtggacattttgtcggaatgtcctaataatagtataggtatacgtgtagagatttgcttgcactttgtcggccataggtagggtgcacctccaccattttggtgcgtagaactgtaggctgtagctaccgcagcttccatcgggtgccaatggcgacgacgctggctagaccttgtccgcccgcagcaccaccatgggagctccggtgtagaacgggccgacgcccagctcagacctcaggtagcacctcgcgccggcgaccctcgcgccctcgccgttgagcgggaacacctgccaccaccgcgccaagacgccgtcgaggcacctgcggcacgacgccggcggcaggtccggcgagcactgcgccatggagtagatgttgcggaaccccgggtcgcgggcgtcgtcccccacgcgctgccccgtggcgaacagcctcgccgggttctcctccaccgcgtaccgcacggtggccgcgagcagctcggtcaccgcgcggtcgtacgccgccacgacgccggcgcctccggtgatgttggtgccgctgatgagcagcgtctcgccgccggcgttgtcggtggcggcgaggaagtcgcccttgttggagaatcgggcgtagcactggttgtacacgagggccacgtccttggcgcggccgtggcggccgccgcagacgcggccgacgtcggcgaggacgcgggtgccgcagtcgaagcagtcggagacgctgaggtcgccgcggcagaggaggaggccgtagacggcgtctggcgcgccgccgcggatgcccgtggcgaagagcgccgactgcgaggcggcggcgcccgcgcggagcgcggcggcgaggtcacggaagttggactcgtaggcgctcccggccttgtacgtgccggcgctggtgtcgcac

SEQ ID NO: 56740 - DNA, 7139 bp, Oryza sativa
  unsure (1)..(7139): unsure at all n locations
aaatcgatctcggcaacttgggcaacttgggcgtgcgataacgcaccaatctggctgaattcacagtgatagttaggtatttgtccacgcacacaccaacgcacacgttcattttgacgcttaattgtcagcacatgcgcgcgcgcgccggggggggggggggggggggnaannntttctattctatcgctggcttggtccgcgcgtgccgctgcctttgctattctagaagccagcaactctggtttctggcagaagctgttcataaatcacaacgaaagatgataacaacgcaacaaaaaacgaccaagatacgtctcgaaacgtaagagagtaacggatctttgtttgaatgggtttatttattagatatttgttttaccctcttaggaatttttcaaacaatagaagggtacctcctcattgtaaagtaaccaaatcaaattatgcgatttttcttgtttcttaattaaccgactatagttacaatacatatagcctaaacttgtataaaatgtgaaacaacacagctttgtatagggttaataactagattttccatatctactataggaaaaaattaatatgatttataccgccctcaactatgaaaaaaaaaagacaacacacacctcatcggttaaatccggacatttaatcacatgcggacatttttaggtggttttgaatcaagttttcccacggcatactccaatgtggaaaacgagttgacgaatagattgccacgagcattttttcaacattatttattaatatctatgaaaaatttattcgcttgacgaatagattgccgcaagtatttttccaatacctttctgtcaatattgtgaatctgtgtgcttgtttgtttccacctcgttcacggaatctctagactagctatagtccctataatgcagcaggatccttaccttatcaacgtggcatatcatgaaagcaatagtaagttgcgttgtgtggtgagaaatccaactaaattatattatgcaaatgtgcaactcaataccaatacgtttgtataaatctgacaatgtacttagatctttttggtacatttttggatcaaattaagatttattagagatgggtatttctagctttacaaatcaatgaatctagatctacgattacgttgataacatttagataaatcatttaattcccgatttagataaaatttaaaactttgcaccgctataatttaacgtaaaaattttaaatttactgtgggtccaagatctaaaactatgcccaagtgacttagttagtatattaaatattgaatagtagattgaatggtgcaccatcgatccaatggttgcaggagtcggcggcacaatacctcgggctacagattgatctgtggttacaagagcgtgcagagatcggtctaggcaccaatagtataccatttgggaggttctgtgcatgcctgtcaggtgctcgctcgagatgtttttgtctgtatatctgtatggcttccagaatcaggcatagacatccatatttatatatccagtttcttccgtttaactgaagtgatgaaatttgtttatcagttttcccataaagaacacgttgtggtcggagacttggtatcctgatgatcaaccacaggcatgtaagaaattaaacatgcatgcacgatcagcctgcatcgatgcatcaaacatatggtaattggaaaaagtacgaattaccccctgatctattgcggtagtacgatttatcccccgaaactataataccggacatttaacaccccaaacacttaaaaccgaataaattacccccctaactcgatttgaagcggttttcagcctacgtggcacacacgtggcgatacagtcagcaaaaacaaataaaaacaggtggggcccaccttttagcgttttttttcactcctctctctcggttgacagatcttgcggctggcgggcggcgagcgggtgaggagccgacgccgatgggcggccagcggcggggatggccgcgggcggcggacgggtgatgagccgaggccagaggcaggcgggcacggaggccgacgccgactggcggccggcggaggggatggctgcgggcagcagacaggcgcggaggcggctgcaggcggcagacgggcacggaggtgactgcgagtggcgggtgggcgaggagcggacaccgactggcggccggcggcggggatggctacaggcggcgggcgaggatccgaggccggaggcgggcgggcgtagagaccgaggccggcgggcgggccaggaggcgaggctggcggtgggctgagcaagctacgccgatcctccatcccgcgagctaagcagggtggcgccgccgtcgtctgtccagctgtggtgactatggcgagcggcggcaactgcggcagggcgccaggcaaggctcttcccctctttctctctggcaccatcgggagagcggaccccaggccggcggcgggcgttgtggaggcggtgatggaacgcggcgtggcccacgacggcgactacggcaagtggcctcccccctctctctgtctctccgtagcgcagtcgggagagcggaccccgaggccggcggtgggcgtggagggggcgttcagggcgtgcggcgtggcccatgatgaagctcacgtgaaggaatcgaccgcggcaggcggcggaggtcctcccgcacctctctctcctcttcccctctctcggcgagcacggcaccccggcggtgcccgaggacgacctcggctcggcggggaaggttgtctcgtcgtcgtcgtccgctgctgttgcccctacaagctcgcgccaccccctccctcgccgtcgctccccgtctctccctcccctcaccgccacccgcactccaccgccgttgctgccttctctgcctgggccaccaccaccaccacactgcagccatccacctcctgcaaaagctccatctcgcgcgactcacgcgtcgccgccacggacgcggtcgccgacaccgtgcttcgcgttcgccatcgccgctcgccctcccggcacgcccgtcgtgccccctagctgatgagagagagaagagagagaggggtgaggtaggagtacatgacaagtgggcccacagctttttaatattttatttattggattgccacgtggcgccatgtatgtgccacgtaggagcaaaaccactctgggttgagccaagggggtaatttgtccggttttgagattcgggggggggggtaattcgtaccttttcctatggtctctaaatgtctctgtattcatctggaaaagtaaccacatgatagaaaaggaggcaagacgcttgagcgaactgtatgcagcacgaacgctgccatgaatcagaggtgtcgagtcgaaaatagccgtgtgcaacaaaagaaaactagcagagcaaagctcctctggtcttgtgcgattcggactgtcactgccacgaaaatcattgaagactttcttcgatgccctgtaaaagccctcttacacacggctaaatgacgtttcaagagacagttcgctaaatgacatctaacaaaaggcctatggaaataatatatttgtgtagaatagtaaacggagaaaaatactacgaaatattacacatgtacgtattaagctcagggaccgatatatacaaaatatacgtggtagagataagaaaagattacatataagaaaaaaattacacaaatcaatactatcctaatacatttctaagtaccatatatatgtactctaacaatttgtacacaggtagtcatcatgccatatgaggaaatcatgccctgtctacatgattgagctgatgttgcaaattaaatcctgcatatctacaaaacctatgtctctttcatttgtagatggagaaacttgtgatttcaaacaaaagaaaccgcggagaatgaagtgttcaatcgatcaattgtcccatattcctaatgtgctataagaaaaaaaaaggaatacattcagtccctcgatgaaccagaatccttcatagtggaaaagcatcaatggcttccgatggacacatcaaagcacatgccagcaaataactagaacctagtttctcgagcctctcttgcttcctcgtgctacattgaggccgtgtttagatagggccaaagtgccaaaaaactcggtacaaggggtgcagtctggactttagaactaaacgggtagtcacctgaaattcggccatattgcacatttaaggcccaacagtagcctagggttagggtggcccattatacccctgggaggcgccgaacccgccgatcctatccattccccatcgcctcttcacacgcgctaaccctaaggttcttctcccctgcgtccactctctctcgaactcatcggcgtcgcatctgtcctccccgccgctgtaatccaaccctaccctgggtgaatcgaagggttcctcgtccagatccatcacatccgtggcggtgcgtgcagcggaatcgacgggagcgtgcaatggatttgtacgagggcgacagcaacaacgggggcgactacggcgacagccatgatggcggcgggtacggcaacggcgacagcggccacggctacggagacgccaatgacggcaacaaccttggcggatacggcggcgggagcaccatcctcctttacggggccgagcatcgattcggcgccagcatccctacgcacgacttcctcgcgcagcctctccatctctcccgtgatggcggccgcacgtcctacaactcgagtggctttggcgagggttcttccagcagccagaaccctcccggttcaacttcggggctctcgacctcaactacggcgacaagtggtcgaccatgcacggctaccaagaccttcttcgcagtggcgaaggggatggcagtcaatgccctcctagcgtaggcgtccctccccgtaccgtgcatcgcacgctcgggttgaggggccggccaagtgctcaaggagcttccggatctgggccgcgacggggcggtcggatgtcggcggcaggagttgacgggccgcatgcgattggagctgggttccaagcgccaatggcaccgccatttggaggttcaggccatggaggcgtattcgtgcctcccatccagcctcaagctcgagccgcatctcagggtcgaggccgaggtaggggtcgcggtgcacggtgccggctgacagaggtaaggacgtttttaggtgttgcaatgtgtggattcccatttcatttgaggttaacaagtggttcatctgattagttgctacgtactacagttgttgtaacttgtcaagtacagctagtacaatacttgcgaaatgtattacagctacagttagttcgtatggttaatttctatgtattactgcttacagctcttatgttagttggttagtaatacagctattacaaaaattgtggtacaattttgtgcaataacatgacatagtgagcgccgagttcattgtgataacggtgtttaattccgattgattgatatgtcgcaaggtcattgctttcccggtttacttgtccctctaggatttcaacgacagggcatcgtggacaaatgagaacaccaaacttttttgcgagctgtattgcaagcaaatagataatggcaactgcataaggggaagaatgagtaaagcaggttggaaggagatcagaaagggtttttatgccaccactgatttggtccacgacaatgagcaattcggatttagatacaggggtttgaaaaatatgtggaccttcatattgaggttgcgtacagacactggtttgggccgaagacctgacggcaccatggttgcttcagacaagtggtgggatgacaacactaaggtacaaaaacttcactttttcgttgcgcagttttacacatgatcattcctatgcatctgaccgatgcattcattttgtgcaggaccaccctgaatttaggaagttgaagaatgggatgcccgactatctcgaagaaatggaccgcatattcatgggggtggctgtcaacggatcgacttcatttgttcctacatagcccgcaacccagccggccaaccccattgtggatgtggaggacagcgaggatgacgaagaatccgacgatgacgacttcgaccccctaagccccatcagtgttgggacgaagaggtcgcacagcatgaggagcacaccaagcacgcagagtagggctactagtccaagcaagaagttgaagagcccagccgtccgcgccgtggtgaacgaattgaaggtgcacacgagctgccgaaggagaaagcgatagcaatggacagctattcggcacagcgtgagaagaggatggatgatgatgactctcgcgcgggggaaaaggctgagcgcatcatggcactcagtagggagtgctgggtcacagaggcgactccacacttgtgggttgccatgttcaagatgctcaaggatcgagatgccgtcaatgtctttgagctgtccaatcctgaaggaagaaaggccctccttgagcacctcgcacgggtcgacaactagaccttttaatgcttgcttaacatgttaatgtatcagccttagttatatcttttgggttatgtacgctttggaagctatgaggtgctatgtctgttagtgctgctatgtctgttagctatgtcatttatggtatgttggctactgttgtgttgcaaactatgtcatgcgtaatgttggcaattaaatataagttgtagtaaggctgtctttccaaattcatttcttaatatgaggatgtttgaaagttaccgttgttattttacttttattacaggaggatgtgcggctccaacctgtggatacaaaggatgaagattccgacaaagagttcggcagagttatgatggagtactttatggacgattatgcatccaccgcgtttctgtacggtacgttacatcttgcaaaacacattgacaagtactacaaccagtcagaatatagagatgttagcacaacaatgagtgcgttggaatgggtagagaagaagcatgcagacaggaagcggtgttacaacatgtttagaatgacctctgatatgttctatactcttcatgatctattggtcgacaatttgagctcaa

SEQ ID NO: 56741 - DNA, 711 bp, Oryza sativa
cattaacatatatatgaatgtgggcaatgctagaaagtcttataatataaaacggaggaagtagtaaggatgagaaaactgcaatgtatgaatagatcatatatataggctgtataagtggaagaaaatataagcatatgtgggcttaattgattttaacatataaatgttgatatcaaacatgtaaactagcaaaaccatctcatgcacataacctagagataaaatcgcacatgaataaatcaaatgtacggaatataattaagggtgccgctttgaccacgcatgctacaaaatgttgacgatgacttgtcacaaccgagaaatgatgaaggcatgtcaccgtgaatatacagcgggaagccacacgtagcacttcccaaacaccttattcgcttgcagtgatgactatacacaactactttctttacaccgaagaagagttcgacctaatgttttacgtctgtcttagtagattttatcgtttgttttagtggatccctatttaacattaaaagtatattaattttttcccaatatccttttcctagtgcaggactttgaagtagagagtttaagagaaatgctctcccaatcgtcggtgtttgccggtgagtgggatctcgtagattgtgtattgcacatgagtgtgggatggagtagatcgattacagacaatggtgcaatatagaagtgaggggctgcaggaat

SEQ ID NO: 56742 - DNA, 10465 bp, Oryza sativa
  unsure (1)..(10465): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaaagtgaacaatcagtttagaagttgaatgataagcaaatatagtttcaacattgtaatcattaaccaagatggcctaattgttttttaccacaccatgtagtaaatatcgaaatgctgaccccttacacttgaaaatgcactaatatgacagatacagaagttagcatacgatttacaaacaggttaagccactaaatcattttcacatctaaatctgacgggagaacggccaaagcaaccgttatgaacctaaattatttgatacagtcgaaaatgagttccacttgattcttggcctcgtcaatcatcaaccgagtacaatgcttcgaccagccaatacaaaaggcattgcagatatatgtaccctggcctcgtcaatcatcaaccgagtacaatgcttcgaccagccaatacaaaaggcattgcagatatatgtaccctggcctcgtcaatcatcaaccgagtacaatgcttcgaccagccaatacaaaaggcattgcagatatatgtacccagacccagctctatctaaaccaccatcttgtacctgcaaaacggacgttggtaagtgtcagttcagtttgtgaacaatgtgactgactgcaaggtaagtgtcagttcagtttgtgaacaatgtgactgactgcaaataaggtaaattgagatcctgagagcaatgaagtttgataagattcttttcaacggtagtgcaccaaacatagaaaagctgcattgagctgctgagctcaacaaatttgactaccgcagtaatacccttatacccagcaagcaccaggtacttcgctatataaaagatacccaacagatatgcctaaacatcaaacattctataattctatcaaataagaacaaaaattcagcaaaaaagggaaacacagtacatcctatgaatgaagatatatgtagatatagtcatatagatataatgcatcacgtctccatgatgttaaacaaagctgatcagatcgttaataaagtttggcaatgaggctggcaaaaatcaatagccggttcttccattaaaaagaaaactgaggtagtgctctaacgctctgaagagacgaaataataatcaactttgctataggtgtcaaacgaagcattcagctgcatgcagcatgcctattaaaggaccttggtgctcagtacttaaatgttcctttcaacaccctgttatgtactactccactaattagtatatgaccttcctcatctaattctcgatcactataggttacttcaaatatgttatctcttagtcatcaatctcatatgtaatagctcgtgtctaatatttcgtagatgtatctctctgataattttgtttccctaaccaagcagaattcaaaatttcaggtgcacatatctatatctggtctttcaggtgcccatgagatagccaagtagcagagccagaaaatatatcctgtggccctgtggggtcaattattgctagtccatatcttagtggggtcatttcttcttctctctttttacccttttttttttggacaactgtacggcttatgtgtttactcctgccaaagccaagagaccaacataagaaaatacatggcagaattctctatgccatggacttgatttggcaatcacatactttattggagaagttttttctaaattcaaacagttttatttgaagtagcttaaaaacctgggtttgtgacctctcacaaattcattttctgatacacctcaaggaaaaaagtattagcaaagatactctgttggcttggttgttggttttgacaacttaattgagatcatcatcatcatatggcttatagcatgtgctgtatttggttattagatgtgtatgaagttatgcataatttattgtgtgtcatctccaaattctcctttcacgctactattccatctccaaaatccaaactatccagtcagagacacaatatacatactagtagtgcataaaaactggggtgttgcagccatttaggattggcatggttgatttctggctttgctcaaggttgatgcaaagaatatgtaaagcaagtatgaaacatgaaattctctaggcttttttgaccacagaaaccaaaatcaagctgatattgcttgcttcctgattataagactgttacttccatcatgctatgggaagcataattgcttaatacttcgatctgtggtgtgctgatggagaaaaatagcttctttgctactttgtgaacagacgacagaccacacaatcgtgttatcctttttggtaaaataccccaacagtcagcaagaacaatcaattgccgagtaatagattgtataagttctactgtaattgaacgaacgagcaatgcgttaacgaattctccagcgagaagttggactagggaaggaaatggcagagtttggataaattactcgtgtagatgacagtcatacccgagctaaggcccgagggccttgatggcgtccatgagcaaggcgtagacctccttggccagatcatgtcgccgcatctgcgtttgtatctctgaatcaagctgcctcctccacttgccctcgatgaatcttgcttcctctgtccctagcagtgacaaccccttcgccagggacacactggacagcgctcgcccatccgtcttccagtactcatcaagcatctcagtcagcacaggcagcatggcggcggcgtccgggacagtgcgcggctggtcggcggcggcggcggcggcggcggcggcggccctttcgtcgtcgccctcagcaaggggctcgaggtcggcgccccagacgctcgcgcagaggtcgcgcacgcggcgttcgtgcggtcccgcggacgcgccgggcgccgcgtgcaggtacttgcccttgagccgcttcagcttgtagtacaccttggcctggtcgatgtgcggggagagggagcccctgatggagtcgaagagcgcgcccatgtccgggaggcgcgggacgtggccggcgcgcgcgcggaaggcggcggcgccggcgaggagcgcgacctcgtcggcgtcgccccagagcttctggacggcgcccccgtgctgccccccggcggcgggcgcggtcccgcggcggggtccgcgaacgcgccgcgctgcctgcgcttgcgctcgcgctcgcggctgcgggaggaggcgggcgcggcggcggcggggggcgggctagggttgggggccgggtggcgcgcggcgtcgcccgcgcggggcttggggcgggacgagcgcttcttcgacgacctgggaggggatggcgaggcgggcgcggcgcccgcgtccatggcgctctgggacggccgcttggatggcatccgcgcggcgcggcgcggcacggcacggtgcggcgcggcgtggcgtgggtgcgctctggatgcgcttgcggcctcggcctctgtggggagagagcttggaaattggaatgctcgatctggctgcacactgtgcgctctgtatacggatgcctgatggttttcaggccttcgggggagagtgtgtgtgcgccgtgcgcgtcaacccgatttggccgtggccgtcgtctctgatgatctgatctgcatctactagtatattcgccgtgctgtgagtcgctttttctgctggctgtccttttgaaataaggccttgcatagataaaaaaaaattagcaaaaaacgtcacattaaatatttggccacatatatgaggcattaaatgtataaaaaaaccaattgtacggtttacatgtaaattgcgagacaaatcttttaagtctaattacgtcatgatttgacaatgtggtgctacagtaaacatttgctaatgatagattaattaggcttaataaatttgtctcacattttacaggcggaatctgtaatttgttttgttattagtctacgtttaatactttaaatgtgcatccgtatacttcaaaaactttacgcctaaagaactaaacgcaccctaaaaactatttgacagcactgtgtagtttgtagcttgggcctctttattctccaatctccatcctctttgtaatggtgaatggtgtgtatatttcaccatttctgttaggtgtgcattagtacattgaaaaggctagatacattggaggaagtgaatctggtatacacatgactttatacctctcatcatctatactactactagaacacttgattttagaaagtaatgagtataattttccttgatatccctacgactaggctggaagctaagatatcggtacaattttcctcaggtcacaagatagcgtacggataacactgcgtgaaagggtgactagaaaactagttggtaggttggactggctaggaaatgacgtgtggttgtcgacccgctagaggctagccatgggaaggttgctcgggtctagtatgtggcaacgcgcctagctcgagaccattcacgggaagattgctcggaggcgacagttcaggggccaatgcgtccatctcatggtcattcgcgggaggattgctcgaggacgcgaatggttggtcgcgtgggcgccctcggtgggggatcacatgaccacgctctaacaacaggtacaaatgaagcgtgcaatagctcgctcccatcattccacattaattaggcatgctcaccgcaagtcaaaggtatttaatgtagggatttggtgtatcacgcctcacccctcatgtctcctttctctccatctgaccaagctataccgtcagggggaggcctagtcacttctatggtagacctgtggaaggtggcatcttgtagcatggaagaattataagtggtggatggtatgatagcgggtacggtgtaggtaatgatgtatgactatagtacctttgtcagttatcccatggtgattaggtagattgtgggagagtatataacttataagcaccagatagatcaccgagtgaaaggttcaactctcctagatacacaagaacacaacacgtagaagttgtacgagctctggacttagccagttctaacacacctccggtgcaaaaagttgtccagatattaatcaagaaagcaagaatataactatcatctctcgagaggcgcgaaaacctgggtaaatcaagtgtgtatgagcttgtttagtgctaaaatatgcgatcatagcttttgaccccatctccgaacaccaagtttttcggatcctatttgcccacactaggacacttagaaactagttttataaaggtaaggttttcttactaggacacttgattttattcaagttacaatatgttttatcaagtgcaaacttatcaaattacgtgttttataaatgttttcttacttaggacacttgattttcttcaaattacaatgccacataaatcagggataaatgagaaaaacacatcaattatcgtgggtgaaaaagcaaacccttatatggtccatagccaaggcatgtctatgccatgttgggttatctttgtgtttttttaggtgaaagtgaatggaacttagtgggccttagcatcaagcttaatgccattatttttgtgacctaaggtcaaattcacttataaccatgggcccataactttacaatatggtaacattataatatttaccataatatgaagttggtatatacacctacagctgtaggtcaataatatccggtaaatgcagaaatatttgtctatgctctattgtatcgacaaacaatctccttagtgagcatagcaggaaaggtagaaacgacaagaatgtccaaatatccagtaaatgtagtacgtgaattattgtcgtttactaagactggtacgataaacgctatgttgcatgcatgtatgcttgcacgctggaaaacaaaatggcatgcaagagagtgtgagtgattttggagcttatctcgtaatgttatatgataaatttgataaagatcggataaaaatacatgtcatgtttattttggcatatttgtgaaggtgtccatttaaaaagttataattgactcgcaaagtttcatctattttttttgtcaaaactatatacggtcaagtggaaaagaaactatattccaaattaaatgttacctaacccaatcatcttcatcctttaccaactcccttataaaatcgttatcttaaccatgcatagttcattaaaccgtcaacttcattgaaacttctccgctaaaaaaactctgtagattcttgaaactcattcattaccgcaacgtatttattactgtttttaaaccaaatatcaccacaatgtaaatttcattttacttgcaccgcactctatttcgaagttacttcgatacctcacgttattgctagcgtgaagaggacggtgagtaaaggtgcctgccggtagtagtagtataacaaacccaacgagaagagcagcagagcatatgctgcgtgcctcccgtgcaaaaccgaacccgtgtcctgacgccgcgagcctctcccagccccgcccctctctcccatcggatccgagcgagactgacgcggaaaaatcgggccggaaaggagtcgaaggaagaacagacgcgaaggagacactcttcaatactcgggctcgcggaacgaagccctagcgccctagccctagccctagctccgccccccggtcctccgccgccgtccctcctcgccggaggccctacccccgacccccgccgtgttccgcgggggcctcggcggcgatgcccccttccctggccgaggctttatgagcggcggccgccgcggggagatggcccgcgccgagggcttgccggagggggccgccccgggcgtcggggtggacctgtacgcgcaggccaggaaggccctgtcggtgcggacgccgttcgagggcgaggggacggcgcctagggttcccacgctgcccgcgcggctcgtgaactggtcggggcagagcgacgcgcggaagaagcacaagaagattcagccccaggacgtggctgatgtggagctcccgccgcagccagccacggagccctctgcgaagactggcgtgtgggagcagttcgaggcgtatttccggccggtgaatttggatgatattgatatgttaatgccaaagtttccgttcggctatggcgggctcgattcgtgcatcctcataccatttgtgggcagtggcaaggaattgatggacacagctgagacatttgatgtggctgtggctgaaacaagctcgtacttgggtctgggtggtgaagaaagagtcagtaacaaggagcatagcgaacggagtgagcgaagtgagcaaagtgttgagcaaggcatacatgaggtgattgtgcgacagttcgttggtaacaaggaacgcggtgagcagagtgtagagcagggcatacatgaggtggttgtgcaacaggagaattggccattggaagtggagcaagctactagcagtgctggcattgtatcatcaaaatgtgaagaagagggagaatcatcactgaattggttgctaggatcaaaggaacggtttgtgctcacttcagaacggcccaacaagaagaggaagcttttaggtgtggatgcagggttagagcagcttgttctgctaccgcgctcgggagctgaggctagttctgtatgtgatgtttgttgtttgggggagagtagtacggtgtccaatagcatgctcaattgcaaccgctgtaaggtaactgtgcaccagaagtgttatggtttgcatgttgtgcctgatggccagtggttgtgcacttggtgtaaggatttggagtcactgcagtcgttgaagaaagatgcggacaacaccttgtcgatgccttgtgttctatgcccaaaagagaaaggcgctctaaaacctgtcaaaggggagcctggtcaaacagcgcatggggggaaccttaaatttgtgcacttgttttgtagcctttggacaccgggagctcttgtggaagacatggaatcaatggaacctgttactaatgttggaagtgtccaggagaatcagtggaaattggtgtgcagcatttgcaaggttaagcatggtgtatgtgtccgatgtagtcatggtatgtattttaccctatgtctccattttactattttagttagatgaactatatgtatatatacatttaagttatttagaatcagtgttttgcagataatttttcttgcacacttccattttgtaccaccgcatagaatttccctgcatcatgcttctactgcggtctcgagtttcttaagaccgagtcattgcttatttttttttcctttcttcaatgtgggccttcaaaagcaacctttaaatttgcctttgaactggaagatatgtagcaactttatcggtctattcaatgaaaaaccgcaaatatgctgtcactcaggtttacctgaggaggtaattctaaatcaggtgttgcacggtagcacaaaattcttgctaaaatagctgggcagtaggtgtgtttggttccttggctacccttgctaatgcacaatgaaatcattgctaggagaggagagctgaattgtcttttcatcaaaaaatggggaacactgacttgtgtgtccattaccaaaccaagcaaggcaacccagtttccttgtccactgaccttgctagataaggatgagcaaagctaccaaacatgccatttatctcatttctggtgataactttccaaaggaagtaatcctcatctgaatggatgactttgctcaactcattaactcaacgtagtttgtggcagaagtattgctacaccatacaatgatggaatattgctggcaaagataattctatgtttggcatgcgggaatttggtagaatggtactttttcatgcaataaataatgggtttacattgttacctttgttggctttatttaaatatttttcgtatatatagtaaaaagaaatgtgtatacagatatccattttagttctctacatgccaggttatcttgtaagttgtaactgcattttacatgacagcatatcaaaatgataactgggttctagtccaaccagttactatgctgctgttaatgatggataactgcatattagttagttatacctatacccttgtataacttttttgcaattaataactgaaccaacttttggggccacacacattttgtggctggttcactgaaaaactgtccactttggccagggttttacttgttcaagtcaggctaactgcttgaatgatccaacagcgtgccagactggctgggatctggtccctttttttcctttttggactgccaggccggtctggttctgataagtgtggtttacattatgtattttttgcgaacagatacataaaaccatacatttctcaatgtatgcgaacatccataatatccatttttgaagagaaattggaaaacgccatcgtaaagatatgcaaatagcaaaataccatcacatgtgagaatgacacatagggcatgggcctatatatattattgccacatatgataatattttccaactctctgatttttgtgatggtgccaagtatttgaccctttgtcaaaaaacattgcaggaagcataatatgcttttaatcataatttcacccttaattgacttatgccatatccacagacttcaaaaaaaggctgctaagaacaatgtaataagtaatactgagaacccaggctttaaagtttagttcacaatataattacaaaattatgtattttaagacactaagtacatgtgagttgacatattaagtcttagctgtgaagatggagtaagcagtgaattatatattaaactattgttcatatataatattttgtaggatagaagcattctatgatttgaattatctttgatattttctgtcagttttggtggcacttaaaactagcatcacatttttttaagtcctttaactagttatccatgtggttttcaggaacatgccgaacaccttttcatcctatatgtgcacgagagtccaagcatcaaatggagatatggggaaaatttgggtatcctaatgtgagatcattttcttcaggtgtttgccattagccttatttaggtcgctgttgttcaacttgtttgttttccatgtaggtcgagctgagagcattttgctcaaagcattctactatt

SEQ ID NO: 56743 - DNA, 1831 bp, Oryza sativa
aactggagtaacaacccttttgcagaatggaataaaaaagatggctgaagcaggcgctgagcgtgagtgttcttcccctgctgaagattgtgctaaaggtactccaaaggaagagcatggaggattggtaagatttattacttttaatgattctgtacacatgctcatacacgcatgcacgcacgcacatgtgccaatttgggaagtggaagatcattgctacatttatggacagccaactattgtttgcacgaatgatcaaattataatcttattacctacaacttggcaatgaaagtgttctctactggcagcgaataactggcacaagcatttaaagtagtgagtagaggccactttcattgtcagtgttgcaatctatacttttctgccagctgtcaggtgagactataatttgctcattcatgcaaacgatagttggtctgtaaatgtagcaacgattttccacttccccaattagtctctcttgtgtatgtgcgcgtgttgggtgcgtgtgcgcgtgcctgacatggaaacacttgcattccatttatactggttacacagcaatacttgccttaataattttatcgctaagtgttcaactaaaaaaatattaaaaacaaactggtgaatttatcattattttattatcttaaggaactaaatctttcatcataaatactatctgactcccatccttgtgacagatatcgaacaacatctctggcaatacacaatttggaacttccatggcgataccaaatgaaaataaaggtaaaatatgatgaagtatctccctctgccttttcgtctctctgtgtaatcggtacaatttctggactgtaaaatacattttgattgtttgatggcctatccttttgttctcttttgcattagttactggaagttcaatttactgttggtaattgttcatccacaatcagaattaggaaaaaaaaattaaaattccacaaagccgcaaaaaacttaaatagcctgaaaagagattgcacaacattttctctgtaatgctgcatcagctctgaatgctatttgtagttgtgctagattgactgcttttatcagaatgtagtgcctactaactttgtaaattttcttagttagttagcttacttggaatatttatatgttgatggttgtaaatttgcaagtgttgatttaacactatttatatgtttattgctaaccatttaaaatattgccactctttagtggttagttaagagtcaaggtatgtgtgctgttattattattggtaatactgaatttgttgacttgtgagatgtgatagggctggtctgttcctctatatctatctgttttgtcgcaggcatttaagggccatagtgtatgccttctcaatttcttctgtttatgttctggtttatgggcatttacggctatttggatgtcttctcaatttcgtctcacttggatagctgttgctgcaatgctatctggcaatgcatttgccctttcttcagatatcattccctttcttccattatccggtcatttgtttgcctttttttagttcttacaatatgttattacaggtacatctcctggaaagaaaagatataacttaactgaggctgaacctggctcggagctggagggtgtctcttcattgaatcaatattttcctccaggtgataatgtaaaacatgagttaaacttggttgaaaatggtgttgggaataaccatgattgcaacgcagatcatgttcctggacagcccttttccaagtaagacgaaagaaatttcaaccaattgaattatagttgttcttctatggttttactt

SEQ ID NO: 56744 - DNA, 1910 bp, Oryza sativa
  unsure (1)..(1910): unsure at all n locations
ttatttgtattttattgaattctgaagtcttatggtactcccttgtgttactaattctgacatgttcaacaggctgcagtccacataggttgctatagaaatattgagaatatttctggcccctggaagtgtgaactttgcgaagatatttcaccagaagacacttgtgttggtgatcaatcagattgcaatggcacaaacctgtccttagtgcagtgtgatctgtgccatggcacatcaggtgcatttagaaagactgcagatggacagtggattcatgctttctgtgctgaggtatttaaatgagtattatatttggttttcatgtgactcatcttgtgatatctaatatttctaatgctttcttagtggttgttggagactgagtatgtgaggggacaagatagtccagtcaaaggaatggtagtcttctatacccaacattacatttatccctttttcaattttaggaactcataggatcgtctcaactgcgtttattgtttgcacaattagaagctgaggttgtttgtcagtgttggcatatcatcttatattgcatcatcttgatgcttggctatttgatgcatttatcaggaaagtcttgtaaaggacaaagatacttgctgtgtctgccttcatactgttggcgcatgtctaaaggtacatcataatctttgctctttcttctagttcaatgcatgatgaaaccaaccatttggaatcttgataagtttgtctttttctaccattcagtgcaataatggggactgccaaaccacttttcatccttattgtgctagacatgctggtttctacatgaacacaaaaggatctggtggtattttgcaacacaaggcatattgtagcaaacacagcatagagcaaaaggaggtgagtgtattagtttaacatagaaactgttctggaatgatgagcctcttctttcctacctaagatcaggattctctactaatgctgtagataatctttcattatgataggaaatgaaattagtcaattgccttctcattttagcattgtgacacttaaacaaaagaaaggggggtggatgagggttcatataatcctatatccggtttgaaggctttggttgcatattctcattttccttccgatataatcggaaagggagcatgtgatgcatgagtagatggaaatcctgtgttggtacaattattttctgtaatcttattttgttattcgaaattgatgcaggctgatatgcaacagtatggacttgaggagttcaacaacatgaaaagaatgagggttcgtatatatgatgcatttcacttttcctattttgatctgtgatacaatatttttgttcagttactatctaaggtttctaacttccagtgcatcaaatcctgtgttccctcacttcctctttcttctagaggccctgttaatttttttttgtatttctataagtaatatttgtttttgtatttcttttttgtacttcaaacaatccttgaggaaatgtctgaaggatgtccattctcattgaacattgattaaatgatccctcaatccctgatgaaatatttacattacaattttgcaggttgagttggaaaaattgcgactcttgtgcgagaggataattaagagagaaaaggtgaaggtatgtgtggcccctacttatactttttgctttgtttcttaaaattgaactatatgaggaagctactttaagccctgtttggagaaactacctttgaccttgtgttttttcctctttgtgaatcaccttttgtttccttcatattaataggtgaaaatcttgcttgagttactcatttagtactccttccgtttcataatgtaagactttctancattgttcatattcatatagatgttaatgaatctaaacacac

SEQ ID NO: 56745 - DNA, 13486 bp, Oryza sativa
ttttgctgctacaaagggttccaagcaaacgatgatccaattgggctgaagttgtagaacggtgcaaactgagttaatgtgaacgagagaacgaaacagatgaatgtatggtgtgggatctttaccagaaatcttgctccgcctcaggtcgctcgggtgaacggcaacatgggtggatttacctgtttgaggatatacaaagatgcctttctcgcctgtacatataaattctctgtaatttctttgtacattcttgcctttgcgtgtgatagtttagcgttgcagaagtgatagtttagctttgcagaagacaaaaaaagaaataaccactctttgttgggattacaagaaaagaaatggtccattggtgcgagtcagggccaccgcggggctgataatcgctcaagggattggagacaggcaattggtaatggctaatgaggtctgattcattgctgcctgttgggatggagacggcgaaagcagttgaaatggaactgttggtttacagcagccattttaatggtgaagtggtgatagctggtatagttttagatacagcagtacagtctgaccctgttcttttttatgttgattggttgcgggtgacttgctcggagcttgttaacaaccatttaatatttcagcaaacaagaggtttttgttttaatgactagtaataacttagtctggtgtggtagtcagcttttttatatgttagatgcagataattttttagtctgagacaggtgttttcctcttgccgtccagatttgtaacttgggttaataatctttcctaccattgggagccacacagacgatgtaaaaaaacattttctaaagattttagtggtacttatgttcatttgttgtatgcttggaccggaccccaagtacctggtgtatatttccaaatattgatttgtcattaattgtacgcatttgcatttttgttttttagtcgtcggaaagctgagcttaaggctgccgatatagtaaaccgttgtatgacgtactgcacgtaataatgctgctgtccagtactcatgttactgtattgcaatattggtatgcgttcagtattgcgtttgcttatgtcacccactcctatttcggtacgccagtgtcctgcctacttgtcataggcttgtttagactcaattttttcttcgaacttctaatttttccgtcacgtcaaatgtttggacatatgtatgaagcactaaatatagacgaacaaaactaatcgcacagtttgtatgtaaatcgcgagatgaatcttttgagcctaattacgctatgatttgataatgtgatgctacagtaaacatttgttaatgacggattaattaggattaatagattcgtctcgcagtttacgggcggaatctgtaatttgttttattattagtttacgtttaatatttcaaatgtgtgtccgtatacttaaaaaatttttagcacaggaactaaacacatactgatgtactacatgagggttcatacaagatttaacttgtaaatttttggggatttaactcgaatgatttagctggtcattactactacctccgtctcaatttaagtgcaattatggatttttgtgttcgttatttcaaaaatttatgagcaaacttttttaaaaaatagtcacacctaaagtactatttatgttttatcatctgataacaataaaaatattaatcataatttctttaaataagacatatggtcaaacgttaataataaccaagacaaacctatactcttttttggatgaatgtagggctataatttgcggccgttctttaaatttttggagtcatcgtagcaataacagtttttttcctctacggcgttgatgtttagacgcgtcccagcagatatgggcacgtcgcaaaaatcactgtcataggaccttacacttactttttagagtacagttccctttcccaatgtgtaccttgtccccttatatacagaatacagtactgctactactatttctccctcgattaaccgttcttccacggttaattatcacttggatggaaccaccgattagtacatgctcgagaaacgcaatgcacagtaacatgtaagcatgatacgctcgtagtcatagagcattcaggtggtgtttaaaatagattaagatgaagacaaagtcagtgtatacaaaataaaaaaactatttgcacataattaattgagttttatttattaaaacatgtaaaaaaatatttgatattttaaagcaacttctatatagaaagaagcataccgtttaaccgtttaaaaatgtgctaatgaaaatcatgaaaaaaatttacattttaatagaaaataaatggggagagatatattgataaataagaattagatgctcctctactattgttgacaggtgatacccgtagacctattatgagggtatcagggtacgctggagtaggatctacacaatacgatatcaaacacacagaatacaaagattatactggttcagacccctcgtaaggtgataggcttaatccagtttatatgagattatgaagaaaaccacagaaattaagagaacaatagaaccgacgagtaccgattagacctttgtcgagattaactcgacgagattaaccggcggcttggctccgagtcctccgaattgattatgctatgcccggttgtgagattatgattcgatgatcccgtatccttgagagctttgtatttatacccctaagtgtcttggccttcaaatagaacttggagaataccttacgcgtacgagatcacagagtccgcaactccttcgaatatgactataacaccttatatttggaaagacagttttcttatatatctgctgaattccttaggactaagataactttcccgtatattcgagggtatatcatatctgtacactgcacaaccccaaggatactgaggtatgtcttattcataccctgataactactagataataatcattgtgaaactagtaaaaaagtagcactgagtaatatgcttgctgattacacaaatatgaacaaataaataaagctatttacagagtcgacagaaaagaactacttcctccgtccttaaaaaaaacctaattctaaatttgaaccaggttcaaatctagaattgtgtttgtttttggactgagggagtaggttggaatcatctggctcgtagtcgtaggagggtgaggactaaccaacattttattgataggcttcacgttaatttctctactctgttcagccttgctgtacagatcagtacccgtgcaggggcgtgaaaaaccgccgcgagatatactagcaggcaataaacagagccacaatgtcagctagcgaaggcaacgacgactcgttgcaggcttgcagccatccggccacgacacgacagtatacggcacgaagccgagccgaccagcaaaaatatcgatcgggacgaatgagcatccgtgatacggtggtagtactgtgacaggccatgtcggtgtggtgcgcggcgcacgcgatgcgaccccccaactccaacttgaccgacccttcgaaaagccaccaccgccgcatctccaaccgatcgaccgaatcctgttgttgcagccgcgcgaggcgccgtcttttgcagggaaaatcgcacgcacacacacacgcactgatatctccaggcttctctgcttctagacggtcgcgtcgactcctgtttttctgtcccttttcgccggggagatttcgagccgcccgtctcacgggagcctctcttctcctctcttgcattgcatatttgcctgtacggccctacgttgcgtctcgtcgttccctaccagcactgggtcaaaagcgcaacaaaaggccagtaccctcattcaggcagcttgggtcggcagctactagcttggaccaatgaacagtgctgattgctgaccaatcatccagcgaattgttgcttttggaaaaagaaccggaaggaggaggaggaatatttgctcctgtacatgtgctatctccctcgacgatgtacgtgccaggagcagggcggcgagggagagcgattcgatccgcgagtggctcgggctcggcgtgtggctgggctccgataccccacgttgctttcacctccaaagcgcggattattcggtgccctgctgctgcatgcggttgttcgattgatcgatcgatcgatcgatctgcttcgatcgttctgatgatcctgcagggtctcggtgaccacgacattgcgatcattgcaatctagttgttgttgttgttgttgtgcggttcgagatgatggatgggacgggagccgtgccctgcaccggggggaagtggagatcgatcgaagccggtagcttagctttctttcgcttgcaagctagtatagcacgcaggagaggaagagaagagaaaagaagaggatggagatagatcatagatgcccacgcgctagctcgagattttcttgttgacctcttgaccccggccatcctcgaatggcccggcactttctgccggctttgtgttttgcatggagtttgctgctttactcgtacggcactttgctttgtgcgcttggcgcctaatcatgagcgtatcgatcttattgctgtcccctggagttaatcacgccagttgtgctaatccaagtgtgtcttgatctctcctcgctttgttagttgtaggataattaacaataactactaaaatgaactggagtttctagctaggatatcatgtacgtcctgattggttactctaaagggtagctatctgaaggggacgaagttgattgcaggcccttcccacttaccatggtaggtcactttttttttttcatgtgtggtgatcgagcgagccaaacaagtaccaaagcaggtgtactccgtcacctcgtgacaaactcgcaaagctccattttgtgcacttttcctttacgaaattattattatacactatcttgtgagcactgataaaaagtcgatcgagcatcgtactatcgatcaccaacgtacagcggatatctgctcgcaatgccatcgccatcctcctcctttgttagtttagctttttctcctttttttttcttcgaagaatttagttgagcctttcgtcgttgtaccgacaaagccaacgtggcaagaggctgcggggccggcatgcacgggcgaaatcgaatgatgggtgcctccacgtccaccgatcgacgcgtcttgagcggttgagccccgtacggcttccgcaccgcacaggaggggatcgatcgatcgatcgcgcgtgcactcccgttcctatcaacgacaacgggagccgggcgggagcaaaggcgaaacaccgtgtggcgcccgccccgggagcggagcgcgcaccaccaccaccaccacctatacctcgctgtcagcttgccaacggagagagggggctcgcgctcgcgacggccacacgcgcgatcccgcgtccatccacccatccatcatccaccatccccaccgtggtgccgtgccatcgcctccgccttatcgtctccgcgcgcgagcgcgcgatcacgttacgtagtactacgtcgctcgctcgcgtgggggcggctgcggcgttgcgttgagttgcggcgaggcgaggcgaggcgtggtggaatcacgcaaccgttcggtacacccatcgggcgtttcgcggacggggggagcagacgttgggtctgtttagagagcttctagcagctgcagcttcttctagaatctccagttaccagaagctctcccaaacagtatagttttttttacctagattatgagaatatgtgcttgtagaatctggaaaataaactagaagccagaagctaagtttttcagtttcttcagattttcaccagctagtttctcagcagttgtttctcaaaatcttaagctcactaaacaggcccgttctcgtagaccgtggtggtggtggggggaggaggattacaatggatgatgccgcgccagatgccaagcgcaatagggcacgtatgcggggtggccaccggacaggtgagatggcttggtggtgacgcgaccgtggccatgttcgtgggtcgggtggcgtttggctgttcgggtgcacaacggccgggatttttctcccctgttggtttgcccttttttctcggggggcctgcagagcttgatagaccctagatagctgtttgtgaatagcgaaagtggcaacaaaaggagaataaaagaggatatgtatacagtcttgtgctggtgcatgtttgatttgcatgctaattttagttattgatgtagtagtaatattgaggccaattaatcagggttgtatagtgtacatagctttgtgtgggaaatcatttatttgaagtaaaatgtactccctccatcaaaaagtttaagatatattttattttctggttttttaaatgagataaacatatttgtagtttctatgtgctaaactaaattatcgaccaatacctgaaaagctatcttaatagtcattggttgcatgcgtataatttctttcgttttgtcacatggtgtatgagttaatttctatttagtttttagtgacaaaagaaaaatatgtcttatggctggtttggcaacttgaggaaaaatgattggaagtttagatgagggaattgatggtgagattaacatgtgaatttgatttttagtcacaattttatttttgatagaggtggtgggaattgacaaggagtttagttggtgactagattttaaatgaaaatggatggctaagatttatttaggcaacgtaaaggagaaatttcctatcaattactagcccctacccaaatattaaaaaggagggagatcttccctcaattccccatcccatcccacgaaaactcatttgtctctcaaccaaatagaatagttaataacctcatccttttaaacttctaatctctcataaaaactcaccccaaccaaatacacccttagacttttggatgaagggattacataactacaaccattttaactaaacgatcgtaaaattacaaatttaaggtattttatcacaaaactatagatttagtaccaaatttataataaaactacaaatttaatgttgagtatcataaaagtatagatttaatatcgaagaagtcatcaaaaaattataacctttattagagtttaaatccataacactacatttatgttggagctataaatggcgtagttttgtggttaacttggtactaaatttatagttttatgataatttagctacttaatgtatagttttataatacaacactttaaatatgtagttttatgatagtttggtcgaaatatttgtagtgtgaataagctattttttcaaagaggatgcccccttgtttttacatgtcacgaaaacgccataaaaattgaaaaaaaattgatagatatatgatatatatcactctacaaatctaaattcgacctatacaagcaggaaaaaaacaaatacgattgttgatagtgcacattgttaaattcaccgtgggtttttgtgtagcatactcttacatgcccaccatgaagatccaacattagcatctatagcatgagtcgacaagagaagtccatactcatattggaagatatactttcaatttttctttttttacaaaagtatacttttttaaagagaaacgtatatactagtactaaacttgctgttatcaccaatcatatattcgaagttttgccatcaaaaccacagttagccgtggttttacagtaagcatgcaaggcgtgcatgcatgccttcttgtattttaatcgattgcttcattatttatcttctaaagttgataccagtaaaaaaaggtacacgttacttttgtagctaaaggttagtttaacatatatagaccagtatcctcatgaaagggagctgatacgaaaaccatgtattgcattataaagtttatgttctgaaaaggggccaactaaaaaaaaagaatcaacacgtttgcatcgatgacctataatttatcatgttaactttagaaaaagaaatatgtacgcagtatattgtgatggtctagactatataacattataaattaattagtgaataaattatagtctggaccacttatatttttcaagttttttattttgaaccaccatttataccatattttcactttaaactagtaattttatctttgttgtgattttgttaacagtgaaatttggtaatcggcaacgacgtcatcgggttagaatcattatcggctgcagcatctcgccgatgggagttatcaagtcgccaatagtcggattcctgctatattcggttaaggaaatcaatctactaaaggaagcttatccctaagtgaccgagtttaaagaggatgcggcatgacagtttatctattaattaggaatagtttgttagtttccttttatctttaggaaagtgtgtttagtgtctgataaggactttatattttccttttatctttaggttagtttctttcttgtccgacaaggacttgtatcaacccatgggtataaatatgtacacccggggtctatgtaatctatctccacgattaatacaattcggcgcatcgccaccccttttaccttttctaccttattttatcatccggcgggacttggcacccgacgcggggctgcatcggtgttcgatctccagcgaaggggtaagtccaatgtttcgccggtccgagcaattgtatcgtctacgtcggcgtcgttcaaggctgcatcagtacattcgacctcttggattgctctgatttggatgatatatttgcctacctatttatcatatgtctctgttaatctagtcttagcatatcaatttacctctatcggctgcttctcgctttagggtttctgccggtatcggctaaatcgtgttgctagattagattagcttagatatctaccaccctaaaaatcagttaacggcttgattgtctagatattatgtttcttttcatacttagtgctgcatcagttaagtttgatctactaagtcgtgtttagaaccataatctctagcttgcttcttgattgccaataagggtttcatcggggtttcagccgatgagttatgtggacgttgcatcggcttacaaggattgcatacatattggatttagtcgatcgtaacaaaggtttcattgtttaatccaatcttgtggattttatgacattggacctccagccgatgtatgctttaaccttcggatcaatgcttattctatcatattgtattgatagccgattggtttataccggattatattgttgtcgtattttattatcatcagtcgattgccgttatatcattatctacatttgacatatagcccattgcttaaaccctatcactatcggctggtatcggcatcggctattatcggctatttgctggaactactccatcggcttgtcagtcgattggctattttgatatactatttgcatatcttgtcagttgcaggatcaaactgactggcacgctcgcatctcatcatatttggacccgcactggagctaagcagatctcctaggctgcaggcccagtttatttgcaaggaggtgtctttccaaattatcggcctttgatcactgatgcccagccatctatttaggcagtttcccccatcgcaccatcagctcagctgacggcgccggcatcgactcccttacctgctccgtcagcattggcactaggccagctggtgaactctcggttgttaatgagagagcaaccacagcatgtgggcaggttgcgaatcggctgacgcaagatcaggttgctgccatgtttctgccgcctcaacctgctgttgatccaatacaacagcaaccgattcaacagacactcccaatttagcaggttgtacaaccaatccagcaacaagttgtgcaatcagtttagcaaacgttaccaaggcaacagcctccgcggccgattcagcagacgccattaagacagcaaatcggtcagccgattcagcaccaaggctcaatgagcgcatcggccgggcttgtgacgcctggtggacagcctatacaacaatttttaaatcaagtcgtcacagaacacttggttcaccacgtatagccagatgacacagtaatgcctcaagttgttcccgagcatttggcacgtaatattcaaccgatccttcataattaccagggggggcaacttgaattatcaatatcagtctccttccccgcaagcccaatatcagccagggggactggctcaacctcagtttgcatctcagtatggtcagttcgagcccatgcaacaacagtcacagggaacagctcagcaacgaccgtgggccaatgtgattgctgatgtaatgagggaacggtttgggcttaaaccaaaagagactggaagcttgtaccggcagccttacactgagtggtttgagagagttcctctccccaatcggttcaaagttccggacttctctaaattttcgagacaagatggtgtgtcaacttatgagcacattagccgatttttagctcagtgtggtgaagcatcggctgtggacgctctgagggttaggttgttccagttatctttatctggatcggcttttacttggttttcttctctgccgtatgggtcgatcaatagttgggccgatttggagaagcaattccacagctatttctacagtggggttcatgagatgaagttatctgacttgacggcgattaagcagcggcatgatgaacctgtgcacgagtatattcagagattcagggagatgaggaacaaatgctttagcttgagtttaactgacgctcagttagccgatttggcctttcagggtatgattgctccgattagggagaaattctcgtctgaagactttgatagcttgtcacatctgatacaaaaggtaaccttgcacgagcataggtctgcggaggctagaaaaagctctaagaaggttaatcatgtttgtccttacatgtatgggtcggatgacgatgaggatgattctgaaatagctgcagccaaatgggtgagaagtaaaaaggtcataccgtgccaatgggtaaagagttctggaaagaaagagaagtatgattttgatattactaaagctgacaagatttttgatctgctactccgagagaagcaaattcaactccctgttggtcatacgattccatcggctgaggaattaggcaaaaagagatattgcaaatggcataattctaggtcccattctactaacgattgcaaggtttttagacaacagattcaggtggacattgagggaggcaagattaagtttgatggttccaaaaagccgatgagggtcgatggtaacccatttcccgttaacatggtacacacagctgaccgaacagctgatacggggcgcatgagggattatcaagtaagttcagctagaattataaacaaatatcaaagaaaatacgacaagcaacaggaaaggcatcatgaagaagataatggtggctttgatccttattggggctgtgagttcttcaggttctgttggaatgaaggtatgagactaccatctatcgaggattgtcctggatgcagtgatgttgcagggggttcaagccgattgtacgatagaggcaatcgaccaaaacagacaagagtacctgttcatcaaagattgggcccagtaaaccaacgtggtgattcggaagatgatgaaaataggaagactcaatggtgtccttctggtatttttacgaagaattagaaaagaagggttcaaagattgaggagtagggaacgcttccaagaggtcgagcaagaaattgatcatcggctgaagaaagcaaaaccgaggcaggagtggcgtgttaagaatcaggctcctgtagccgatgatgttgcagccgatgaggcaaagaggttggcaaaaggaaagagtattgtgacggcaccagttaacatggtttttaccttgccagcagaattcgggatcgatcaagccgatgtcgacgaggtggaagaggaatcggctaagttggttctatcaccagaacatgcggtgttcgagaagcctgaggggacagagaatcagcatcttaaaccattgtatataaatggctatgtcaatgggaagctgatgtctaaaatgatggttgatggtggggccgcggtaaatttgatgccttatgctacgttcaggaagttgggtagaaatgccgaggatctcatcaagacaaatatggtgctcaaggactttggtggcaatccatcggaaaccaaaggtgttctaaatgtggagctgacagtcggcagtaagactattcctaccacgtttttttgtcattgatgggaagggttcttacagctagttgcttggaagggattggattcacgccaattgttgtattccttcaactatgcatcaatgcttgattcagtggcaaggcgacaaaatagagatcgtaccagccgacatgtcagttaatgttgccagtgccgatttagctctttgggagatggatggccttgattgtttatctggaaaagtttgggatggagattttctaaaagtgtccgattctgatatacagccagttgaagatggagaacccaagctattattttgagggtgtcgtggagggttcaaatgtctacactaaggatacggtagatgatctcgatgacaagcaaggtcaaggttttatgtcggccgatgatttggaagaaatagatatacgtccaggtgatcggccaaggccgacatttattagtaagaatttgtatccagaatttagaaccaagctgatagagctcttaaaagagtttagagattgcttcgcttgggagtattatgagatgcctggactcagccgatcaattgtagaacatcggctacctatcaaaccaggggttaggccgcaccagcagcctccgaggagatgcaaagccgatatgcttgaacctatcaaggctgagattaagcgtttatatgatgctggttttattcgtccttgccgatatgctgagtgggtttctagcatagttcctgtcatcaagaagaacggcaaggtgagggtatgcattgattttagagatctgaataaagctacaccgaaagatgaatatccaatgccagtagccgatcagctggttgatgctgcgtcagggaacaaaattttgagttttatggatggaaacgcagggtataatcaaagttttatggctgatgaagatatccataagacagattttagatgtcctggtgcaatcggcttatttgaatgggttgttatgactttcggcttgaagagtgctggagctacatatcaacgggccatgaattatatttatcatgatctaatcggctggctggttgaggtctatattgatgatatggttgttaaatctaaggaaataaaagaccacatagccgatttaagaaaagttttt

SEQ ID NO: 56746 - DNA, 2352 bp, Oryza sativa
cgaggttaaggcattatttactatccaatgaatgtactattatatgcaaggccgacgttgttagatacatgttatcggctccaatattgaaaggaagggttggaaattggatattttccttaactgagtttgatcttcggtatgagtcaccgaaggcgattaagggacaagctatagccgattttatcgtggaacatcgtgatgattcaatcggctcagttgaaatggtgccatggactttattctttgatggatcggtgtgtactcatggttgtggtatcggcctagttataatttcccctagggggcatgtttcaagtttgcttatactattaaaccttatgcgactaataatcaagctgagtatgaagcagtgcttaaagggttgcaattgctcaaggaagttgaagctgatgctattgaaatcatgggggattctttgctggtaatcagtcaattggcaggggactatgaatgcaagaatgatacattaatggtttataatgagaagtgccaagaactgatgaagaaatttcggctggttactttaaagcatgtatctcgagaacaaaatattgaagctaatgatttggcccaaggggcatcggggtataagccgatgatcaaagatgttaaggttgaaattgcagcaataacagccgatgattggagatatgatgtgcatcaatatttacataatccatctcaatcggcttctaggaaattaaaatataaggcgttgaagtacactctattggatgatgagctttattatcggatgattgatggagtgttacttaagtgtttgagtgccgatcaggctaaagttgcaatcggcgaagttcatgaaggaatttgtggcactcaccaatcggcccataagatgaattggttacttcggcgtgcagggtatttttggccgacaatgctagaggattgcttcagatattataaggggtgtcaagattgtcagaagtttgggacaattcaacgagtgccgacgtcggctatgaatcctattattaaaccgtggccattcagaggttggggaattgatatgatcggtatgataaacccaccatcaagtaaaaggcataagtttatattggtggcgactgattatttcaccaagtgggcggaggccattcctttgaagaaagttgattctagggatgcaattcaatttgttcaagaacatataatctaccgatttggtattcctcaaactattacatctgatcaaggttcaatcttcgtgtccgatgagtttgttcagtttgccgatagcgtgggtatcaaattgttgaattcttcaccatattatgcacaagctaatgggcaggccgaggcatctaacaagagcttgatcaaattaattaagcggaagatttctgattatcctcggtaatggcatacccggttggccgaagcattgtggttttatcggatggcttgccatggatcaattcaagttcctccttataagcttgtttttggacatgaagctgttttgccatgggaagttagaatcggctctagaaggatagaattgcaagacagtttgacagctgatgagtattataaccttatggccgatgagagggaggacttggttcaatcgcgtttatgagcccttgctaaggttaccaaagataaggaacgagttgctaggcattataacaagaaagtagtgccaaggatttttcgaaaggtgaacttgtatggaagttgattttgccgattggaactcgggataacaagttcggcaagtggtcaccaaattgggaaggactgtttcaaatctataaggttgtgtctaaaggggcatatatgttgcaagggcttgatggtgaggtttatggacgagcgctcaatggcaaatacttgaagaagtattacccaagtgtttgggttgacgcatgatcggctagtgttgctgatgcatgacagccgatgtgttttacatcgtcttgagatggccgatattgttatatcgcccttagtcgtttttctaattgtaatcggttatggtttgccgatatataacggccgatattgttatatcgcccttagtcgtttttccaattgtcatcggttatggtttgccgatatataacgaccgatattgttatatcgcccttagttgtttttctaattttatcaatgctgttgacattataaaattggggggcacatatatacaaaaaatgaaagtgaaaattagaagttatgttattcggcacaaaggattgttaaaacagcagggtattaaggtatcttagccgattacaggaatttctaagtcctattacacaaaagttattgagacaagtactgctggatagccaaaat

SEQ ID NO: 56747 - DNA, 19175 bp, Oryza sativa
tttcttggttacatcggttggttccctgatggcgccttggaggagggttgagacctaagggggcatgatagccgatgacagggggagacaatctgcctccattaggaatcagacctagggcatattcaatgttcctaccactattgctctgatgtggaggggaggattctgttgtctgcaaaacaagaacaaaagattagtcaagtaatgaattggctaaccgttatgaaatttagtgatgacaaagtttacctggggtatgacgtcagggaatagatctgtcatatacattgtggccgattgatgaaatagatgcaacttccattcaccccaccatctgtcaaagttcctactcctaaatcctgctaactcaatattgtcgatactgcctaaggaaggtccttggaggttaagcagtcgatccatcattagagttgaagaaatttctcctcggcattggatcttgtcagcaaagaataagccgattgggagttggtctaatccaagttgtctagctgaacttatagggtgatagaattcgtaggagacttggatatttcttccttggtgaataccgacatgtaggatgcatgggctgattgcagctgtaaagacttccctggacgtttgatatctttcatgattgatgtcttcaaatctgaagtctaatgggagctcaaggtctgctaagtcttcataaagaaaccaaacccgggcatctttctggaagccttcataaaagctgcagaaccaatctttgagcagctcagccaatagttttaccccagcatcggctagtgtggatgcatattctccatatgacatgcatctgcgatgggtgcgttcttctccatcgtcttctacaattggctccaaccttgggaattcagcttctgttacatatggccgattgacaactttcatgactaccaggtttagccaggtctgcagtagccaccatggtccacctgctccaactattgagccgacggctatcttagccgatgcattgttcaacatttggtatagatagccgagaaggattttgcccaaggggaattgtttctttgatcctaaggctccggctacaaattgccaattggttgtgagaccacagctggatccacaaaagagaaacttttctagccacattagcaagaaagctacgtgctctcgaggagtgacaggccttttgcccatgtatgccgctgcataaccagaccaccctcctatgcttttggtcttgaagtcaaattggttcttggtgttcatactcatagggttagccgatgaagttacatctaatccagtaatcatgatgatgtcgatcaaagttggagtcatcggcccttggttaaataagaaggcattgatggtgttggaccaaaaataggtagcggcagccattagaggttcatccttagcagaattggctatggtgagagaaagcgcttggccgatcccaatctcatcccagtggactttcttactagccgatatgcgatggtaccaggtggtccagctcttatcaggggtaggcctttcgagagatggccaagacttgaaggtattcttccagtgacccaggttagggttagctagtctaaaggggattatgttggtttcaccaatgatgaaatcagtggggtcaagattgccgattgggccaagaaaataatggtttttgtgcgataggctgggaatcgcaactaggttggaaaggtgctgcaaatccaaaggaatcgggaagcagaaaacataatgagaaaaggagaaatcgatttcatgcgaggaaaagggatctagccggtgagaacttacctcagcgtactcggctgatggcgcagtagacgggctagtggaagacgacatcaccgcaggcggagatctgatcagaagcgaaatcgcctggggatcgcttttgcgtcggaggaatcgccggagagagaaaggacaaagttttgcttgagcggtgaaaacggaagtcacggcgtgagatttctcgagggcaacggttggtatttaaagcgatagaataacggtcaaaaaacggcagagtgcgaaacttgctcggagtcggtacacggcaaatccggaacattatcaaatatcccggacttggggggcatgtgttaacgaccaaatttggtaatatcagcatcagaaaaggagattagatcgaagtggagtcgaaggcggagattgatccgagaacagagcaagaatcggctgaagtccagatcggctacgattaggatcggctgggtctgagtcggactaggtaagccgatgcagccgattccgacagtataatttggtgtatgacatcgggttgaattgaggtgcttcaagatgatttccgcacatggatagagtcccaagaaggcaattgtatctattaattaggatgttttatgtaacttccttagagatatgtttgggcaaaagtctgccgcaaagacttatggtatcttagtgtttgttaaagatagtggtcatgtccggtatggacatatcttgtaattctcgagtataaatagaccccgagccctatgtaatttttaacacacacattcaatacaatttcggcgcatcgccacctttttgctttagttttgtttcgacgagttcttgctttcgggttgagctgcatcggtttcgatcttcaacaagaggtaaaacttgttatgacgacttgtgttctcgagattagtgcttccatctttatgacactctaatcttgtctatataattcgtcgagttattatatatcttacataatctttggcaatatcgtcatctaacctacaatcggctaacatctgttaatagaaggcagccgattaggttaaatagcgacgttgtcctagattatataagatatctaccactttatgaaacatccagcggctttgttgtctagatattgttcttcttttcatacttaatgctgtattagttgagtttgatctattaagtcgtgcttagaatatcaatctctagcatgtcctctggttaccgattagggtaatatcggagtttcagccgatcttatctgatttaaccatattcaatctatatgcttcagtgacatgttaaatatgccctttatatcaagatcttattgcatttaagtatattaagcttttgtttggtatattatacttgttttgatatctttatatagagtagtatcggagtattaaccgatacatgctagatctatctgatcggctatgctataaacatatataatcctattattaatatatatttcgatttaagtgatttatactgtctcggcatggtgaccgatctatcccaatcatttgattgaagtatatattaatataagaactatatatcgttaatatctacagcctatcgaatagatttagttccttactatctatttataaccactgatcgattcataaatgacatcggctcaaagataaatgatatgtcatcggcacttagccgatcggctatcatttatagatttaaccacaaattctttgtctctatttcttgttgattacaggattaaatcaactggcacgctcatacattcgaagacgagctttggacctgcactggagttaagcagatctcccaggcctcgtgttttctgtcaacagatttaaaccacccaaaccacttttttaagcacatcaataaccaatattggttccaatacactgataaactccctccccaagctatatctttgtcggaggcgtagttagatatgggtatataagagaattggggtggtccagagtgagagagagagagtaaatttaagtatttaactaatgcaaagcgaaaggattagtcaaaagatagtataaattgaaacattggcaatagaaagtagtctaagctacaattcactcaattaatatacatattaatttgtcgaaacacaacgaaattgtatagcagatgcaattctacttgtaaatgaaccttaacctgcgatttgcgtagaattacgtgaaaattttgggtagttttattagtacaactttacaagcatacaacacatcttgtgaccacaaagttggctgacataaccaataatcatgacatacatgtagataagcaatccagcagtccaagatgtcggtctactcatcgtgatatgatatctatcctttcgagaaagacaaccattaggcgcgtgcatctgttaaaatttaaaaagaaaactcgtaggtaggagtagttgcgtattttatccaaattactagtagaagagtagtagtacgagatatctgtgtgcatggtgctctcactcgtgcaaagaaacaaattagtaaaacattgtggccctagctgcctggaataatcctggatcgctaatccatcacaccccctgacaaagcacctgtcatttggtttggagctagaatgatgtgagatttcccctgtgacaacttccctgtctaccagtaagactaacctcagaataactattgaggacgacaacagagatatttcaacagagataaagattgacgagaagaactgaatcaatagcactgcatgcaaccacacagattattgtggcgtatgtatgtgtatcatcctcgatcaaattaaaggaacgcccatatctgcagtcatgtcgatcgatcgcacaccatagatgagattgggttaatcacgcatcccccaccatcactggaaaagataaccgaaacagctagaagcagaagcacaaagaacaaaatccaatagtgattagtactcaacaacagcagcagcagcagcaacaacaatctgacgaaccattccgtcatgatctgcatgccaatccccaccatctctcgtggggcagcacacactgcacgaacacacgctattccctcccccacttggccggatcagttccaccacaagctattgccaccccactcgatcccccggtgggcgccaccgcccgggtcatcggcgattcgtgtaggcgccaaacaggctcacatgttatattttggatttttttttagacttgtgtacttttttccttctaaattctatgcaaatagttatgaaaaagatttaaagaaaataacaatatagactacagtgaaatctagcgcttaaccgaaaatcaacatcaaattcgacctacgtattaaagaagaaaaagagacaaatttggatataaatatatagtgccactactatttaccaactgaaactttttatatcttagtaatatatatgatgagttttaacgacctaagattttgtggagcgatatatatatacgctgcataaatatcatctatttttttcagaattttttgtaactgattgaattgtttttagatggaggaggagacaactgagggagggttcaaaacagtttcccgtttttgagcataacaatctctctctcgttcactgcagcggttcacctgaaccctgatattccccgaggcccgcgtgtcagcgacacgggagccggaaggaacgcgagcacgccatgacagtggcggccggcttccgtagcaaaggacgtacgtacgccactgccactagctaagctaaagccaaactcctcgcccgcacgggccgcgtcctataaaagacacaccacgcgtggcagagcacaccacgccccaattcgagatcgatcagctccagctcgtggagtgtgcgtagcttgattgcacttgcgcagcgaggttaatcagctgcaacggcggcgaggtcgtcgtcgcggaggagaggacggcgtctgtttcggtggttggtgcttccgccatgctgcagggggaggagaagaaggccgggaaggtgaagaaagggtggctggcggtgagggtggggtggagggcgccgacggcggcgacggcggcgggttccggcggttcgtcatcccgatcgcctacctctaccaccccttgttccgccgcctgcttgaggcggcgcgcgacgcctacggctacgactcggccggcccgctccggctcccctgctccgtcgacgagttcctccgcctccgctcgctcgtggagcgggagacccacgcggccggcggcggcggcggcggctcgtcgtcgccgcaccgcgtccacgccggcggcggatcgcaccaccaccaccactactccttctccccgtgcacccgcgccaaagtcagctcctgatcgatcgagctcgcttccgtgcgccatggcggagtcgatctgccggcgaggacgccccgcgtacgtgtacagtagcgattagctatagctagcagagacagtacacgacgagaggagagtggagtggcatacagtagctaggtgattagtgatttgctccgggttttcgatctcatgattttggtctcttgatttccccttcttcttcttgatctttttgatcgatcttgtatagacgcatgtatgatagaattgacaggtcgacttatgtatgtataattatcagttgaactcacagttcatagctattatattctcttcacacattttatagctcgatttgcttctctgtccattgctaagccagacgaattaattagccgctgattgatcaagacggattaggcatgagctcgaggtcgaggcgattgcttctgccgcctgccggcgaggcccacctctcaccaacgccggcacggcgaggagtcgcggcagcggcggcggtagctcaccgtgaaagccgccgttgactgcgggtcagcgagtgagcccacctgtcagagagaggagttgagggggtggaggtatatttacacaggaaaccctcgttttcgtcgaattatctttcacaacccctgagaattgggtcgcgattaatggtagcgatctgactagaatacctcttcgccgttcgatcaaactctgcagttcagattggttggactcgagtgcaggtaggacgttttcgttgagaatactcccgagagtttggatcgcgaccatcttggatcactcttcatcgtccgattatcatctgacggtcgatatcaatcccattggagagagtaggacttgtttttcataaaaccctcctctttgttcgtattagagcagatacaatagcgggctataagctagttataaatatattttaaaaagataaagtaagagagagaagagcaaaagataaagtaagagagagaagagcagcaaactacagatatgtagccagctgcagaatggactccaagacgtaatttgtctatgacaagtgagaccagatattaatagtatagtaagcaactattgtatgaattagctattacattggctatagatgatttggagctagtagtgggctatactattaaacttgctcttatcagttaggccggcgactctcttccttctggtgccgaatgcccgaactcgccggagctccggcgatctcctggaacccaatcgatcggttagtttctatatgttctttgttgcaaaatagtttgattagtatgtataagatctactttgactgttgtttccaggctcttgaatcttgattgactaataagtgtcttgagaaaagttatcttttgactgtcgatgggtttcaattaagggcatgtatgatctcaaatgagggttaatttttgttggttttctcggtgcggcgtttcttttcctctggacgactcatccatgtcgtgtccatcaggaatcactgaatcaggataggttcagcattgaggcaatttgcgaagaggtgacagcactcgtctcaggacctgatcttcagtgcatcttgtctctcgatctctttctcttccttttcttttccttcttttctttgcactatacatcaaatcaaattgacaaccaaaatctccactacttcatttttaacgtgaatttataggtggtacttgaggctaagcctaggcaagagacgcagttgtgtacctccccatattatggcaaaaacagttttaacccgaaaaggctttcagcagttcatcgttttccttcttcttcttaggctctgggcacattgccaaacctacaccctgcccacccaacagccacggaagaatggtgttcttgagttaacaaagtcaacaaaaagtggtggtctttatgacaggcttacttgtgagtcttttacccctatgccattaaaaaagttggaggttacgtgtgtgctacaaaaaaaattttgagtcacctgtatgacatgacacaaactttcgtttacctgtgcgccactttggatggaattagcactaacaaagactaacagaggtttgaaagatctattttgcccttctatttcatccacttttgcggcggcggtggtggcgctgcggcgtgccggcgaggcaaggcggcgacagcggcgtgccggcgacggcgacgaccggcggcggcggcggcggcgtgccagcgacggaaaacgaggcgaggcagcagcgtgccggcgacagcgacaaacggcggcagcggcggctagggttcaaggcgcactggaggagaggagtagtggagatgaaaatgctttaggggcaatttagttattttcatacgtgggtcccacatgtcagagctcattctctaacagaaggtggatggaatggcacacaggtaaacgaaaatttgtgtcatggtatacatgtaactcaaaacttttttgtggcacacgcgtaacctccaactttcttaataatggcataaaggtaaaagactcattacttataccatgagtgtacatccaaattataaatttatacactaaaagtggtggtctttatgacaggcttacttgtacattagtgtacatccaaattataaatttatacactagaattagtcaaaatttgacatttcttttagctgaaaattaacaccgtaagattacattcattttagactgccattatttctgtgaccggagggaatacagtaaagttgtccttgcaactcagtggatataagtcatgactcgtattcttgccaccaagacttctaatgtatttaagatgtaaagctataagtcaatttggactttgtatagtaggattaatgatctggtggaacaatgggaaataccataatagtaatgtacagtgactacttatctttgagcaatacacagatatcatatcaccatgcaagttgattttaatcaattaaagttttcaggtagaaagtacaaattgaagtgaacactagatgcctaatgatatattaaccttacaaaagcttgtacatccattaccatagcccaagaaagaaactcatctggaaagctgaaacaagctagacaaatagttgcaatttgataagtacatggttcttgccccttgccgtatcaacttctcttctctccattagcacatttccagcatattccccatgtataactgcgtagacacaagaattattatatcatataaaacgtactttcatttttcaactattttatctcgatcaataatgatatagcttcgtggctcagttcaataataataataataataataaatgcctgcaatcttcaccgatcgcaaaactgaacactgatttttttcaaaaagaacaaaactgatcactgtgaacgaacagaagcactagatgtaactgtatatattgacaatactgtcaacttgtactagttgccgtactaatccagctgcaaggctagcagaggcgcgtgatctcactccatttgtgcagttgatctgctttgttcagagtaaacaaatatcagatcagatatactactgccgtaaaaatcacccaaagtgcagttcagctcattcgatgcatgcatgagtggtctcaagtttaatcttttttaacttcaactatcatctcctacagaagtcagaaccaatcctcagctcgctcatttgttctttccacttccttttgcgctttaacctgagcttgtcttagcctttaattaaccaagagataatggcagcaactaatctggctgccactagattgttctgatccatgttccagataacgatattcacgaagaattgcagggcaaagtaatggacagagatgacaacataagcagcttgtttatttggatgtgctgcccaagtggagatcggaatttcagagctcgtgccagcgtaacgagttgccattggatggctcgtcttattctcgcaataaaagtgcttctgttagtactagttattagtgcaaagaacacttttccaaatgagattttcgcaaatattttagtaccattaacagaaaagaacagattggatcgctctgaagttttccctgcctgtcaatggaagtagtagtaaaagctagtttacaacggcgacgaaaaatgaccgtgaatgtgatcctctagtaactctgaagtttctgagatctgcgtcatgagcagtgtttcatatgatgcctagcatctctgaaaacaagtccacaaatcttctcgcggaatccttcagtttgagacaaatgtatagtatgctttgtcaattgatcagttgagcacgtaattgctacctctcgatcgctctctctttcaacgaaaagggagagcacgaattgctacttctgcagcaacaggccatcagctagacagatactcctcgtaaattgtccaagaggccagccaatcggcctcgacacgtctatctgcatttctgtcgcttcttcgtcgtgtcaaaccggctattgttcattggtttggaaattttggattagacgtcgccggcggccatggtacgtccgtacgtacgtgtttggaggtgatgtgtgcagttggtgaacacagattattctttgggattatctttgagagtttgaggcccgtggcagctcgcttcaggaccggtggccgtcttctagggcctgattacttgaacatcttcgtgtcggcttcgactctctggtccttctggtctcttagtagctgtgaaaggagcggaattttagggttttcaactcggtgctctcctcggtctccgtggttttcgagtccatcctctcagaggattgtctgtggtcttccactggcgttgctgcttttgtgttttttttagtgtagtgtggctccacctctaccctctcgctgattggagtagcttttatttttcgagaatgcgcaaaagagttgcgcatcttttgtattaagattggggagaaattgtgacagctttacagtgcaactgaaagagaaaccgaaaaagaaaggcaagaaaaggaggctaagctataatctcatgacatcaactttgcaaccacgacagccatgatctactcggggagtagacctgctagcctccatagggcggcctcctctgctgctgccctagcaacctcctctcacgctcactgcttctggttaaaaaccctattgttcctctctttccatatgaaccaagcggctaggaccacaactgtatcgaaaccacgacggagctgcttcgtcactcccttcctggctgccgaccaccaagagatggagttctgagaggcagggaagagatccggacgcccaatggcattcatcacaatccaccagaattgtgcggattccgggcagtggattgcgttgtgttacaattttttttttcctttcaatatattaacgtgcaattttttttgcgtgttcacgtgaaaaagagtttagctttgtgaacttcttttgaatctggcctgattggactggttgaaaaatactcgatccttcgtcggtagagaaaaccttagacaagactctgtgttatactatggtcctgtcagtaccattcatgtactggaaaaagaaactccgaagatctggagaaactcgaaaaaaaaactctgaagatcagacttttgtgtgtttatgaggtgtgtacagcggggttattgaattgctatggtaccaaagtgaaatgagtgaaatgaccggtgacttatatttggtagtatttgaatatgacgataagtacaatagctgaaatagagagatgctacggtagctaaatgaactgtgacacattaaagaaaatgttattttgtaaatatgaaattatgctgatctgaaaataaatggtaggacgatggaacttgcctgctctacgcttcatctaagttaccaggcacaatttatgcatgtttgtggtgttattgatcaatttttgtgctgtaaatcacatgatcaacataaaaaaaaacagctattctcatgtgagataaatccaagtaactagtgaacaaaaactaatcctgaactccgtaccatcatagatttggttggttggtcaggaatctacaaaaggaaaatgtgaaaggcactgctctccttcttgattaaagaagataagctgctagtttgctacattaccgaaagtggataatcaccacgtgaggttggcatcttaagccgataaaagcacttgctaaagcgtgcgtatcactcttaacttgacagtatttacacggagcaaatggcgagagctaccagcttatagcatcagcaatagcagcagcagaactatattcttcagaaagcctggcgccgttggatattcctgcatttcttggatttttattccgatttgcagcgccaattgatccttccacgggccatgactcatggagctattcactgtcctttcggcacaggagcagacacttgttgcaacctgcagagatgcttctgaaaggcgaaatgttatctggagctgagcatctgaattcatttcagagagaagagcaatggcatttcacttctgcctgatacagtggcatggtcctgctggtcctatgcgttggttggttgggatatgaggtgtgcatcgtgttagtggactggcttccctactttggtcagggaattcagcattggaaatgtgcagaactgcatatcaaacagtgtggtgcgttaggcaagaagctactcctacatgatgaaaatgagtttcaactgaaagactgaaagcgaaagtaccattgcgcggacggaaaggtaccaaagatgaggccaaagtccaaagagaattagaagaaaaggagagagcgtgaaagctaacttcacatggctcaaaactgctttgtagaccacagatcagcaacgagatctgattccaagcagttaaaaaaatttacccgtaacactctagcgagatctttttcgacgccggcagatgaggggtcgaagaaaaagagcttgtccgtggctccccagtaaagaaaagccaaccaatggtcatgtatgataacatggacagaattgacagtcgtcagagaagagagtacttgaaacctctcctttcatgcaagattgcaaagctatatagggtgtgtttagttcacgccaaaatttaaagtttgattgaaattggaacgatgtgacggaaaagttggaagtttgtgtgtgtaggaaagttttgatgtaatggaaaagttggaagtttgaagaaaaagtttggaactaaactcggccatattcagagatgcgaccgagtacgacgacagctggaagatgtcatgaaagaaagccacaattcatggcatgaattgatacccatagaaagaagctccaaaaacatcgccgatatgatactgtccacctccccttgcctaaatgaggcttcaagtttacaattactacagaattggtccttgactacacattgcaattcacatctgcgagtagagaagtagtagacacaagatgaaacttgacaggatctgatgcggcttgttcatccaaggagcctctgaaacgcttccggcagggccatttgcagtggatactttgggcagtgtgaaagaccctccttgcactgatggtgagcctgagttcggagggggaatggcgccgccggcttctgcaggtccaggtgccgataatggcgggagaaacgttgaatcatggttcaccgtggtagggggttcagtgagttcagggaactgatgtggtcctgcgtgcagaagaagaataaaaaacagtggacatgtatcaaagtaaaagtggcaatgctgactaaaagagccgagttaaagaacttgtaatcatagaacgaacaattgctgctcagccaaagcgaaggtatgaatgtattcattcgcaaagtatgatgcaggttgctctggaattcaaagtgacaaagtgcaatttttgcaactattcaggtgggatgttaattctgttgatgcaacttactactgttttttttaataaaaaaggatgcatgcttttccagttcaaaaacctgaaaaatactaacatctgaggcagattgaaattcaaatgcacgatattgctgcattgtaagccagttgcaggccacaagctcacagcaacagtaattacctggacatctggattgaagacctgtgctcagcctgcaaaggaaggtagaatgtaacaacttgatagtagaagtagaaaaaacagagactctgagcaacatgttacttacaatgtggtaatggttccattaacaaaacctccgtagctacaagaagaaacattgcagcctgcactggtggaacgagcgcttacattacctagcagaacattgctgttactgcactgcatgcttggacatgaccctgtcaatgaagctggtgtgcaatataaactgagacagaagagaagacagacattacgacccaaataatggttccatataatatcgtgttaaacagaaaaggtacaatctgaaaattacttgagattccctggcccgcaactacactgcacacagtttccagcagtaagtgcataagtcccatttgccacaattagtccatggtctgaagcagatttgggaaatgcagatgtacatgctaagatacagaaacaagcaacaattgtcactggaagaactagggagaaaatgctgatatttagaaaagataaatgatgcagcccaactgttgtcacagaaggcagaacagaagaattagcaatcaacaaaagatagagtccataaacgcagaggctcatcataatatgatgcttatgttttcttacaggatacacaatctgaaactcactgaatgaatagaaaggaaaactgaacagttcgtgcataactctccaatagtatcttcctaattcctattgaagagtaatcgattgcctaaacaaagttctatttatctgactccgatgttagcgaattgaaacatcgcatatactccttccgtttcataatataagactttctagcattggccacattcatatagatgttaatgaatctagacacacatatatgtttaaattgataaacatctatatgaatgtgtgtaatgctaaaaagacttatattatgaaacggaggaagtaccaaacatcaaactgcagctagtaattgggctactgtaatgacgacagattcataatttcaaatgttcagttcggaccaacatgaggaagactaaaatcgagcaagatggtgaagcccgacattaaactgatgtgattttctttactgtactaatcaattaaaccctagaatataagcagcctatgaagcaatcaaatattaaagctaaggcaccaatgcaatgtccactagcatgcatactgtttatatccccaatgatgcattgtctgattattatttattcagaacaaaaacatactgacgaaccaatttgcctgcagaaaatatgctcgtttgcaaagttttagctcaaaacagttagctcaatgcaataaaccatacggctcatctgcgatatcgtttgcaaagtttgagatgaacatgtacctggcaatgggatggcgagaatgtcgcccggcgcggcgatcgggcttcccatggcgttcacattcatgacatccgtgacggtggtctcgtagctggcggcgatggcgggcacggtgtccccgacctgcacgacgtaggagaggtacacggcgggcaggttgttgtcggaggagttgaagcagacgcagggcagcgggacgacgagcttctggccggggtcaagcggcgcgtcggggtccgcggatgcgacggcgttggcgttgcggatctggtcggcgaaggcgagccccgcgaagacgccgtcggcgacggtggcgagcgtgtcggcggggcgcgcggcgtagcgcacggagaccgacttgcggacgccgtcggtgcaggagcagcgggtggggacgcggacgaagaggcccatcgggaggatgcggtgcgccgcccccggcgccccaaagtccagcgcgttggcggccagcagcgccgccgggtccgtgccgaacagcgcggccacctccgacaccttcatgtcggcgtagagcgtgtagcccagcagcgccgagcacgagtccgaccccgtgcacggctcgatcgtcgtcttcgcctccacgccgcccggcaacgacgacaccatcacaaccacgaccatcgccgccgccgccgcgacggagccacacacccccgccattccactccactccactccacactccaccaacttcaactgtgcagtgcgtgactctgcggaagcgctggtatacaagctgagaggaggagggtgggggggatggcccaccggtcagcggcggaaagggaggagcgagtcggttgctgggtgagtaatggcgggaggacgctggaggcgtccgcttttggcagcgatgggggaatctgtgccaagcgaggggaggagggaaaggtatcatcagagcaggtacaatagcataatataagtcagctgcaaatatattttaaaaagataaataaggagagaaaagagcagcggtctacagatttatagctagctgtagcacggactccaagacgcagtatgtgtatgacaggtgggaccatatattaatagtgtagtatataactattgtatggatgagttattagattggctatagatgaattggagctagtagtgagttaaactattaaacttgctctcagagacaccatatctttgcctctgccacgcgttggtttcgaggctgagtcactgcctggtgggtccgaggataccatggagcccacatgtcatggagtggttttggttaaccgcgaggttgacggggtgcggtgcgtctttgcctttcgaaaagagggcgaaccggcgcaacggtcgacgtgagctgaactgggccgcgtggcagagaacggacgggacggcctcgcctgccgtgcgggctgtgacccggtcacgatctcttggcgcttgcggccttgcgggctgtcgctgacttggtggcagagtcgcgaactgtgtttcggattgggctgcaatgagtcaggcagcggtgtggcccaagggacggtgtggcatagcccatgaacagacgacctcacaagttgggccaggtagaactctccaccggcctgttacgtgtgcggcagcgaagtaggatggcccttttatatgttgagggacaggaaaaagtacaaccgaaggtccgtcaacttgtcatcgaattacaaaattgtcattcaaccataaaatatataacatctctcaatttaaaaaaccgttcactttagatccttcggtagttttgacatcaattttatctgacatggctactaagtcaatatctttcccctcttctacactgtgaaactgtgtaatattggttgctaaagagagaagaagaagaagaagcagacatgcagaattctactagtaccattgaaaaatgtacgtacgtcgacgtcgtcgctgtactgaccgatctacgagtacgagcagctagcagagggtgtttgactcgtagcctttccggcagtgcatgcatgttaccggccgggggcaggcgtggctctggtgcatggatgggagcacgaaccatatgatactcgtagctagtactcctccgatccaagttccggcgcctgtggcgcgcgacaagaccagacgaaggcaggagggatgcgatgatcgacgcgaccacatattataacgttctctccgtattcgcaaacagttgaccggtgttataatattccacgggaggattcatacgtttgccgtttgcgtaaactcaagagatgccagattgcctgtccacgatattggattggatgtttctcagtactgcactctgcctctctctctctctctctggcttccatctcgacgaataacttaaagatatcaatagtactccagtactatctttgattattaccgtcgatgtaaaattagtccgggtcagatagctgcagcatgcatgcatgtaatggccggccaattagcacactgttactccggcctgaaagagggttcagagacagtttgggtggacaaacgagtaaggctgtgtttagttcaacgcaaagtttagattttggttgaaattagagatgatgtgactgaaaagttgtatgtgtatatatgacatgttaatgtgatggaaaaggaatgaagtttggactttggatctaaacacagcctaagctggctagcaagcatgtatgcatgggatggggcacacatgggtgcgaggcgagcgtcccatcggagaggcagcatcctgatcaaatcacgccgactggtctgcgtgccttacgggacgggccactgtgcctgatgctacgttgtttttggatcgcctgctcgtgaatactcctttcttaagcagtagtccacttttctcgtcaatggctgtgtttagttccttctaaaattaaaagtttgggttgaaattggtacgatgtgactgaaaagttgtatgtgtatgacaggttgatgtgatggaaaaattaaagttggaagtttggattgaaagtttggatctaaacacagccaatatattgtttgtgatagtgtgatccccactgcttaattccaagtcattccttatttgctggttgatgatggtgaaccatatatatgcatgcatcgagaaatatattcacctttcaagggccatgtacatgcttggatgttgattcgatggcttaaattaaattcatcagattaatttgaattgtaaaatttgtcaaagcagctattttgtggttcaccggatgtggttcaattggattttgcgctagctattaaattgcagaccccagttgggagcactacaagtaatcaaacctacgtatacaaagtggtcaacctcaaaatggcagtcatatatagtactagcctactaggcctgagtatattgcagaatactcgagaaatattgcaactacaattagtcaaatactagcagtatactcatagctgcatagctgctttgagggggtgtttgggaga

SEQ ID NO: 56748 - DNA, 10278 bp, Oryza sativa
ttttatattataaatagtttgatttttttttcttagtcaaagtgctttaggtttgaccaagtttataggaaaaaaaagtagtaacatttacaatactaaattggtgccaaatctgtagttttgcaacattgtgttttgattctgaagtatataggccgagtttagttccaaactttttcttcaaacttccaactttttcatcacatcaaaactttactacacatacaaacttccaacttttccgttacatcattccaatttcaaccaaactttcaattttggcgtgaactaaacacacccataattttgtgatactctattttagatattaactggcgagagtttggttaaagtatttatactcatgtggaatttactatattcacaatgactacaactacacacactggtatatctctttctattcaccatgacacccatgagctagctagctactctgaggggttgtttagatggggctaaaactttttaatcattttcacatcggatgtttggacgctaatttggagtattaaacatagactaataaaaaactaatttcataaatgagagttaatccgcgagacgaattttttaagcctaaataatccataattattaaaagtttactgtagcatcacattgtcaaatcatggcgtaattaggctcaaaagattcatctcgcgaattagtctaaggttatgaaatgtgtgtaattagtctagtaataagtcccagttgagctctatggctggttagcgtatttaaggagggcagaggtgccatgtcgtcagggctactccctcttttctctcctgtcacactcaagaagacttgtacgtcctggattatcagtggcctactgttgttggaaaagacatggggaaagaaatttgtcaccgcatgcagctgtgtgcgcttggatgcttgcatatgccacttgcccacaattatgcgcgcatcattccgcctagaagctcgaatgattgcatgataatgcgtattgtagaaaaacacttctcctctagctaggtactccttcccctcatatctagtaatctctcttcgttgccgatcaagaaaccatgcagggagatcaaagaatgacgaaacatacatttttgcaggtaagtagtaaaacccttactagttagttaacgctgcaagaacaaatgtatgcgtaattaatggatcagtagtgttagcatgttgatcaatcatcttcagactcccaagcaagttcgtgctgaattactacctgctgtctgaaactacgtactagctagctgacttgcaatctagacgaagacagatcgaagagctaactgcagagcaattgggcgtcgatctaaaactacctaataacctagcatgcggtagatcaattgtcaaacagtcaaagggatgaagccaagagaggcagagagcatatgttaagcttaccgtctgtcggcagtggattgttgacagtgtgaggtcgacgacgacgcgcggtgatcgatcgcaaagaagactagatcatcgaattgacaggacaatatgccgcatggttaaagggattgaagcctggtccgaggctccgagctcgccggaaattaggcgcctccagtaggaaaggagaaaccggagtcccggatgcctcgagccagacaacaaaccccttaacctaatccaagcaaatacacacacactacagatcgagacgccatggatgcatcggcttgcgaggaatgaagcctggtccgacgcttccacacgcccgagccggctcgatcgccggagaggaattaagatgtggatacctcgagccagccaacattccccacaagccaccatggccaatgaatttaatgaagaagagcacggacatggcgagccatgaaagagcagcagctagcagtgataccacatgctagcagcgcgttgcaatggatggatcgttgggcaagaaaggagaaggatgcgagggttttgaagaggagagggatcgatggggcagggaagcgaggacaggggcagtaatggcaatttatggtgacatgccccatttggcacagcgggtgccctaatgcccaataactgcgctactctacgtccagcccccggcctgtctttacgttgctcgagccagtgaagggctttgcagttctgctgctgcttgctagctgcgcgcatctctcactttcctcgctcagagagaggccacagctgactcactccactgctttgaattcccacaaaatgcctcgtgaagtgcaccccttctctccctagctctctctcgtctcttcagggcctggaatgtcttggacaagcttgtggtgaaaatttacttttcatctgaaattcagaattgaggaagtactcttctaaaaaaagttcagaagagatgaacggcaaaattcatattttcagaactgaggaaaagactactcttctaacaatgggctcacacgagatgaatgtcaaaattcggaaatgaaaagaaaaaaatggtatacttatatgcagtgatcaatacactttcaggacatgatcggtcggtgcttttaattctgatccgacctgagcatattcattctctttaagacagcattgaagtgcccttatatatatcaagagatgaggtatagctttacgatcttgtgtgtaatactacatatacagtactcctactgttcactgtttgtaagacagcattgaagtgcgatagcttaaaaaaagtgcattcatttacatttttttccccttaagacaagcagtgtatggagtccattttgcctcgtgaaatgaaccaatttagtgtaaattaaagtcagtggaatgtctgtgaaaggcttgtaggaagaaagccttcattaaaaccacaccaaatataacctcatctagtcacctgcgatctactagcccctcttccatgttttactgttctgcagttacctgccccaaaactaaaggtcttctacacacatacctctactagcagtagatagtagctcaaacttctaaacgttttccatcttggaaaggatggagaataggaatgagacttggatgacttgacgcaagcaagtgctacaagaatcaaaatgtcctttatgacaagctagctagctcgccagccaaaaagggcttgtaattgcatcaccgaaatgtcaacaccactccccgaaagagtattcaaaggctttctagctctgggttcttgggttcttcctgttcttgggttcttcctgtatatacacatgtatatgtctcagcttattcaaaaacatgtccatcaacacacggatacacagtgcacgcacgcatgcagtccacgcattttggaaaattcaaatttcaaaaatgaatgtgtactatatacatatacacataaactaatttgccaaatggtctgaagatcgacctggcctacattgtatattttgtatatacgtctagggctgtcaaaaaagtttgagactcacgagttgctcaagttctattcatcttaggctcgattcaagctcggctcgagctccagtcgagccgatcccaagcctctcttcaagctcacgagctttatcgagacgagctcaatcttccaacgagcatagcaatatattatttttattgtttatttaataaattatgtatcaaatatactatttgtaagtatcctataaaatgaagtattttgtattggcatcatatgtttattttattcattttctcttttattaatgtgatgaactaaaaataattaattttttaaacagattattcttgaaatatacatagttctacttacaaaccgaactcgatagtcaagctcgccccaagcctatctaaaagctggaaggtttcgtaggctcggctcgagcttaagcataggcaagcgagctcggcgccacgcctcggctcgttgacagccaatacacctaatactagcttgaaactgatcaagatgcctgtgtatatgaatgcatgtgcagttttgtaccacagtagcagttactctcagtcaaccttgcagtgttgaccaatgaccaccagcctattacacacaagtacacagtgcctttggcctcccacgtagcccgacagagcttgtgatgatcaccatcattacctgttgatttgctcagctcccactccctggcacgtgcctcgtgcgagagagccacagctacagctagggcctccacggcctgcagctagctagctagccactggctcgagcattctctgctttcctttaatatgagtgagaaacacgcgtgaatgacgctccggccccgtgccatcagcagtactcgcgcgctagcttgagactatatgcatgctacatgcaatgcttgcacgcttccgatctgcctaccttttgatctttttttgttctgaacgcttgcacatggtcaaagtgtacatgtacgctcagctggtacgacgtagctcccctattgatatcgttgctcatcacaagcaatgaaccaatcgtggctctccatgtatgtaaaaaaaaacaacgagaaaaaaacactatggcatttggcaggtgaacacgcgcgaggacaggcagagttacgttgcagatgcagacatatggaccggtgcggcggtgcgtcgttgccggctggtacgtacgtttgccttgcccgcgggaatgggcaaccgggcgcagcgcagcgctgcctccgcggattcgcaggggcgcgcggttccgtggcgcgcgcgcgcgcgtccgcgtccgcgtccgggaacgcgagagtgtgcctgcctcgcctgcgcggcgcgcggcgacacagcgggcagcgactggcattgtcggcgtggccggaggggtcggggcgcgcgcgcgcagcagcagcagcagcagcgccggggtgggccgggtcccgaggcacggcaccggccggacacgcccgttcggccgtggcatcacgcgttgcaggggcggtccagtggagagcagcagataccgtactgtgcgagataatagctgtatgtaaggtatgcctgcctgactgactgactgccttcaatccttgtaggtggtgtgacattatgtaatggactattccatttcttctcctggctagctagcttctcctcaaggaagaaaacatgcgtatgtccatcagtccatatgtctacacatgccatggaaccaacgctttctgatattagttgattagtattacaaaaacaatatccatttgaatatgttgttttcagaatttaccggtgttctttcctgcatgatgagcgcctcaaaatgtacgtagtgtagtaatattccccgtatttcgtggccaaaaagagagtgaacaaaaaatctggtgaatctggtgtgtttagttcgtgggtgtcacatcggatgtttgactgatgatggaaggggttttcgaacacaaataaaaaataactcgcctggaaactgcgagatgaatttattaagcctaattaatctatcattagtacatatgagttactgtaacactttatggctaatcatagactaattaagctccaaagatttgtctcgtgatttccatgcaaactgtgcaattagttctttttatctatatttaatgctccatgcaagtgtccaaaaatttgatgtgatgtttttggaagagattagctatataactgtcgataactttttagatgaaaaactttcaaatgtaactccactataattacaacgtagttacattgtaactagactatagttacaatgtaactggcacaaaaacgctcagaatcacgttgttgcttagttggttaacatatgcaccgtgagatcgtgggttcgatccatgccccaagtgtggatgtgatttttttaatctgcttgtgcgcatcttgatgtcgaataaggcctaactcgcaaaagaagtggacatcaatatgttagagaaaaaaaatgatgaatcaccgtccttggacggaaaatttagtccgttggacttggaggcgtccctcgcttacggagtcaacaaaaagttgatctcgagatccgcgtgcaacgtcgggtttgaacggccacgattaagtgacgatcacacgcgaccgaccggccctggcccacgcccacgcccacgcatggcgaattggcgatgcttgatgcttgcaagttggtgaaggattctcccggtcgtacgggctcttttcgcggtgaacgcgcgcgagaaaaagaaaagcaacggtttaactcttgtgcatggcttgtggaccatagaccacagtacacgtggccaacggctgttctactgctccagcatgtactagtgggtactactcctgccagtttcacatgcatgtgagcccctggtttcacccagaattttatcgagcagacggtgcacacttgttgggtgaactgatgatgaccagttgagtgtccattgtccatcaacttggacataaacatacacatgctgcataagagacaaaaaaaaggtgatcagtaaccagcttaccgagaagcgagtggttgcagcttgcaggttctgactctatcaacttgctaaaatgggggatcgattgaacgattccccttgtcatttcctgttccacgcacgcgcgcgctcgatcgttcgggccagctgctgcttgtatggttcaagccacatagccatgcaaagccaaagcaaacctctctgaactctgggtagatgtctccattatttttgctagctaggttaacagtggcgcataatgcagcaacgggacaaggaggtagccggaggagcccaagagagagacagagagggagagagttgagacagggtcatgtgcggcggtcagaagagccttggccgccgggtagactggcgctgtggcagcagcagcagctgcgcggcgcggccggtcaattatggacaaatgatggcgccggtgattaggtgaggggacgacgcgggccacaacgccagtacgtacgtcttcggcttcgatcagtcgcttcccgccgcgcgacgacgccacacggcgccagttaccagttggccgtttgggctttaggaaattaataattttatgattaagtttatttcgggcggtgtactgcttcctcttctcgcggccatcggctgctgaagtgctgatcatgtataagccccggcccgttgagaagttatgatgtacattgaatattctgggacggaaggaaaccgtggtactaaactcctcatcagtgacggaaattaaaccagcactactaaactttcggcactaccatccttaagcgtgtatataggaagacgcaaaacccctacttacttttcttcaagtccaatatacacattttgaaataattgatagaagttatcacggagcgaagatatgatatgaactcatggcgagtttacacggtgagtgcgcaaacttgtgacatgttcgcaatgttagcgcggagagaagtgaactatcgaagttagtggctcgtatatacgagaacttgaaattatcataaattttgacaatttgatcttttccgaaaactaattttacaaatgaaccgcggccaaaacttattttagaaataatcttttttatcagcaccaaatcgtatggcgctgaacgttattttttaaataagttttggccgcgatttatttataaaattagtttttggaaagggtcaaattgtcaaaatttgtgtgaaattatccgaatcgaagttaacagcggttagtcacctacatcgatctagatagtcggtgttgatctacatgtgcatactgactacaactttgtctcgttggttaattagctatccatccgcaatggataagcaaaagagtacgcaaggaggaaagaagtgagaggggttattaatttcgtctgcatccggtccagctagggcaatctaagcatggagatcggccaggtgaaacaagcagccggagtacagcccgtccaccgctgctcaccggtgcccaaagggagacgggcgtttgcgatgaagcggcacatgtacgcaggattggggacccacgcccacgcttgcgacatcgtcgtgcgcaaccggttcggcgtgtggtcacggcgaaaccaaaagtacatcaggaagacgcggtatttcaagttcgtcgcgctcggttcggcgatgtccaaggtgagacggaagctccaggagtggatcaagcagcacggcttgttaacgtgggctcagtactcggcgcggcgggaggagttggaggccgctgaggcaggtctgcagaagcttttccaccgtcgcatgcccgctcggtttaggaagctgaagcggcgagtcgtgaaagagcgcgagtgggagcggcgtctcttgttgaagaagcaggcccacgcggcgcagggtgcacccataacacgcgccctattcgtgtatatgtcttcatgtctagttcaactgttttactatctgagaagacttatgcttggtagtgtcacgcccagaaatttccgaatagaatttcaagtaaaatgtgcattaaaatccccgtccaggaccggccggggtacacaaacgacaaagttgacatacagatccatgtcttacaaacattataaaagtcttacataaatgcagcggaaaataaaaagataactggagctaagccttgacttgcaccgcagcgggaacaccactccacaggcatcctcgacggcacggacgaagcctactcggagaagccaccatctgacgcatacttaaactttggggttttggggaaaatagagcaagattgagtactacccactgtactcagcaagtcataccggaataggggtatgatgcagggaattatcaagggatagctataatggttcatttgcataaagcggtcatttataaccagaagttgaaagtagtaaacagttgtaataattaatcaatattaatcatccactgtccaacgctataccacgttgcaacaggcccaaccatccacctatactattcaattccaaaagactagtctagggtgagtctaatcacggtgaatctggttgaccgcccataaccgcgggcacggctattcgaatagttttactccgatcagaggtgtacaactgtaccaacaagacacagccccacgacatgtttccatgcgccgacatgccaccacgacataccggaaagaggccgtgacaggacccttcgcataaccccctctaaccaagcacaccacacttcaggtttcacccccactcctcgcaaggcagcgggcagtcccctctcgtgcctaggcgaatccggaagccgcataggccgtcgcagggcccatccaaactccatcacgcccacccttgcctggatgcgtcggctagaggaaagctacactacaagcccagccgttgcccacgctggcttgtggtaagtacgaggaattcttccagggtttcccgcgaaccggtccttaattgccatgggcgcgaccatcaaaatcatgcacccacagcccaccatttaatatattttaattaagcaacaccagaacggtggcactaatccaatcattaacataaggacctacagtctatacattaatatgatttcccccattgtgtgctagttgaactaatcatggctaagcactccctagtccaatctctagtcatgttatatcccaagctaacaaaggaacatggtacaaaatagcatggctatgacagtaggtaaacattccacagtaatattataaaacaatgcagtatttgaagaaaaacaatagagcatttgcaatataggatcaacatgttcaagtgacaagcatgacttgccttgctctgctgctggaggaatctcgacgactatctcaaagtacaccggagcgtcgggagagccggaatctaagcgacatacaaagcaaataatacaaacaggctataagactactgaaacagagaacaaaaccatttttaatggattctacacatttttcttgatttactgagacttgaatggacttaaacggagctcggatgaattagttatgatttttagaagattctctgtgtttttactagtaaagaaaagtccttaatgaattattgcgcaataaagcatcccagggctgacgtcataggggggcaggcggcgccgacatgcgggccccacgggtcagcggctcgagagagagagggaggggcgccggcacgtgggccctactggcagtggcacaaggcgggagggggtgcggctggcaggcgggccctaccggtcgcggctccaaaaaggggggggtggcgagacgccggccgggcccgacatcaagccggccggcctgccatggcaagggc

SEQ ID NO: 56749 - DNA, 8374 bp, Oryza sativa
cgaacccgacggcgccgacggcgtggtgcggcggcgaccctagcggcggctagaggcggctggagcaatgaaaaaaaggcggcggcgggtgggagcacggtgcgggagcgatggggagcttgggagaggccgacggaaaaaaggaaaatgaggaggaggatgtgggatgaattatataggggcggagaggtcgggaacggccgggagtggctcgatttcgccggagttagtgggggaagttggaggtggggagagagagagaggcgggattcgaatttgaatcccgaccatctcgtgacgtgggcgcgagcgggagtgagggcgtggacgcggggaaggcggggcgtgtgggggtggggcgcggggaaggcggagaaggtgggcggcgcgcgcgtggcgtggctgtcgccggctcggggaggcggccggaggttggggaagggactgacaggtgggccccacctgtcagcgcccgagggagatagggggaggcggcctggacttcgggaggagaaggggaagcggaccggcccgatatgggaaggggcgcgggaggaggaggaaatgggccgacagcccatttggggaaaagaaggggaaaaaaggaaaaaggaaaagaatttccagggattaaatattgcttgtgctcaattttaattggttaaaattatttctagagctctgaaaattccactaaaaatcttgttagcgtatttcgacatgtagaactcaagaaaaattccacatgccaaatccgattattatttgcattaattcattagggttttctcttgcttttacaccgatattttctctggtggattataaattcaatttaggcttgggaaagaacttcagggtgtgacaggtagcttgtgaagttgtatttggataaagtgaagacaattaatgtgtgtatttttctatttcttggtatctccaaaaaaaattatatatggaatagtactacatgtaaaatctcatttacaactagaattgttactataagagaaactcttctttaagagaagctaatgttttttttttttccataagggactttctagaagtacagtttgttaaatgtatacaactacaatggtcgacgttccagttcgcatgcacacccagcagcccagaatgaattgaacccgtggtcggcggcggcgcatcccgccggcaagccaaaggggaaagtttcaccggagcaaacgcaagaccgattcgtcacgggctcgcggctagggcatcctctagggttcatgataccatttcaagcatcctcatggcatggcgcggcgcatctaggtggccaacggcgaattagcggcggaaccaggtgaacacgagtgtggggaaatatggcgagcaacaagacacagcggtaagctagctagctagtagcctttggaaggtgtatgagctagggaaaaaggattgggagactaccgagacgaagggcgcgtagtgaagaaatgccagcagagcggaagtaatcttccgacctcggcgcgaaccaattaaggtcggggtaagggaagacgacctcgccccagtcgccaggaacgcaccggcacctcgggcgagccacgcggtggacgagagcggagtggtggaagcgatcggcgagctctagggatggtgaaggagtggaagctaggagggagaaagagagccctggggcggctttcatagttcatagagctatcggtctggaggagaccgagccagcggtgtgtgccgagcttgttgtaaaagttagtcgatatagtggaacgacgactaaccttcccgatcgtttcagtcgttgatcgcccaagacatgccagatgacgacacaggaacacacgatatttgttaacgaggttcagccgaagcctacatccccggggctctgattatggacgctcctccccaaccaacatagcacctagccgctacgagtccatggccacgccgccatcctctcactgcgtgtctacgctacattgtagtcgtcatggttacatcgtggtgcccccctctctatttaagatagttgccgggttacagagtccgactctaactccacccctaacacctattacaactccaagtccaactataaccaaataggactagtatattcgacacctattctaacagagctggcgtggtcaaggtggggcgagcgcgtcagagcggcgacgtcatcggcgtgcctgcctccgcgtctccccgagctagaggacaaggtagaggcaaggaggaaaaaggaaaagcgcgaggcgaaaaagcgaggcctccctctgcttgactgcttctggtggcgcgactggcaaggcggactgaccggcgtcgacgccttggacactagcggcggggccatggtgagacgccggctgtgacggtaaaggcaggcatggtagcttggcgcctggcggcgagcggaggcaaggcggcggccagagcggtgactcgcacgcgagggcgggaaacggcgaggttgcatggctggccgcgctggcgagcgagcgaggttgcctactctcctgcatgtgcgcggcagcacgtgatgagcagccgtggcgagtcgggctcgggcagaccggagcttcggcacgcgagcgtaagggagagggatctgctgggctgtcctgcttagataaagaagggagaaagcggcctgattggagaaataggcatgagagggatttatttggatgaagtttgagggtgatttgatttggatttgaaattggacgttacggagatttgattcaagtttgatatttgaatgtagggactactcaaggaagggaaacacggtgggactcaaatattttggagttgtaagattacttgaaacgaggattggatttgaatagttgaaaggatttactgatagacttaaggagggaggttcaaacaagcaaatttaaactccgagtctatttcgaaacggtaattttgaggagtcaattttggttttgaaggaaaggagataaatagagcactcagaatacgagattttcacggataggtatttcatcagttttgaacgccacgtaaaaaacggggcattacactagctataatctcaaaagaattgtaatttagtaacgtttggtttggctttaaatccactattcacaggatgagaatccagagctgaagctttgtcgtaaaggacagtaatcgtgccctctggtaggcagtgcacctatttgctcgaaaacttccgtaagtttttttttttccttcaaaactattagatttttaaccattggattacctcgagatttgcgcatgaaagaattttttttctagaaataattttttacacatatcacgcgtaagaacatgatgctaactaatcaaaccatacttgaatacaagttttatataagttactatatcgtagttaccatgtaattacagtacagttacaatgtaattgtgtctcaattatatactactattgttatatgtgaaagtttttcattaaaagaattgagacatttttttagatactcccgtaccaaagttactaccactatataaggaaacatgcaatttatcaaaattgtagtaaaaactttatattagactgaaatcgtcttatatccgtgtgcatgggccataactttactcagtttaaactagtttagcggccgtccatgaaatgggcctggatttagcctatataaaataggccgtacatgggccgataattggatctgaacgatactctgaatattaaattctcgcggagatgcgtcccgcccgcccgtgacgcgtacagccgtacacccattcctccacgctgtttgctccccgcgcgccacgaagtagagtactccatctcccaacgattaatgccaagtcaacaagcaacaattctttttgtcgaacaccagcaagcaacaaatcatccagtcagcccgaacacagataatgcagccgtcgcaacgatcccgccggccaccgaggttgagccgccgcaatgccatccggcagtcggcgtacgtggcccggccggcgtcacagctctcgccgccgtcggagtcggaccaacccgccttctggtattcgacggaggaatccgttctggaggaaagggttgtggaagatgaggtcggagatcatgcagaggcaggtggagccgaggcggccgcattggtggtggaggaggcgtcgacttcgagctcgtctgcggtctctgtccacgcggctatggtgatcaggaggagcatcttgaattggagtaagctggatcttatcggggccggatcgtccggcagggtgtacaaagcggtggctgagtaagtccgcttgcgatttaccgtttgccttgctcatgaactgttcgatgcaatgcttcattgtacttcgtgtctggttgtgtgttctattctttcagcagaccggcaatttcggatgagttatctctgtatttctcaatgcttcttcgtattattgccttgtcagggatgggtttgtatttgctgtcaaagaggcttcgttgattggtcccgaaagctatacgaagcaaaccgcatgtcagctaaagcaggtagttttatctcttatcaattaattaggtgaaaaattatcttgtaagtgtttaattaagcaaattgcaatttttgtcaggggtaaaatttcagagtattgatgttctccaattctaaatgattccaagtataagctaattcagtattagtaacaacatttcaggaaatcttgcttcttagtcggttggagcacaagaacatagtgcagtattttggtgccaaaatggtatgccagttctcatatgctagttgaacaagtgtcttcattatgttgctgatcgcctctgcaaactgttgcctcccaaacaccttcattttaggttatttttcttcggtttgagcttactatccctgtttggatttgcttgcagggagaaaccgtgctatgtattttccttgaatttgtgagtgaaggttctttggtatctgtatatgagaagcaacagctggaggaatcaactatatcatctttatacaagacagatcctcaatggattggcttatctgcatcatcataatgtaatgcataggtgataacacattatctccacaaaaaaattcttgctgctggcccggtcatttgaaaatgtacttgttatagtagtgatcaagttaagtacagatgtacaactctcgatcaaatgactaaatgagtgaagtacttctttgtcatattatggtaaatctgcactgtccttcccttttcaatgcagagatattaagtgtgcaaatattttggttgataaaaatggagcagtgaaggttggagattttggactggcaaaggaggttacttcatttttggtttcagtgtccttttttcccctggtttgactgacagattatgaaatgattttgtttgatattgacgatgtgaattctcaacccttttaattgatgtaatgccagataaaagtctggaagcagaaaagatcttgtaccggaagtgtatattggatggctccagaggtaattgtttgacttagtatttatacatagagttttgctcccatccagcaggtaccatcgggactgtccggtaccaaatctcagccatttaatcagcgaaatcggacggtggaaaataagtggtacctccaggtacaaatttgcccatgaggaggtgctaaaaaatttcgagtggtggaagggtaaatttgttttttcgcgtaggagtgtccagggaggcagtggcgagttgcttcgtgcttcgtcggcggcggcgagttgcttcgtcggtgacgacttgcttcgtgggaggaggcggcgtggcggcggctgatccgtttgaggctgcggcgtctgatccgtttgaggcggaggtggcggcgacggcggtggcggcaggtggttcgttgcggcgaggttgtgttgggcgcagtggtggcgggcgcggcagtggcctggtgctgctggtggcgggcgcggcggtggcctggtggtggccacggtcacgaggtagcggcggcggctggtgtgtgggcagccttggctgcgaggtggcgacgggcgcgatggtgccggccgtggtgatgaggtggtcgtcggagccggtgttgtggcggctgcagcgacgagatggtcatggagtcgtcttagcaggcgatgtggcagtgtatacatcgatttcttttcatccgatctaaatcattaggttcggttggttgcagcagtagatactttcattttctgggctgcatatactcttcttcttcattgcttataggatttgtattgtacgatttattggatgttttgatgagctcaaccattacttgttctttgtgaatgttcaaatggccaataccctcccatatcatttactgattactgcaattcgagtaagggcgtgaatgaagccgctggtgaaggagctcgctggttccgccgccgcggatggcagatgcggggcgagcaagcgagcgcacaggcgggggcatggatgcggggtgagcatgcgcgcggctcaggtgggcttcgcacgggtggggctgcgctcggagggaggaaaaaaaaggagattagatgagaaagcagcgccacacggagggaggaaacagagaaagagcgaaaaagagaaagcgagggtgcgactcctttctctgtttcccgatcgtacccttctaacatggacggatggatttatctctgtacctgccggtaccagtacctgccggtacaagttgctggatgggagcaaccctcttagacatattagtatgaagtatctagataaacgttactctgaagaatttattgcacttttactttacgatagtcgtccaactttccggaccagcagaatctatattggttatctgaatatctgatgatgatcaggttgttcgtggcaatccgtatgggtattctgctgatatttggagccttggatgcactgtcttggagatgcttacccaaagaattccttatcctgatgataactgggtcagtaaatcctacagtactcatttagacttcttacagtctcttcaaattcgatactgattcagttctatcaggtatcagtcttctaccaaattggccgtggtcaacttcctccagttccaggctccatatcaccggtgtcacgcgatttcatccacaaatgcttgcaggtgaatcctgatgatcggccttctgcagatgaactgctgaatcatcccttcgtggctgttccagaaccagactagtatgctgcatgtttgcttaacattgctaggcgaagaacattcagtagctccttgtttccttcctgtaagttcagggtcagaaagtcagaatgcttgtggttggaaattcatagtcctatggctaatttcacgagtacttgtttgtacgacatctgttccttataaaaatatcccactatccaactttgcgactttgaccattagttgggagagcaatcaaccaatcatgtattttatggttgagacttacgacgacttgctactccgcgtctgcatgtctgagtctgaagtctgaaccgacggcgctgacgttcccggtgacgaaaccaaacagccacacactctgaatcttacaagcaaagccaattccgcaattcccacgacttggtactcggagatagcggttggtcgtaacgggagcagttagccagttaccgatgacgtcgtctcgatcgacgctcgggtcgctctcggggtacggggagggtagtcggctccacgccgttataaaaggccctcatccgcaacgcgggtctctttccggcgtcgccttgtcactcgctcgccaccacccctcggcgccacggcgagcagcgcaccgggtccaggtcaaaagcgcacgcacccacatcgcacggccgcgtcgccgtcgtcgcgcgtgagccccccgtgcctagtcaaaccccaccacgagcagaatcccccaatcttctcgcgatccgctcgctctgctgctgcgccgcgggagcgcgggggaggaggaggaggaagagggaggggcactggccatggcggcgcgccagcggccgcaggcgcagctcgcgcggatcaacgccatgaggcactcctacaccgccgcgggggacgatggctccggggacgacgtgtgtggggagctcgacgacggcgggggcgagtacgcgtcgcagaccagcttccgcatccgcggggggcgcggggccgcggaggtcaccgccatcttccgcaagctggggctctccgggcccgaggacttcaccatcccgcccgcggtctacgccgccgccatgtcccacctctccagctccgcccgccgccgcggtcgccgaggtggcttccccgccggagcttctagaagcttctccagcc

SEQ ID NO: 56750 - DNA, 21967 bp, Oryza sativa
  unsure (1)..(21967): unsure at all n locations
ttcaagcagaagctatagaagtttccacacgatcatatgcaaggcctgcagcgagcgtcagatcagtagcttctaaacgagctctgctgaagcaggatagtgcagacgaggacaaggagaaaggtaaattggtcagattggataaatcacgagaggaaattagaggagaggtggttgtggaggcgacaagggagaccaccggtgcctcggctctggtcgtggaggcgacaagggagtccacttcacgtgacatcgagcatttgatttcaccctctcctcacaggcggtttaggagaaccatcacgtcctggcttaagggagagcatctcgggagtggatcgttcgggtcagtgtatgaggctatcagtgagtaagtatcgatctgcctactctgtcttgacgattgcataattcgttttcattatgtttgttgttaatatgtttgcatttgctactgttttatgagaggaatacaacgaagaaagaatatcaatggttttggactatgcagagaaatcagaatatgtcatctgtctagttcacttaattgttggtatatcagaatgagtattagcttcatgtgtccaccgaactgagatttcacaaattggctgcatccatttcaacttgttgggctatttattttatgccgggttgaatgaaatacttgaacatactgatgcaacatattatctgaatcatgcggctagctaaatttcttactcagtgcttttacacttcatttggcaaatttaattatttaggtgaacccttgtgtagttcttttgtagcactgcgtggattccatctaaaccactcttggaaaatataacttctgtcaacagttactatatagccgtgcctcgttttgttaataaaaagcttcataatcgacttttaacatttattttacagtgatggttttttcttcgctgtcaaggaggtgtcattgattgatcaagggatcaatgcaaaacaacgcattgtccaacttgagcatgtgagttaccctgtttcaaacattatgtttgttattgaactatttaatatccaagcaacaattgttttgtttcaatccactgagaatactggtgaatcatttggttccaggagatctctctgttgagtcgtttggagcatgaaaacattgttcagtattttggaacagacaaggtaatcctcctttcttatagatgttaattccattaagattacagttgtgaatgtattcttttcgtttgattttaatattatgttgcttttactctgctagttatcttcatgtaaacaacagttgtctgacttgagttgctgatttcgacgtttacgtttactttgttggataaacattttacaggaagatggaaaactgtatattttccttgaactagtaactcaaggctctttggcagctctatatcaaaaataccgtttacaggactcacaagtctcagcgtacacaaggcagattttgataggtttgaactatctacaccagcggaacgtgttacacaggtgcattactataatgctctatcaatgtgatagtgtactctagcttagatgtttttattgtttaggatttgctcaactgtattcttgctggcctattgataccccgttctttcctatgttaccagagatattaaatgtgcaaatatcctagtggattcaaatggattagttaaactggcagattttgggcttgcaaaagaggtatttgctctatcaaatatctgatgtaatcaatttgtcactagactacatgttgccctcactctttctaatttggcatgtcccagatgtcaattttgagtcaggcaagatctagcaagggaactgtttactggatggcccctgaggttagtctcacagttatgctttggtcctttttgtacaacccatttaccttacgctcctattcagaagagtgtaggtgctttaccattttatgttttaagcatatttctatgcctgatctattatgttcatattgttcacctctttatacttgtaagatgttgcatggacacataattgtatctctgtggtcaaaaagtcacggtcttgcaagttcaagcaatattttgcataaagtggtatgtgtctccatattgtaccgagcgtgtaaattttctgatagcatgttctcattcaggttgctaaggctaagcctcatggacctccagcagatatatggagtcttggctgcacagttttagaaatgctgactggcaaagttccataccctgatatggaatgggtgagtatatctcttgtcttactttccagtaacagcatcccatttttaaataccaaatgcactgatatacgcgggctgcacgctatttaattaaaggagcaaaaacattgatgacaacttcttcatgttgatgacttgtttgcttacatcagtacgtatgaagtatatctttttgggaaaatcaaacattagtttcatcaggaaaatttgggtagtattggatttaaaaatgtcagtaggaaaattaaacatttctattcagaactgcaaacagcaaatccactgtatgttgctgtgttaattttcttattatccgggaatttgtattattactgtccgtgatgcagtcttttcttctgctatgtagacgcatgctttgcttaaaattggtagaggaataccaccagaaattccagctacactgtcagaagatgctcgtgatttcataattaagtgtgtaaaagtaaatccaaatgatcggccatctgctgctcagctgttggaccatccatttgtccagagatcactgcaacataaaggcgcctaatcactcttgtgttgctaacaaacttgcttgtacataagctggtcagtattccattctttctcatacaaaaatttcaagaaatagggcgctatgactatgatcctgtattgcaaacattaatggatttctctctgttgcatttcatagattttaattttacctgtggaaacaggaaagctgttgatgctgaggatgatcccaaatcccttgccatgatacagcggtagtttgtaggaagtcgagcttacagcatgtgcaagctatattcaactgaagatacctttcaggctgctggatcatgtgaacagaagataccttgtcaggtgtttactccgtgccttcacaaccatcagggtgaacagttggttgtccaaagtttttagtgctgattgtcagggattatgagttccagtgcgaaccatcgaactacgtttcatgacttggataaaaactgggaaaggttcaaaaggaggattagtggtatctcgcctagtggcctatggaagcagccaagcaggggacgtagaaagctcagtgctcacggcacagttaacttttctgaccgcgtttctgtacagcgtttttgtacctgtaaagtggcttccttgtgtatgtcattgactgttgacgagaaaatccaatttgttttatagccataccgtgaaattgtccagaaaaatcagtgtgttttgcgataattcaattcatgttggacttcactcctgtgactacacagatgagggggaatcatagtggcaggacagctaaatgtactgaactactgatatacaacagttctctaatctaacgtcggctatcttttgacttcagaatatcagtcttctgcattctccagtctccagggtctgaattcatcccccatccaagcaatcgattacatggtcataatcatgccctgccatctcatgcatgagcaacccaagcatctgagatatctcctccgcctgtggatgcgaccgatcgccggagacgaactcgtgcacgtcgccgtcgatctccacggcgctgtagcccggcctcttcctcagcccccgcgccttcatcaggctccggaccttcccggcgccgtcccacttgccgacggcggcgtagatgttcgacagcagcacgtagttggcgtcgccgccggggtccagctcgagcaggtgctgcatcagctgctcggccatgccgacgtccccgtgcatccggcagccggcgaggagggcgccgagcaccacctcgtttggccgcatcggcatggtggtcaccacccgcatcgcctcctcgagctgccccgaccggccgagcaggtcgaccacgcagccgtagtgctccatccgcgccgcgatgccgtactccgccctcatcaggtcgtagtatcttagcccctcgtcggtgaggccgccgtggctgcacgccgtgagcacgccggtgaacgtcacggcgtccggcttgaacccctccctccgcatcgcctcgaagtgctcgacggcgtccgcgcaccggccgttggcggcgaacccaacgatcatcgagttccaggagaccaccgtccgcttcctcattccgctgaacacctgccgcgcgagctccacctgcccgcaccgcgcgtacatgtcgatgagcgagttggctatcctgacgttgcgctccagcccctgccggaccacgagccggtgcacccacatcccgagccccagcgcgccgacctcggcgcacgcggagatgacggctatcagcgtgacgtagtccggctcgacaccgtccagaagcatggcgcggaagcagtcgatggcctcgtcgtggcgcccgttcttgacgcacccgtcgatgagagccgtccaggagaccttatccggcgccggcattccgtcgaacacctcgaacgcggcggcgacgaggccgttccgcatgaggccggagatcaccgtgttgtaggtgacggcggacctcacgggcatggcgtcgaacagctggagggcgaggtggggcaagcgggacgcgaagtagaagcgcacgaggcaggtggagaggaggaggtgggaggggaagagcttgagcacgcgggcgtggacggagagcgcgaggcggcgggcgagcggggaggacggggagtcggcgcaggcggagaggacggtgagaagggtgacgtcgttggggacgggcgccgcgggggaggagagcatggcggagagcgcagcggccgccgcggggaggtcgccctgcttcgccgggcgcgcgatggcggacgtccatgaggcgacgtctcgcggcggccggcggcgaggtttaggggttgggttctgaggaggttggggaagggcaagggaaggaggggctacgacggccatgaggtaaggtctatggctgagggctgaggcatttccccgcgggcacgttggcacggagcctttgctctcccctggtttcttcaggttttcttcagaattcatccccttttatcctggtttcattagcatcccaatgatatgttggcgatacaattcacaacatatatagatcctgttcatttctccaacaagagttggataaagataaagattttcatggcacggtttttaaactgataaacagtatgtgtcatgcgaaaactttctatatgaaagttgctctgaaatatcatattgatctatttttcaagtttgtaataattaaaacttaaccaatcatacgttagtatcacctcgttttacgtaaaaaaacttaaatcttcatctacacctttatcttctaactatgcctgaataaacacaacagtctggttttcagttgaagactataaggtacgacgtgcatatggagccacaaaatgaaaatatgcagaaaagagaaagcaacatactgccaatacgagggggcaagccatatgcatcaaaaccacaaaaggaggcaaatcaaagtctaaatgatatttttgaacttccttaacgaaaagaaattacatacagcacaagaagcatcttgcactagataattgcgcacagctgaacataattctgcagtccagttcttcagtaaatctagtgaaagtcagatacagaagaaagttgcttaagggaggtgtatggctggagggcagattcattggaccatcggatcagggttcccagctgcaagtatgtccagcaacgagttctggggctccagctcttcatgccacagttgtagtttgtctccagggtgaaatttcctcgaaacaccatctgcgtttatctgcaagattatcatatccataagttcaagaatcattggtctttcagaaaagtaatagcattttaagcaaagataacaagacatgcctcaacttaaaatttactttgccacatgctacacattttcagaaaaaggaagagctacaagaaaatgcaatcaaagcaaatagatgcccaacaaggacataagaaaatttgttactaatgcttccaatcatccaatgtcttgtctacaataccctaacacattttagtaaaagagtaaaacaggtctgaatgaagtataagggatatatcacactgaaatattatccatttttggcaagaaaaccagtccatggaagttaaaaaaggccaactttttcattttaagtttcatctgatactatattctatggccatcacagcaaacagcatgacaaatatagcatagaaatttacatgtttgtatgaagtcaactaaagcaatcagttccggtatctgatgtttcaaaatatctacaacaagggaacagacaatgacaataaggacgaaaaaagggagcacttacagtgacggtacgaacaacccctccactagcaccatcacgggctatagcaagggaaactaccttaaccacaaacttctgtaaagatgaagaggaaaattaagtaataagagatgtgatgcagccagcaatattatacagggaacactgaagtgatggaaaatgatctttgcactctatgaatctggacatataaataatttgtgatattttcattaaatcatggcaaaaatgctgacaaactatctcttattactcatggattacgactgtttgatatttagatgatgtacctcagcttcttcctgggacatgccctccttccattcgtggtcaagcaatccatagaggtaactagagcctgaacctgcaaaactcagaaatagcatctggtgtcaggcaaacagcaaacaggggcttgggaaaattttatagtcaatgattataacagggcagggttgcacaggacagtgttggtaaacaaaaaagaatgaggcaagctaattcaagacatcaacaaataaagaaagaaatgaatcttgctaactgcaaaagattgcttctgctttgcttgaaaaaattaaactgctcaggtaagtttgaaaaaaaatatctcataactaattggcttatactattgaactgacaaattattcttgtacgatatgtagatatgttatatatagacacaaatgttggtgggaaatatgtttcccattagattactctgagcccaatgaagagacatttgccataatatatatacctccgattgcaaatggttgcctcagaattgttccaccaagggggactgagaaaatttggcctccctcatatttatcccatccaccaacaatcatgccagcttgcaacatgttctgaaaaataaaaaaaatggtaaaaaaaaaaccattgcgacaataaaacaacaacttaaaatcgtgtatcagagaaaccattgcgacaataaaacaataacttaaaaaatcgtgtatcagagaaagaatttcatctcatgtagtcatggagttattggatcgcagaatgctatagaaaatataccttgttctgataagccaacaacctaattaagttggctgcaactttcacggtagctggctgcccaagctgaattctgaaaatggagggaaaatttagcatgaactgtcttgcacatcaaatgtttccagtaactagtagaacaatatatatgaagagttcattcaacttcttcctattcgcttcaaggggacaacttacgtgtgttggtggagaaaatagcgtacataatcggaaattacttgtgtatcagcagcctgtgagacagagagaaacaaatatttacatgtgaatactactggactcttggaaatgccttagctgataataattagaagccgactactaacaactacagaataaatgaatcaaagtaaaatattgacaatgagagtgtaacttatgagagggcaatgaatgactgggaaaaccgatcaagatgacatgacacagtataacaaaagaacatatataacttgatgaataggaagctcgtgatttcccaatatcttatggccacagtacaatgagacaacatgaaaaaggagtaaagtccctaatatagatacttacagatccagagcggcagatgtacacattgtcagttagctgagtaatcttgtccgacgcacggtttgccacatacattcctaagaattaataccagacaacaaagggtatattaaaggaaagtaacaaaaaccaacatagtacgtcaacataacatcgatttcagttggttcagaacatgcacatctaagataacaagtcagaacatcaaaatcatctaagaaagcttgttaatcatgtagacacgagacccaatgttctaaatttccaaaacagcaacatcacgctaaacaccaatcgtgtacacttttctgactcttcactcttcagggccaaacgagaactatatggacagaaaaatacaactggaacaattggtgttgtttctagtttcctctaatgctacagtcacgattttttcacatatctgccatacaagttttagcacgcattctactcgtcacatacagatttaagcaggataaattagtggtaagaagcaattttccatcaacactacattacgtgatccactgtggacgctatatatatattacaactaataatctcataagtcacaaacctaaaacagtaaaacttgaatcaggatcgcagaggctaacaatcactactcctattccccccatcccccgcgattttgcatcaaaattgggcccgcgacgccaccggctccacgttaaanccccaaccacatcnaatggaagagatctcccgcatcgggaggtgtcaggcataccggtgctggttctggaatcggcggcgaggacgacgccgccgtcgtagcagacgccgacgatggtggtccccatccggtgctccccggaggtgggattgtctcccgctgcggcggagggggcgcccatgagagaggcgtccatggctggccgggggcgggggcgagatcggcggtggcggaaaaccctagcttagnnntctgcagcgagatgcgagtcgaggcgctcctttcagtcgcgcgagcgagaagagaccagacggcgagagagctgtgtatgttacggttttgggctctggtctggcctcccccgcaagaaagaacacgaaacggagacgagacgaggacgtgactgggtcggagttgtcgcgtgctggtgcggttcgacccgatggcaccacgagccggtgcaaccacataccgacttcccgagcccgaccgaggtcgggtcggagatgacgtcagcttgacgtagtccgcatcgacgatatcccacagcataactcagattcaacactacttacttccaaaaaaaataatttacatagtatatgatgttnatatactacgaatcttaacaacttgtattccctccattctaaaatataagaacttatttgatatgtagggaaaaacaacaattttagaggattttaatcatataagaatatttcatatggatgcctttgaaataaaggattgaattcctatcattttaaaattcctatgaaatggacaatcctatatagattttgaaggaaacttgaaaagagctctaatctattgaagattttcccttgagcctatccctctcatctgactcatatgttttcatgcattttgcaatcctttattttgtagttgaattcatttttgttttttccatgcctgcgatccaaagagtccctaaaggattttgatcgaatgggacacatctaacactataaatttggttagaacatcctagttctactaattttgatagaacatcttagcactacgaaattggacaaagctattcataataatatgatgtgtcccatctaactaaaatcacttatattttgggatatagaaagtatattacatctcatattatgttaacttattttgggatgaagggagcagagaaaaaaaaagttgcaatgtactctacaaaaacagcattggaggaaactgcaagcactaaacagatatcacaaccaccttactgtaaacaactgaggaggaaagcaatacacagaaatcaaatgcattgattaaaatcgatatacatatttcaccggttgatccatacagcaaaactggaaaaaataactcttcaatttagtatttacaaaccaagactctgtacatcacctgctgaatgttttacagccatttacatgtacatacatcagacgacccatactgtacattggcaagaaaatacgaaattaataaatcgaacatgttggcattacaatttacaactttacatagaccgatcaactatgcctgaataagtacaccaatctggttgtcagttgaagtcttgaagccgcagagaaaactcaaatatgcagaaaagaataactaacatacccccaatatgaaggacaagccccatatgcatcagagccacaaaaaagaggcaattaaagtataaacgatattctttttgaacttccttgatgaaaagaaattacatatcggaaatgaagcatcttgcacttgataatggtgcgcaaatgaacacaaccaaaaacctgcttggctgcttcatctgacgtttcaacaatcaagttctgctcatgccaacaacctacaaagctgagcaacctaagaaaaacacagcccttcttacaacagtcaaatctgatccatatctgacaacaacgttggaagtgttattgtccaacctgaaaacatatcaaggcttttctgtcgtgctggtagacagatccaatctctcaaacctcagtattaattctaatgaatttggacttcatatattctaccacaagctcattccagtctgacagggaagcaaatggcagcaaaccagccaagcatgggagaataaccgacaggacagtataaaatgtgtatcggcaaacccgatatggtaaatcagacgccttcgttctgtcagtcactgaaataggaccataaagcatgcggtataaaagagatggcctgctgttcccaaataaatggatgaagcagagaatctcccagaaaaagagccagacatttccatccccgcctagtgtgtcaacgcagaaccttccgacagaaccacagagaactcccaataacataacattgaacgttattggcatgtttggtccagtcattgcagaacgctggaatatcaaccaagcaatcaagagaatcattaacatgccaaatgacatccttgttgctgctattaaatgacacctgaaaaacagcaaacccgaattgaaagctgatactgaatttggcatccaccaagatttaggttcctgccaaaaaaaaagtgggttaaagagattagttcatagcacaaatatttactagcagttagtagcgaaaaatgatgggacatacccttgaagccgctgcacaagctgcagtaacagcagttatccgcttgacgaataaatataggttccataaccaaaacagacagacatatataccactgcggtaaggagcaaatctataagcttcctgaggagttcagcatgtcttgtgtcctccatttgcgtcataaatttttcctctctgaaagaagctttctgaaatcccatagaaattttgatcttctctagcatgtgtgagtatgagctgagagctatctgagattgcttcaattgcaatttcctcatgtttagtcctatttcaagttccttgagctcatttgaacgagtctgctcattcagagatctctcaaatacattaagaatgtgcctatcaaattctggactagctttattatgaggtagtttaaccaactgctgatcggtgcccgcatgaagaatgatttgattatccattgaacttaacgatgtactctcctggatatcatgtaccggcctttttgaatcagcaccactcaatttgatttcagcagcagaagtaccatcttcgtgagaaaaccgagagttatcttgctcatagacaggtgtctcattaattaaatgaagtgtcctcaatgtacttccaaatgatttctcaaagtttttcgtgaagttgtcgaatctatcaccatatatctgcagaataacgtaagtcagatatgtaaaaaaacctgtctaagtgtaatcacagacaaggaaatgaaccattcatacatttgtcaaggactctttcactgctgacgtgcacatctgcatcaagattcagagttagcatacctgaagttctgttatagtccatggccatcatttgtagaaaggctaattacatgaactgtgtacctttgaaaggaaatcaggttgtaatcttccttcagagcaactgcttctattaaggacctgaaacaggataaggtcagttcttgttaattacgagtaagaaaaggttaaaccatacaagctgaatccatgcttcagaaccacagttctctactggagagcccaagaaattcatttgattcatttttgtaaataaacaacttcattttaatttggcttggatgtatttcatcatcctaatggcgagacgatcatccagagaacagaaggattacatatctgagcctacgcttcaaaacacacgcttctgttcattagtgccgtcccatgtaaatttgcttaattcaatttggttatataaacgactttagttgaatttagatgcaatgtgaaaagacgcccaaaatgagttccggagcaaaagaatatctctacttctccatcctaaattcataatccaatgaccgtcccagcaaggcaagaattgggtgaaccacatgaggagggtaaaaaccgaacctttccgccgcgactaaacaagaaaccagtcaagaatcgaagcgaacgcgcacctgggcaagaaccgccgcgaaggacatcccgagaggcagcgcgaggtcctgcgcgccgtcggcggcgcccctcccatcccctccagtcgcaagcagcggtctccggagcctctgccgccgccgccgcaggcgcacccccttctgcagccgggacgcggagccgtacgacgacgccgacgaggacgccccgccggactccggcgagccaccgccgtcgcagcaggccccgtccataataagggagcgtggcggcgaggcagaggcggtagggtttagttgccgcgccgcaatttcttcgcctcgaccggtgcgcgacccgctctccggtgggcttctcataacgggggagagagagagtctaggaaaggcaagtcaaaatgggaacgcgacgcggaacggcttcggggtcgcgtcgcgtcacggtgcggtttacgttagccgttaagcaaactcggaaattctgagcaaactttgtgccgttttgtgcgtgtatattaggcttttggcctggtttccattaaggaaaaatgttgtaaggaaggaaagcagtgttaaattattataggaatattatttaaactactggtgttgtagtatccacgaagtttaccgtgtcatttgaaatttctaagaaggtttcacaaactttttccgaaatatttgcccgtcaaaaaacatgcactgaaagatcaaaaaactttcttcaagttttcgagagaagttggtcagtagctttgggccctgcactgccactcggtctttgcaggccggtgcacatcaagattgggctggatactccgctatcaacgggttccgcacccacaaggcccgttacgctgctgattttgcttgcgcgcgaaccggattcgatggcacgaaatctcgttcaatcctcccttgattaacctgacgattaccttaacatatctgccacttatttataaccacctcatcccataatcccatcctcatccaagagaagatagatatccatcaatcaaataaccatggatgatgcggcgggtagaccaccgcgcccggcggcgaggtgcccacaggctggccggcggccgacctgccgccgatcaccaaccgcgacggcctcattgtatcccgatccagctgaagcggcggcggacgtggctgatgattgctcggtctcccgccgcacatcatggccgacgaggaggccatcgaggatgtcgatcatgaagacgttcgccgggctggtccgcatcatatcgaccggtggctcgacctgacggatgggaagacgacgcacgcggctcgtctgcgaggtggacgtacgtcgtcgccgaaccatgcgaggtgccgcgcgtcctcgcgctccacctcgtgcccaagtggctcgtcaccgtcgtgctgcggagacgcgacgacgacgcctccgatgacggctgtgacggcgagtcggctaaggccttgttcggcacgcatgtttccaatccaggccaggaattgatcaaggccaggtttcagtggatccgggtggattcactggaaccacctgtggattgaatccattccttttttcaatccacctcttcaaaaatctgtgttcggtttgacctggaatggaatgaagccattcaagctgccgtggattgtcgatcgatcagatccagtgattcagaactcaaaacattcagttaatgtcatcactcattagaattcagaatcatgcacatttctaatttctaacagtaatagtatattgcaggagttaattaaccaaaattcccaaatagaaagacagggaacaccctgaatagcatcaggacaattcttcaccatattcagttgctgtcatcattcatcagaattcagaacatcatgcatatttctatctagttaagcatgaacagtaatatatttcaggattaagcacattcttttcaggactatatcactaatcaatctggcttcgccttcctccggtccctctggtagcaatccatcggcatttgggaatatcaattgattatccgctgcagccatagcaaagaaatcttgcggttaagacttagacagtgtgatatagaagcagtacaactcttgcaagtaaaaacagagcaagtaaaaatacaatagagctgttgaacttcacacttattatccattttacaagtttgtttgcatgcattcaaacaaacttgggggatctgcatttgtgttatcatcataaaagggctatcctatgtggacacaacatttgatatcttcagattcgaaaaaaccaaacttgtcggcttatataataagtagatatgtgaagtctaatacaacataatatcaagtaaattcaaaagaaaatttggtaatgaacagagaatttccatttattcacatgtttgagttttttaattagcctaaactacccagagcttagaaagaaaatggtcctattccaggacttagatgtaattgaaaaatatgagcctatttgttgttgtcatttattacagactacataagaggcaatttagctgaaaaaaatgttaagatactgcactgtagttgccagaatgaggcagccaaaaaagaggcaacaaaatcatcttcctactgcagttcaatttatatttcagcatcgatgcgcaaagctttcttctccaaataaagcagaaaaatatgcttgttaatgatgtttgctgataacaggggctggtttgttaatggatcactagcaggattgcagtttccaccaccctcaacaatagttgtcagtaatgccaggccttcatgtctgttgaaaacgcctgaagcttcctgcaaattctggttatgaggtgcaaattgtcatgcatgatgatcctcagagaaagaggatggccccatcggaacaaggacaatctacaatgatatatgcagagaaagggagaagggaccaaagcatctgatggaaaatggctaagatttaatgaatcataaacagaaagatggaaatagaaaaggtttataattagcatagtagtttgttgaggcagccagtgctggctaaaattaagtatccaagctaaaaagcagctaatccatgaggacatgtggttatcaaaatctgaataatgaacagaaatgccatcaagaactgacaaaaactggttatcaaaggatcttttcttatgcaacactgaatttaataacaatcttgacttagcctggcttgggtgagtacaaaaacagagatggagcaccagtccagttacagtgacatgtttttttttcagcataatttcctggttcattcgagaagaagacaaactgaaagggaagctggttgacagatccatggctatgcaacacatcgatccttcagccaagatctagggcaagaaacagaaccaagaacctagggctcttccaccaagaatcccccgcaacactgcaagaaccttaaccacagaccaaatctccaagaacccatcacgattcccccatccccaccccctacgcggatcggaatccccaacaaacaccagcccttggaaagccctcatttgggcgaaagaagagcagcagcagcacaagaaccctagcaagcaaaaaccaaggaggcggcggtggcgtgctacagcggcaggggaggaggcggtggccaagaaccctagcaagcaacaaccctagcgccggggagagaaaggaacaaggaagacgacggtgatgcgttactggcgagaaggcggcggagagcgtggacgtcggatgggaagcgggtcgtcgtcgccgtcgcctctcgcgtcgccagccgcatgccgtcgcctcttcgcttctcctctcgcgtcgcctcgcgtccggattggaaccggagggtcagaggtggggaatggatccgggccaggaacagggggaggcaggccaaaccgggcccgtttccaatccgggccggccgaaacgaacgacgcttccgggccagaccagatttggaaacgggccgcttcgttccggccggaactgaggccgttccgggccgttcctggcgctgccgaacgaggcctaagatggagatgctgccgtggttggatcgtctggccgtccaatgcagccacgattttttttatggcggtgagaataaaaccatccgttgttcttggtgattatggaaattaaccggaacaggttctgataactctccgcgaggagagcgccgcggcgtcggtagcgggcggcacggcgagttcccgtggcgatcgacgaaatgggccggaacggtaatgcggcctacgtgcggaaatattggtcggaactggattcccacgtcgcgaatgttgggctgatatcgcgctatggacagaccacaaactaccagcccagtaacgacgatctgggcctgagccagattcccgtgaactgtgccgatatgttgggccggcctcagcaattgtgggctgaccaatttgtgggttccagctccacatgtcctggagctgaaccaaccaaacatttgtagctctagctaaaacaagagcggagctcgcgaagctcggtggagcatttttataaaatgaactagagaggcaaagttaggtttagactactcaacaattacactccagattcaactcctggatccattgtaactggcttttttttcaaaatcaaaaatcagaccaagcgaaaaattaagagacctaaagtgaacttattccacccagatggtgctctggaatgggataccgacgccgcgtcgccttcagttgtccacggtctagctattttttttttcaaaatcgaaaatcagaccaagcgaaaaattaagagacctaaagtgaacttattccacctagatggtggtctggaatgggataccgacgccgcgtcgccttcggttgtccacggtctagctactacaaaatcaaggccaaaatgcagtcttctgcttctttttttagaagggtattttttacccggcctctatatccaaccgaatatatgcatccattgaaatagggaatttagttctgcaaacaataaattcgctccatagaaaatttgaactcagaaccttggggtactactcaggtcactgtagccactaggctatatgcaatcttctgcttaattattattgtcaaaatcaagggtcattttccgcttagataatccgcacgacttcaatgttcgatcgtatcagcatggaatttgtttcaccattcaccaaatatgaaatcagccctaggcctatatatctagggcactattacttcactttatagagccttgatgcttgtcgcttcagccacagcggacagcgtccgtccgtgcgtgcgtgcgtgcacggtctccgtgacgccgaaacaactggccaacaacaacgatctgtgggtgcagtttactgtagtgccaaacttctctctcttcgtgtcctaggatttgtttggatgagcttaagttttgagaagttgtccttggtagttaacttatgagattcttgagaagctgaatttctcggtttctgacttttatttattttattttggaatctgaataaaaagctaaactatttataaaagttttaattcttggagctcgatcatacatcccctccgtcccaaaaaaaaactcaacctaatataatgaatatagacatactagattatgtcacatttcaatcctagattgttttttttcagatttattgtactagattatattagtattatattatagttctatgttaagtttctttggaatagagggagtatgtcacagctgtcacctatcccagagcccgaaatgtttgacatattccctcgtctggtgctttctggtaggctatcacatgatcatctctaccagtcagttcttgccgctcgacctgattggtcacctaagccattaggtccacgacgatctctcaccttgcacacgccatggctactgtggtaacagtgttataaatggagtgcacgcaataggtgaaactaccctatgggtagctgctgctagtagctttgagagcgtgcaacttgtcacgtccagctagagcgagtcactgactcgtgggcccggacaccgtgcgtttattagatggcgaattgtttaattagaggctaatttggcctcgacctgggacggggttgataggctaaacaagggtcaaaccgacccctatcccgactcgtacttggcccaaattaaacctgtgtgcatcgatcggaccgagccggtttaccccagcacgaatcgtgatgtatcgctgatcacttggtgactcggaaaccgagagccctaggtagctactaatccatttgcacaaatttaaatactacctccgtctcaaaataagtgcagccatggatatccgtgcccaacgtttgaccgtccgtcttatttgaaaaatttgcgaaaaatttaaaaaaatttagtcacacataaagtagtatttatgttttatcatctaatagcaataaaaatactaataataaaaaaatttcaaataaaacgaacattcaacctcaaacgttaaacgtgaatagtacaaaactgcacttgggacggggggtataacgtaccgaattgaacccgatccaaatctgcactcaaacccatggcataactaaccacaacgtcgtcataaatggatcacaagggagcaaaaaccacttgtgaataaatttttactaatcccagaaaggtaaactctaatgatctgcaacatggccaatcagatcgtttcaaatatcatggccaatcaggggccgtacacgttcatgcgaaggatcgatgcagcttgcagagtagctagcagtagaacttctggtagatttgcacgtgattggtcgttccgatccattttgctttgggctacgacgactatgagcagagttcaagttgaaccttgttttgtttacatgcaacggttgccgtgctaattaagcagtttattaccaagggagttagttactactggtcttgtactattggagtacaatattttgttgaaggcatgtgggaagagaattaattttattcgggaagtgaatattaaactcttaagaacatatcctcatgttgtctatataccatctaaatatttatgaaaaaaattaaaaagataaattaatatgtgatatattactccgtaaatatacaagctataattcaactctcacaagttacaacaaaaataactaatcaaactaatgtatattcacaattaaatttgtattttttaacttataaaagttgaatctatcattgcacatgtttgtggagtaatctatcacatattaatccatcttattgatcttctaaaaatatttcataactatttaaatgaaattctaacaacgagatgacgtccctcgagatagtttagaattatcttttatctattcgcgatcgaactcactgataatagggagcaaattctcttacgtgtaagatcgaatcacaagaactaagccaaccagagggggggtgaatggttgatataccccaaaacccaaacttttagcgcaaataaaagttaccctcaaattcgatgtaaaccggtctgaccgaggttgatccgccggtctgaccgagctcgtgccaccggtctgaccggtgttgatccgccggtccaaccgcctgaagattgcctgccgcgtgtgaagtcgccgccggtctgaccgccgcctgccaccggtctgaccgccggtatgtcgttggttagaccgccgaaacccgatgaaacacaaatcgaagaactctcaaaatagatgacaactttattacttctctctgtgtttacaaagtgcaccaacatcactccttacaaaaatcttgactaaactcgaaaccctaactaaactagcaactcaatagctctcaaaagcgataccgggaagcctcacgctccccctctatttatacatgatgtaggcagcctaaagccacgaaccaaactcatactaagagtcctaaacaccttaggaaaccctctagtacaagacacaaactttacataaccaactgtaccaaatttggactccttccaaattcgacttcgcatcccatacgcacactatacctccatcgtatgccatatggaatcttcaccaaccacgtgcatcaactctagccttagtatcccgcatgatatctgaccaccacggacatcgtcttaccatcaagccgactcccagtccatcaccgcaaatactcttccgaggcatcgagtcacctacacacgaaataaacaaagaaaccatattccgataccaagctatccccaacttgactcattgttagcaaacaacagtattacatacgtatagtatccatctagaagccataaccatgaaacaatcacggatatccaaagaaacaacccaaaaccgaaaccgacacaacatcggccggtcagaccgcgggccggccggtctgaccgctcgatcaccaccggtctgaccggcatacaccacccggtcggaccggtaagataaaataacagtgaatctgatcatcacctgaaaattgattatctccaaaaccacttcgacgataatctccaaatatcaaaaccaataatcacagatacctattgttcatcacagaataagaatcaaaacacactttgatcttacaatctcccccttgatgaacacattggcaaacctcataaaaaaatgttttggtgtttggaaaaataaaaacaaaagtggtaaaaaacacacttcgtacaaatgtacacatcgtgctcaaaaatccaaaagaaaacttctccccctttttaaaagaaagaaattctcaattatacacactgtgctcaaaaatccaaaagaaagaaattcccccaattgaaccaaaaacatgctcttctcaacaactctcaaaattcaccttgcttctccaaaaatccaccttgcttctcaaaaaatccaaaaattttcacattacttctcccccttttgacaatgatttcatcaagcataggaattatgttcattaatgttcaagagcatagtata

SEQ ID NO: 56751 - DNA, 4069 bp, Oryza sativa
  unsure (1)..(4069): unsure at all n locations
agcactaactccccctcaaaataacctccaattctccccaaacaaaaatcaagaagaaatcaaagattttgaaaaagacatccaattgccaatgatatcaccaagattatcatgaattgacatgtatacacttgtattaacaaaaactactacctcaaacacaagcatatgaaaagctaataattaagaaagtagaacaaaaaatatgtcaatccaaaattaaattgatgttaccttgtgaagcaatcgtcatctcaaaattgaacactcatagggagtatgctgccaaaatacctacgaacgagaagatgtcgaggccttcgtgttggggttagaaataagaaattttggaatccaacactgagttacacgacctgtagaaccagtaggtacaaatgcactgacaaaatcagaatcagacttacctgaaaaattacctttttccttcacaaaagtctgagttaaatttcgtacaaaattgccccgaggtcggtctgaccaccgctgtgcctacggtctgaccgggcctgacagccggtctgaccgccggttcaactgcggtctgaccgctggacggtctgactgactggtcagtgtcggtctaaccgtggtcctcgaattaaaacccgatttttgccaacgtcgttttgcaaaagcaatttctctttccttttttctgtttatgggcaagtttaaaacaaaaaccaaccaaatgtccatcttttccacaaaaagaacaagtgtacttctcacgacaagtttgtgaagtggatggttttgaaattgatggttttgcaacaacagaaggttttgcattcacaacatttgatttcgaagaagatgcattcaaagaagacatgatgccagcagatttatacacagtgttcttaggctcagtttcaatcaaaatttcacctctcccagcaacacccaaaaccgtaggaggatgtctagtatgatgagcataagaatcaaaacctaaaccacgattgtgtgtgctaactttagattgatcaagaatcatgttgaggttctttttaccatcagaaaatctttgcaaagaacttttcaaataagaaacctcctgagtaagaatagcacaatttttgcaagcatccaaaagacctttttgttttctacaagttgagcaagaaaacacctcatcttgtttaacaatttcttccatgtgtttaacacgctctaaagcatctttcaacttcaactcattcaaaacacactttgaacaatcttgagaaatcaaaacaccattgttttgttttgccttatttgcacatgaagcattgaccaaagaacttgcacaaaaagcaactttgtatttttttcaaaacgttctttgtcaaaatcaactcatcaacaacacgagcatgtaaagcaaatccaagagcaaaagaagactccaactttttagatttttcaatctcaaattccatttttttgcaattaacagaattgacatatcgcaaagcattaatttcagaaaataaaacttcacaagattgacaattatcatctttaggaatcaaagattttaatctagcaatttcagcattaagaatctcaatcgtacgatccttctcatcaagcacaatagaacatgtttgaagtttcttagcaaatttgtaagcatcatattctaattgatcataactaagcttttcttcattatcatcatcagattcatcaacatcagaacttgcattacgagcaataaaagctagatcaacaacttgcttacctttgccctcatcttcatcttcagatccatcaaaaatttttatgagttcttgaattaaccactgcatgcaatgtttcttcttctccttctccttcatgttcttcttcttgttcacgtcatcctctttgactctaccatcatcttccttcttgactctcccaagcttagggcaatgcgagcgaagatgatcaagtgcaccacactcaaaacaacgattcggttatcctcttttcctgttcctaacatttttcatagctcgagaaaatttgttaaatagcaaaaccaagtcctcctcctcgaactgttcgagttgatcatcagacatggcattaaataaagtaagaacataagacttcgatgaagaagcaccaacatccaaagaagttgaagacgaaaccaaagcactagaattagaatcacctttacgagaaagaatattcatctcatgagttttcagttttgtgtaaagcgaatccaaagtcaaagtagacatgttcacagactcctgaatagatgtaattttcatctcccaaatagacatgtcaagaccattcaaaaagtgacgagaaatctcaaattgtagataattagcatcataagaagaatcaacagatctaagatcacccaaaattttattaaacctaaaaaagatagtcatccaaagcttctccaggtttcatctcaaatttaatgtactcctttttgaaaagatcacaacgaagttctttaatgttattagtaccttaatgaaaattattcaaagcaacccaaatctcatgagcagtttgaagatgagcaacacaatcataatccgaacgagaaatcccactcaaaaaaatattgcgagctttgcaattcagttcaaaagcagttttttcagcagcagtattaataacttcaggaatcacataaggaagagaaacttttctccaaatatcataattctcagccataatgtaagattgcatcctactacaccaatgagaaaaatccattccatcgaaaacatgaggcttagttgaaaacttattagaagcagccatggcaaaaactttggatcggttaaaatccaaagaagcaaacaaagctctgatactacttgtaggatcgaatcacaagaactaagccaaccagagggggggtgaatggttgatataccccaaaacccaaacttttagcggaaataaaagttaccctcaaattcgatgtagatcggtctgaccgaggttgatccgccggtctgaccgagctcgtgccgctggtctgaccagtgttgatccgccggtccaactgcctgaagattgcctgtcgcgtgtgaagtcgccgccggtctgaccgccggtatgtcgccggttagaccgccgaaacccgatgaaacacaaatcgaagaactctcaaagtagatgataactttattacttctctctatgtttacaaagtgcaccaacaacactccttacaaaaatctcgactaaactcgaaaccctaactaaactagcaactcaattactctcaaaagtgatactgggaagactcacgctccccctctatttattcatgaggtaggcagcctaaagccacgaaccaaactcatactaagagtcctaaacaccttaggaaaccctctagtacaagacacaaactntacataaccaattgtaccaaatttggactccttccaaattcgactccgcatcccatacgcacacaatacctccatcgtatgccatatggaatcttcaccaaccacgtgcatcaactctagccttagtatcccgcatgatatctgaccaccacggacatcgtcttaccatcaagccgactctcagtccatcaccgcaaatactcttccgaggcatcgagtcacctacacacgaaataaacaaagaaaccatattccgataccaagctatccccaacttgactcattgttagcaaacaacagtattacatacgtatattatctatctagaagtcataaccatgaaacaatcatggatatccaaagaaacaacccgaaaccgaaaccgacatagcgtcggccggtcagaccgcgggctggccggtctgaccgctcgatcaccaccggtctgaccggcatacaccacctagtcggaccggtcacataaaataatagtgaatccgatcatcacctgaaaattgattatctccaaaaccacttcgacgataatctccaaatatcaaaaccaataatcacagatgtcaattgttcatcacagaataagaatcaaaacacactttaatcttacattacgttattatacgttcaccgtgaataacatttagacccat

SEQ ID NO: 56752 - DNA, 7550 bp, Oryza sativa
catgtaagacctgatgactgaaaaccttagcgcagtactactctgggccccggcgttagtggctacaaagcagtacaccagttggtgtgaactaatttgacagcttaattactttgcagtcgtgttatgttagagtaccgaaacgtgtgcatgactagtgtaggtgacaattacatttgggatcgagttaatggtgacaataacattggcatcgagttaaacacgccgtacattgaaacttactctacggatatattctccttgtctcgaatgaaaaagaaagaaagaaaataattaatgatgaggtcaagaaaatatcacatcgttgatctagctggagaaaaccaacaagctaagactgctagctactgaagaatatcaaccatggtcgctataatggaacgatcaaattagaccactcgacaagatgttgaaagattccatacctttgactatgctagagcattttcaccggtacgttaattaccgcgtgttaattcgacgtacgtcaaaactaaacacctggtagtacgtgttcgaactctcctgttgcatgcacacgtaagtgacacgcataagaatccagaccgatcacacgtaatacacatggaaatcaaatcgcacagagactaatgctgcaattaaaattccatctggaatttaacacgatcagtacgtctgaacatgcctacatctacctgaaacggacccgtggaaaaccggaaaacgccatggccgacacacatctacactactctcaggctagtccaatgagcactccggtcgtcgccggccgtgcaaccgccgaaataaacgacgacgacggtgacgactgatgagacgttacaagctaggcaagaccataaaattaaattaaaaacaagcacacacgcactagaattccaagaaaactacgtcttgttacgactctttgcttgtagcagtacatgtgtcttgttgtgaaatgttgattaattctagcccttgtaagtgttatccatatcgatgcaatgcctgatcccgaagccacgtcttgggatttcgtacggggctcctcctctcacgaggagctgagttttctaaccaaaaaaaactgttacttattgtgcatagtcagatcgatagataggttgtttcaaaaaagaaaacgatataagatagatgttgcatgcatatacattacattagcagtgagattaattaatagtaagaacattaattatccataatatgtaattaacattcataatatatatatgtctgttgcattgctggtggtaatgagaatcttgagatctattccaagtccaacgtccaattaaaggagaacagcttatatattagccagtttttggttccaacaaccagttgacctcaatcatcatgacgatcgaagagctagagaaaaaaattatcaggatcaaaggtgtattataatacagaagagaggatagttggcgtaaaataataactatacattgttactgaaattctgtgtggcccaaacaagttgactcgagattttatacggagacgcaactgctagtccggccttagttttccattatactgtataaatcttcggtcatcggtgagctatagaaggagatcagattaaggcactgaaatggctatcaccttacaggatgcagacgatggcatgccatgagtcaacattgcagaggtccgacttaagacatcgaagcatatatatacactaagtgttgtgaatcacaattaatgcatgcgtttagaaaacaaaatggtaacaccttaggtttttttttctaactaatttttgggttttgctaggtttgcatacaagctagctagcaacctcaatcaagggcactccttaattacataagaattatataaaggtcatgaacgaattatattgtctaacacatatatatcatcaaaaaaaaatttgcatgttgttttactcaattcctaaggtgctgtagacagctatattctccatgaaatgaagtgcttgcgagccacttgatactaaattatagtcacatacacaagtcaacagttcaatttatagcgcgagcgagttctataaaagtactaaacatggcattgaaagttgacattgtgcaactagaatgctagatttatacatatgaaaagaaaatattaatgtatatatagctcacattttaatctgtcattttggtaatggggaaactaaggtgcgtgatgatagcggccctgaagaaattccaagagttgacctgggctccatacaatactaatccccttagcgttagaagcgctctctcccatcatgcacatgaccaagcccccacttgacttcggtatcccttgtcatttggatcacaccaccgtgcacttcacaattcacactactccttcagattaatccatctcgttgatatttcatctcgagtcgtaaaaaccctcatattgtattcatcactgacatgtgtgcccccaaaaaatatcaataggtgtagaaggtcgtgtatatatacgcattcatgtgtgtcaaggcaatatattttgttgaatatgagatgacatgggataataggattaaggaggagtcttccctcctcattgcccttttaatacgtcttagacacccagacattgacttagatgcctcgggagaagtagcattaggatttaagaccgttccccattttagctgtaccaagagagacaaaggtacacaagattaccagaaagaggccaggagcatgtcatccaagaagaagagagctgccatagatctctccctggaggcagagagaagacggccagaagaacgcggcggcggcagcgatcgcgaagccagcgatggcgccgctgctgcagctgaggaagatggtgatgtcaagcaacgagagggccctaaagaggaaaccggcggcgaggaggagaaggtagttgaagtggttgtggaccaaggagaagacggctccaatgaggagatcaaatataggactcaacaagcagagatgatcgaggaggacaagcaaccagctgcagcagcaaacgtcgacgacgatggcggcgacagcgacggagtcggagctagcgcggaagagaagcacatggtaacagaggccaccggcggcgaaggcgacgacggaggcgatagccgtacccccatggcgcaagatgaggtactatacacagtactacaattaaacttaccgacgattataaaaactcctaattatactattagctggtgatgtgatgcaagtagatagaattaatatcgatggagatttctcttgtcctttgctcccatttggagttgacatatatatgtgtgcttcttcagctcagcgagatgcaggaggagatggagaggatgaaggaggagaaccggatgctccggcgagtcgtcgacaagacggtgcgcgactactacgagctgcagatgaagctagccgcctaccagcagcaaccggcagcagcagatgagcctaaggtgatttaatttcttaattagctgagctagcttaaccaagctgatttagctagctattatagctaggctaaatatccaattgagcctacccatgttgaaactaagcttagctctagctcgcgcgctcatctcgtgcatgactttaattattcttccacgtgacacaccataattaccatattactcaattaagtcacgccttgttgtttgcgaactcgtgattgattcgatcgatttccgtgtaggagaccgaggtgttcctctccctcggcgcaacggccgccgcctccgccggctgcggcggcggcttcccggaggcgaagagcaaggagcaggccgcgtggcggcggcgctctgtcggaagcgacgacagcgactgcggcaaggaggatctagggctgtcccttagcctgggagcgtcgtcgtcgtacgacgacgaccagaaggcggtggaagcaaggccgcacgacgtcgacggcgcggcggctgcggccatgatcggcggcgacggcagcaggccggcgccgagggggtacgcgctgctggagagcagcaaggtgcagggtggcgcggcgccggccgccggcgagctcgccgcggccggcggcatcacgagccagagcgtcaacccggccaaccgcaaaactagggtttcagttcgagtccggtgccaaggccccaccgtaagacacaatgcatgcaacatctgtgcgtgcatgcgtgcagtacatgatacgagtactaattactaatattgatcttgtgatgttgtcgcaccggtgcagatgaacgatgggtgccaatggcggaaatacgggcagaaggtcgccaagggcaacccgtgcccgcgagcttactaccggtgcaccgtcgcgccgggctgcccggtgcggaagcaggtgacgatcgaaactgacaagaattcagattgattagcattggttgcatgcatgatcatgtgtgttcgtgcatggattgatcgatctcgtttgattgtgtgcaggtgcagagatgcctcgaggacatgtcgatcctggtgacgacgtacgagggcacgcacaaccacccgctccccgtcggcgccaccgccatggcgtccaccacctccgccgcggccaccttcatgcttctctccagcaccacctcctcctcctccgtctccgacgcctccgccgcgccgtcgtcgtcctacctcagcccgtacctgctcaactccgcctcgccgttgctaatgccgggcgccaccggcggcggcggcggcatgcagcatctcaacctgttcgggaattcgccgtcgtcgtcgtctctgctagctccgcaagcgccaggctccagcaagtacccgtggtctccgaaccaccctccgctcgccggcgccggaggtaataagagaccgttctggagcgccggcggcgacggggacaagccggcgccggcggcattggccgagaacgtcggcgcggtgatgtcggacccgaacaagttctcggcggcgatcgccgcggcgatcaacaacttcatggggaaagacggcgagagtagcagcggcaagagtagtagtaagtggggcgtggttgaatcacttccaccccatgagtagtagtgagaattatattactagttactagctaatcaaatgtgacaagattgattcaatgattgggaaatcagttaggattattgcgtgtaaacaaatcaaactaggggaaatcacacattggaaacatttttttcggggagatttcgttgtaatttttcagtttttttttgtttggaacagatcgaattgttgttaaccgtaaattacagtatctgttcatcgtctttattaattaacaaggttgtacgatcatattcagatcatacaaagtagtatcctatattagtagggccgtgggggttcagttctgtgtgctataacagttttttatttactacatttataagcatttttatggttattttaccatacttaaggagttatcgggagttaccatattttctatattgaaaatattttctagtataaaatttgatgcatatggtggtattagttatcaaaatttttagtgtaaaatgtaggtacctgctctattaagaaccataaaatttctcattttcttatgggcagtcgatttcacacttgcccttggtttattcaagaatgtttgccggcattttaaattttggagaaaaaaaactaaccggtggatatatcagtgcatttaatagtggtttcaatttggtccctatgtctaaattgatcggttgttttgctctctccttttatttatttttatttttttaacacgcaaaacaattgcacatcaatgtattagaataaaaaaatgttacacaacgtaagtggctagacatgtaattaatgaaaaagagttttcattatttggtctattaattatacacatgatctggttgtaactatatatattgtgacaattattttttctgtttgagaaaacaaatgtccacagaggttcgcttaaatagtaagggttacatcatgacaggatcgcatcatttatgaaacactgtatgggctactgtgccagggtcacacctgtagctgatcaagcattatcagttggcttccagaacaacaatactgaattaggcctaataacaaaaccacactttgaaatcttgtggctagtactatatatatatatatatatatatatatatatatatatatatatatataaatatatagcttgatgactacttcatccgtttcataatgtaagactttctagtattacccacatttatttagatgttaatagatgtagacatatgtatgcgtttaaatttattaacatatatatatatatatatatatatatatatatatatatatgtggataatgctaaaaagtcttacattctgaaatgaagggagtattaattaagacagatcatacgaattcagcaagtattgttttgtgctgtactgctagcagtgcaagagttgttccgcgaataactcatttttccttttgatttttcggtttgagaacgtcgtctagcaccattcaaattaaggaagcctgcagtgcactgtgcactctgcatggtctcctgactaattagcaatctggcgccgtcagctcagctttctcttgtaaaacatactccctccgtaaaaaaaaaaagacaaaccctgggttttcgtattcaatgtttaaccgtctatcttatttgaaaaaattatgaaaaaaattaaaaagacaagtcacgcataaagtattaatcatgttttatcatctaacaacaatgaaaataataattataaaaaaatttcatataagacggacggtcaaacgtttgacataaaaatctagtgtttgtctttttttttttaaggcagagggagtacgtagagattggcgcggccggggatgcaatatgcaagtcaaggccgttgcagcgaaccagcttgttggtagcggccatcaggatgcaggccggatcgatgcctgcaaactattgttgcgcatgaagcgactgttgtagcacattagaagccagtatggtggacaggatcttccggcaggcctctgtaaggccccagaggaatttcacagagagaacgctaagccgctaactcttcagttcagtaagatatcttatatatggggtatatagggcaaagttgtctcggtacccaaaaagaaaggggaaatgttatcactaaacaaggaagaacagagatcgcatattacattcgtatagaggaaaacaatcactgtacgctccggacaagcttctccagactctagagtggtgtactacgttccaacttccaaccccttgtttccattgatcattctaacacctctggtcacatggttctgaccatttctggaacatgcctatgctctcttgcagtagtgtccttcgcgtaactaagcctattttccgttaagctcagtcattgcttgtacttacacgagtgttaaatcccctcctggcatgtactttcatcagcactaaagtctgaaatttcttgtagtattagggtgtgtttgagaagaaggggattggggagatt

SEQ ID NO: 56753 - DNA, 2360 bp, Oryza sativa
cccagcttttgcgtggacgcggtccatgactgcaccgcgaccccggcttccgtcccggctcccgcccgcccgaagagggagccggtgcatggaccgggtccacgcaggggtgaacaggcggcgaaactgtaattgcaacgcgaactcgcaccaaaaaacgtggggcccacccgcccaaaatctttgcgtctcctcccctttctaatccactttttattttttgcgccattttttctttttctttttcgttttgttttttttttcgttaatttggcttaactaggggtgtccttgtctttcgccattttctctctcgctcggtttgctgctctcctcctcctcgtcgtcgtctccaactccgtcgcggcctcgcgctcaccgccgccggaatccggctgacctcctccgctcccgcatcgggcgctcgccccccgggtctaggtacttgcccttgcccccctgcccatgcccttcgtcccgattcgaacatgtcagatttggttggttgggtatcttggtggtgggttggttcgccaggcgccgaggcccaagttctttgtcctggaatggtggctagggagctttgtttcggggttctatctctgtgatttgggtgcggatgggaggaattcttcttggtttgggggaatttggggggttccggtgctgatttgagtgttttctggctggttcttggcgctccttcgggagaattttgtggagctctctgatgggagtggtctaggtcgggatctcagactggatggcctaatttgatcttatcaaggtgaattatgccttctcagtgaggatttaggtgactgtggttacaattgctggggtatttgacctaaaaacgaagatgggcgagcaaaaggggcctcctattgtcaaaattttagtcattgaaccagtagcacgagagcggtgttctcggtgtattctttgcgtgtagattggaggattggccgcaatggcgtagcaaaataccctttaatgtatcttttgagcttctgttgatgcttttaagctttttgattgttgtagtagtgattaacaattttgtaggaaatgatctactgcgagaaggtactgtagtaaggaaatttaattggcagtaaagcttcattttctgaactgtccttgtgcccattgataatgccattaacgtagaaaaaatagcatttcggatagcattttagttaaatcgtgagcacttatctagtcttgggccgtggccctttcatttctttgcttaaagttaacgaagaaagatgcttctcgggtaatatttaataatgcactattcagtggataaggtgcactttttagatggagaagaaagtgtttttgtcactgatttgagttgaaaatggtgaattttgaaccaatttgtggcataagaaaacccttttgccaacctccatccatgtgttagcaatcatggtaggaggatcaagattgaagtaaaacttaaagaagccctttgcttcaaatacctttcttgtgctggttacttagcatgttcttaaaggatggaatccttggcccaattgcagtatcaattgattctctctaattaaaaagttatgtgttgttccttgtttctctttaattctggtagatctgggaggggtcctgacatgctccatgtgggccactggttttccctttatctcttatctggctcttaggtgtgacttttttaatgggtattgtagatcacatctaatgtgcttcattgatttgattatttaaaagcctttggttgttgctattcgtttgtttatgttcctacccttctgtggttggatcccataaagtctacctgtgacttctgctgccttggttgcttgttagtcattgttgtggatcttaagtttgctgacttggtttaaggaggaaggctgctgcaagagtaaagctgcaattggttggtaatgttgctcatgagtttttcttgtataattgcaacaaccaaggaggatctttttgtttgttttccattttgacattgtacaatgccagtttgctacttcttgcttcttttttataagtttgcagccttagtttagtaagtttgcttggtttcatatgcttgatttgactcacaaaaatgataactgtgtggatgcctcttttccttgtttgattatgtgattatatcagggtctacattcactgcctctgtggcggggttcatccctatcatcatgttaaatattaaactttcctccttatgccaattcaatggagcagcaaatggtgattccaatgccaacagaaattgctgcctttggaagttggacagttgtgatttgtgttttttgtttcatgattttagttgcgcccttcaacta

SEQ ID NO: 56754 - DNA, 2764 bp, Oryza sativa
  unsure (1)..(2764): unsure at all n locations
ggaactagccaccgccactcaaattgccttgatcaattcaagaaggcttacaccaagggtgcattgctagaggaacttcctgccaacactgttggcacgaacttggactcgacgccattgattgcaggtgaaaaaaatgagtctgttgatcttgcatgtccactgtgtcgtggcaaggtgaagggatggactatagtagaaccagctcgaagttatctcaatgggaaaaggaggacatgcatgcaggatggttgctcatttgtaggaacctacaaggaactccgcaagcatgtgaagtcagagcaccctcttgcaaagccaagggaagtcgatcccatccttgaacagaagtggagattgctagagattgaaagagagaggcaagatgcactcagtacgataacagcaactatggggagggcgattgttttcggtgattatgtgctagacttggaagatgaagatgatttagatgatgtagaaagtgatgaggatgacaatgccaacggacacgggacagataacactagacgaatgttaatgtttctaatgcgccaagttgctcggcatcatcaaaaccaaaggcttcagaatgcaattggtacaactggcggtgccgaggacaattatgcggtgagcagtggtgcaaatgcaaccacgccttaccattaccccttggaaggcgacgatgaggatgatttggttatggccggaggcggaagcaccggtatggttagaccagagaggcggcgtcggcgccgccgtagaaaccgcgagaggttgttcttaggtgctaattgagacaacaggggctttaccactggaggagtacattgcacaattggttctctggtgcatagcattcatcaatttcaacctcaatttacttgttcatgatcatgtaccaaagtagttgtcttaaccttttagctcattgtttcacttcaatgtatgccatctcacattcattgttgaaaaggaaaataccgcacccatcttgtgcggtttgtgtagcctttatttccagtttttcagaagctctgctaaatattaatccagtggggatcgattttagatctcaccagcttcagatattcagttgtgcttagtgctgactaaacatagatttgaacatttgctaaaccggaggtgttgactgacgatattacaacataagaagcagtaagatcttacaatgacctgagctcatgtttcaaccaaacatagaaactgtagaatacattatcattgagttcgacacttcatcgttgaagtgccctacactttatgacatcaacatacatgctctaaatgatttcccgtaacataacattacaattttgttcataactacattctacagagcatatattaatataatcatttacttgtatatacttgcaagaagaaagatttgtatctcttcacgacggtcgatgagcatttccacagcagatcttctagtaaaccgtcgatcgaaggcatctgccaattcacaccatcttgcctgatctacattcccagatggcgaatgaatatcacaaacatcacaagcacatgcgagctcgtgcaatgcggtgccaagaatgctcacttctgtcaaacgccatacaccatcatgtcatcgattgctcaatgcccagaaccaggaggcgcattggacacccaaaatctcccacttgagcacagggcagttactttttcctaatgatggtaggcacaccgtagcaaacgggagatccaccgatcataagaggaagcctgcaagcacgcctagcttcacttaaatatgaagctactcgcctgttgccacaagtgcaacgcttactacagttattcattcgttcggacttcttccctcgtgtgcctcttcgcctcggcctgccattaccctccacagcaatggtcatggattcaaattctcgtgttagctggcaacacttcgagcaatttttggccgctacaaaattctcttgcaaccatgaaccgagcaatgctttgctgaatcgatcaatatccttatctgacacatcccagagatttgcgataacagctggagaaccagcagataaatatgataaaggggctccttgaggagcataacaccctttgcaacgcaatgttccactactgcaacccataagaagagcagctgcgcaattatctaatttctcaatttcctttccagagacatactgagttcctgcaacatttcaagaccagttagaaaataactgtttagttctaataaatgaaaatggctgttctctgtattagtcaaaggctaccagaacagtgcccagtaagaacaaagatactcatgatcactaggttagttcttattcctaacagtccaatcaataggtaataaatacaattgaaaacttgaaagcatccattggcactgggccccctagaagcagttgttcttgttccaattgacacataacccactctgctatcacatgtggccggtttgtgtagttgactcaagggcaccatctaatgaattagcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56755 - DNA, 4816 bp, Oryza sativa
aacaaccgagtctgactctgatggacttatgcaatccgattgcacaacttgactctaatggccacagaaaaagatacaactcagccaccgtgtccgcctagacctctgttgcgttttcctcacgtccaacttcctctcagcaaatagcttgccacaccacgctcatacacaaattatgcacctgcttgcatctagcctcccatgcattagggcctttttctttccgcttaggatttattataatccagcttattagaagtaagctgaaagaaacaggaagattatttttacagcttattataatctagatgatgggttattgtaatctaataagctcaccaaaggagctttttctggattattagatggcaaaagacccactgcccctgattaattctaattatttacctgaattgccaccgcgtaccgcttcgtttctttttttcgttgaccgtgtgaccgcttcgtatcctgcgcgggagtcgcgagatcccctttcccctccactttctcttcttccaccgagaagatcggcaggcgagggggctgtgcgacggcatcggcctaggcgagcagagggcgtccggtgcgcggcagcagcgaactcgggggcatgctgcgtgcggcggcgaggtccatagcccattccgacggagatggatcctgcagatggtgaggactccctctcgaaagcatttcgataccgtgatgatgtggtgaataagcgatcccaatcaggaggcaaccatggcgtctctggcctacatggctccggcagcttctctgatggattttggggcgacggcgtcggcgaagatggacatataggcgatcttcatggctcacccggcgtccacggccaccatgtctcgcctgccccccatggcgccggcagttctggcggatcacccgtcttccatggagccggtgccgggcaccgcgacgccactgtgttccaagcggtggcagatgtgtctccccctggcagaggccgtggacggcgtggcgggcatggtggtggacctggacgtggtaagagatcggccacacaaccttccgcacgtggtggccgaggaaacaaggtgccatacaagccaccaaggccatccagcagtgcaactgttgtcggcgacgccgagggagcagctggtgtagacaatgacttcacagaagaaacaatggacagtgcgcctcatggaatggtacgtctacttcatttctctacttcaaaaattaaggtttaatgcatttatctactgcaaggattaggttgaatctaattgaatttaacgtgtatgtgtactacatatgaaaaattaatgtgtatgtgtctatgctaattggtcatgtatttaccatttctaatatagaaatacttgtgaatatataaacactagtggtgtaaaacaacatgtaaatctgaaccttgatgtgtttgatttatcaaatagaaggaggagcttgataaagcagattggtctagcacacacaataggatattttgtgaactatgcgtacaacaaattgaagacggcaataggcctatcgggataatgactactagatggtaccagatcatagccaaaaagtacttccaaaagacagggctaagacacaataagacacaactgaagaaccggtgggatgtgctgaaatccatgtacagcttttggcttggtctccttaacgacacagggcttggatgggatcatgcaaaaggaacagttgctgcacctgttgagtactggaaaaaagtcaccaaggtaataattcatgtctcatgtacatgattttcatgaaaatgttttaagtgcttgcaataattgaagatttgatgttttatttttagggacattctgaatggaagaagctacaacatggaccaccagaatgtttagaattgctggatgaaatgtttggtactattgctgttgatggttcttctgcttgtgcacctggagaaaatgctggaggggatgatgcaagtggtgatgtacaggaccttggcgacacaccagtagattgctcattgggtaaaaaaccagtgaagcgagggtcttccagcaccgccactagtccatacaagaaggttaagaaccccatggttaggataatgaggaatattcaaaccactatggataccaattgtgatattgccaacaaggtgatgcaaggtgaatttaggttcaattccattaaggaggtgatggatttggtggtggattgcggggcagcagaaggaagtgcggagcatttcatggctacaagattatttgtgaaagctgaacatcgtgatatgttcaagactcttaccaccaaggtgggaaggctctcttggttgcagagatggtgcgagaaggaagggcagcagtagaaaattgctaattatttatatgcatgaactagttatctctgtttttactttgtcagacaatatgtattagcaagattgctacttatttattcgcatgaacttatgtactgcctggccatgtaatatggcgccttaattttgattggatgaactactgtttagtgatccatcaacatggtctttctgtgactattgaggtgatatcatttgttgcattgtttgtagatgggcatgtatggaagtgatgatgacgatgaggaggaggatgaaactattattgttgctagcagacaactagatatgatgagaaaatttggaccggtgttgacatcatttggtatgttctacgctgaaaattatttgaacaagtccaagtatagaaaagctaatttagcgggtcatgcttgggttatgagaaaccttgaagttccacaagattgttatgacatgtttagaatgagtaggccactctttgagaggttacataatttgttggtctcatcttatggtctgaagtcaactagtaagatggattcagttgaagctttagaaatgtttttgtggaccattggggctccacaatcatttgttcaagttaagaaccgatttgagaggtcaaaaggaaaaattagtagaaaattcaatgaagtgttgcagagtatctatctcctttcaaaagatcttgtcaaacctagagacccaaacttcacaactattcacccaagactacttgatgatcggtttgagccccatttcaacaattgcataggtgcaatagatgggacacatataccagtagttgtgcccgcatcaaaggtggttcaacatgtgggtagaaataaatatccgacgcaaaatggcttggccatttgtgactttgacatgaggtttgcattaattgttgcggggtggcctggatcggcacatgatatgagggtgttcaatgatgctttgcgcaaatatgccgctatcttccctcatccaccacctggtaacttctcttatccgtttaatagtctcgtcgaactagcatcaattataaaataatgtctcatggtttatgtttatgctaacagggaaattttaccttgttgactcgggctatccaaatcgactaggatatctatctccatataaagggaccaaataccatttaccggaatttcgagagggtccacgtcctagtggcaagaaggaggtgttcaaccacttacattcatcgcttcgtaatgtgattgagcgctcttttggtgttttaaaaatgaaatggagaattctattggacttaccaagttatccaatgctcaagcaaacaaaaataatacatgcttgcatggcgctgcataattttattcgagatagcaaattgagtgatgaagagtttgatctgtgtgataatgatgaaaactacatgccgatgccttcatctcaagggaatgccagtcacatgggagacgaagatggggacgcaaatgccttccgtgatagtattgctgatgctttatttgctaggagataataatttggttttaagtctaatatatatgtggaagaaatattcatgaatgtataattataaatatttgtcaaatttttatttatctacatcaaatttatatctattgtataaagtcaccgaatgatgacaaaggcatccaaaaaaatagttgagggcattctagactttagccatgcaaactcaataatccaggtttccaataatctagagaaagaaacagctcacagcttattttcctctagcttataataatccagcttataataatctgactcaataagttggattataataatcctaagctgaaaaaaacagggccttaatctcagcactgtaacatgcagcttgtgcatatgcctgacgaccaccatgcactagccatcctatattttaatgcatgcagccatgatgattgtatacaaatcgtgccgcatgaaagtgtcttctccgatccatgcgatttgctcgactccgttcaagttgtacgcaaagaacagcatccgtactgttcgtctgtacctccgcacgcaccgcagtcgcagccctcgtgttcaccgtctacgaccccgtcatcatcggccatgcacgtccgccgcgccgcgccacgctcgccggcttcgcccttccatcactagcctccctgccgccgcggatccgcgatcgccgcgtgcgtcgggcgcgccgtccatggcgctacccctccgatctctccgaacgccttcggccacgcccggcctcgtcttccagtcacgctccgccatcgtcggtctgatcgcgagtgaggtcgtcgcctccgcaacgtcctcgttgtcgccatcgatctcatcgccatgactgacgatctcctgtcgatgcacgatcctcacctcgtgtttcctcctccacatgtcttctcgatccaatactgaaaccttctgctcgat

SEQ ID NO: 56756 - DNA, 8706 bp, Oryza sativa
ttttcgagttgaactaaacaaacaccatgtcacatgcactaatttacggcgagaaattgagaattgaaggccagcaaaggcgagaaatttaaacacgactgcacgagcggcgccaacgaaaacaacgggcgcccgcctctccgcttattcgctgcaccacatagttaggatctacggagtatttggcatagctcagctccggctcggcgaaacagttcagctttaataaattagaggtagagctatggacccaactccattctagacggagttggagtaccaaacagatccgtagttttctgttttaaaatacaacaacatctgacaatgtgtatatatatactaccactatttcttttagagataatcccttatatgccactaaaaattggtctgatcccttatatgccattgaaaattagctattcccttttatgtcattggtctaattttgcgctcactttcatgccactcccgtcagttgactgtaggttgactgctaaatccaaagtaaaaaagacgtatttacccttctgagttgttaggcatgtcctatgctcagaagggcaaatatgtcttttttactttagatttaacggtcaacacacagtcaactgatggtagtggcatgagagagtgcgcaaatttggaccaatggcatatagggaaagagccaattttcaatggcatataaggaatcagaccaattttcagtggcatataaggaattctctctttttttatgattttatgtttgatcatttgtttaaaaaattatataaatattatttatgttgttgtgacttgttttatcataaaaagctataatattaacatatattttgacatacatatttacgctgaatttctaaataaaatgaaagattaaatgttatgaaagaaatcaacggtgtcattagaaaaacagaggtacttccttcgttcaaaattaatatagcaaaatttaagaatggatgagatacaccttaatagtacaacaatatctactgttgtattatgatatactccctccgtcccaacatccccttctagattgaggtttttttttttgggacggagggagtcccgttttatgttcttatgaagtgtagtatatattttaagacagctatagcacgtcaataccatcctgacaacgccgatcgaaacatcaaaactcggacgcgcgttggcagagcctggttggttggtgatttgggcatttggccgggcaagcagcgcgcatacttcctccgttaaaaaaaactcaatctcatattaggatgggacacattacacattctagtacaacgaatatggacataggatgtgtcttatccttttttttttgaaatttaggatgtgtcttatcctaatacgaggttaagttttttttttaacggagggagtaggttggaggttggaggcagaaggccggctggcacgtccgtttctgtttgggactttggacgccattttggcagtggtggtggtagcgcccgtgccagtgccgcaacgcaatctcgtttaccttctggcttcgtacaggtgcggcggcctaactcccaccatccaccacacgtaacacgcagtacatacggtcgcggggagggggggtacaatttggcgaagagcttgccaacacaacacagccgcctcaaggttcacgcgacgttgtattaccacggaagcttcgagctgtgtttcgtaaagctcgagttgggacctctttccccattgtacgcagaacaaaacgatggtttagtacatgattaattaagtattacttaaaaaaatttaaaaaaggattttctaaaacaactaattttcttttctctaaaagaacatatatttagcagtttcggaaatgtgttcatataaaaaaggagaaacggagaaatgagaagttggggaagtagactaaagaacacaaccttaatttatccttgtccagataaagcaggtgaatgatgatgtgtatgtacagtgtaccccacggatggcaggtaaccagtccacttgactaggattttcccctcgtgtcgtgtggttcaaagtggtggtgaagtggatggcgaaagcagatgcgctccgtccccggtggcggctcagatgctgagatgcccccctccctctctcacttggataaagttgatgtcgacaaaatgaagccatcgcgtggcgattacagctagtaatccttccgtcccattttaaatacaattgtgagtttatatatcaattatttgaccgtctatcttatttaaaacttttctatgattagtattttttttgttgttattagatgataaaatataaatagtactttatacgttattcttttataatttttttaaataaaacggattgtcacatgttagacacgaagactgactgctgtacttaaaatgggacacggatggagcactactgcaaggtaatttgtgctttggaaagccacagcccaagcccacaacagttagcccaggtacgtaaatgtagcaggcacaacatatatgggccagagttaattaggccatgtctggcaaacttatgagattctgataaccagcgggatatcactagtactactatctataaagctggtgaaatctgatgattacttggtcgttttcaaaattttacaactacctagtttcacgatatgaattgtttgaagatgctggagatttttagagtagttactacagttgataccagatgtcccagcatagggcttagtaagtttaaggtttcatgagatctgtttcaaacagaggatgcagtgtactcaaggaaaataatggattttttcatgataataaccttaaccctttctagaagtgcttatatttgtgaacggagttagcatatctgtcagaacctctcgatgcttcccaagaaccattaaaaatttcaacaaaccaacacattacgtcatcatctacaacaaaaaaagaacagaaagaactgcggtgagatgagacgcatatgatatgttctttccccccaaattctccttgtgctgtcgcagcccaaattgcactagctacagtcctagctgtcacgcgcgcacgcgtccgccctcgtcgtcgtcgtcgtcacggccggctgaacgcgctcttcgccgtcctcggcacctcgtcgaagctctgcaaccccttcacctcgttccacggcgagctcttcgccgccgcgccgccgccgccgcccagcagcggctccgagtccttcatctccgccatctgcaacacacaagcacactcatgtcactatgtcagctaggatcgataatcttatttccaaaatctgaaccttttatccacagtcaagtcattcgtaatgggcgtgacaattttatcatgacgtggcaagacaacattgtcacaccatttagattggtgtggcaacgttgttttgccacatcagattggttggcgtgatcaagaggtttagatatttttttttacgcaaaaaagggttcagatattaaaagctactccctccgtttctaaatatttgacaccgtcgacttattagcacatgtttgaccgttcgtcttattcaaaaacttttatgaaatatgtaaaactatatgtatacatatgagtatatttaacaatgaatcaaataatagcaaaagaattaataattacttaaattttttaaataagacaaacggtcaaacatattttaaaaggtcaacggcgtcagatatttagaaacggagggagtagtattgaaaaagtttgttttcaaaattaaaaattgaataagttcaaaatatatatatatagaaaaagtgagagagtagctagagtgaggtatggtggatggacctgggaggaagagatggggagaggaggggaggggccgtcggcgagcttcttgtcgcgggactcggagacggagaagaaggagtagaggcccatcccgaagatggcgacgaggatgccggcgacgttgcggaaggtgaaggggtccctgaggaggacgtagccgaaggagaggatgaggcacgtcttgaggtgccccagcacctggtacgtcaccggcgacgtcgtcccgatcaccaggaacgtgctgaagttcacgcacaccgcgatcgagcaggacagcacgatgaacgcctgcaattcaacaacaacaaccacaagaacaccatgtcagctcaggctctgtttgtttaagcttaagattattataatatagattattcaatcagattactataagctagattatagtaagctaacatagaataagttgtaagttgtttgtttctttgaattatttgaggcatctaataagggtagtgggtctttaggcacacaataatctgaaaatagctcctccagagaagattattagattatactccctccatcccaaaatgtttgacgccgttgacttttttaaatatgtttgaccgttcgtcttattaaaaaaattatgaaatatataaaactatatgtatacataaaaatatatttaacaatgaatcaaatgatatgaaaagaattaaaaaatacttaaattttttgaataagacaaaaggtcaaacatgattaaaaaagtcaacgacgtcaaacattttaggacggagggagtactaatctggattatagattataataatctatcataacaatctacttgtttgtttcagcttactcccaataatccagattataataatcctaagctgaatcaaacagggccttaatcacgtcaaccatggcggccgcgtcgacgtcattccttcactagcatgatatggcttgacacaccaaggtatacgtacgtaccacgacttggaaggtgtaggtgaaggcgaagacgtcgcggttggtgaggagcttgtcgacgaacgggccggtgacgagcagcacggcggactggtacggcgacgactggtacagcagctgcgtcgacgacaccttcagcctcctctggatttggttcgtcagctttagtttcgctccaggtgaaggagagacaataatcacacaaatttgtagagttcagagaacgaataatgttcagagtgtgacgggtttagttcctgattttagttcatttgagctagaaaattaaggatacaatctggctgacgcacgtcgcggcgatggtgagcacggcgatgatcgagccgaggagattgagctggagatcggtcaccgacgcgataccgactccaaggagcaagaccatgagggagatcttgatgctccggctgcaggacagtagtgttcagtgttgtgaattgtgagaaaaaaaaaacatctttggttgcatcaaagtcaagttgattctgtacaacatagtgctatcagagagtgaggtgtgaatttgacaatgacctgaacttcttgctaagaaagatggtttccaagagcatggtgaatggtatgatagccagcttggtcatctgcagagaaaaacacccatgatttcagaagtgagaaaaccaaaatgcagtgattggggtcagcaaagtgaatggtgcttgcctggtagaagccaactgagttgaatccaaggcaaaggttgaggaggccaatggagataccattgagcagcccgaaggagatgacggtctgcgcatcgatcggcttcgcctcgaagaaccgcagccgctgcgcgacgtacagcgtgcagaaggtcaccatcaggtgccagctcgtcagcgtcgtcgctgcattttccacatttccaaaacacaaaatgacattcagaaacatctctacacaccagagaccagacattacaatttacaaaattacaaccagtaaaactacttgacaaaaaatttgtcggacggagtacagtatctgaaactctctgaaagtaaaaaaagaaattttcactgaccgaagaagaagcccagggtgctgataaggtacttattgcagatgacaatagccaccgacgacgtgaccgacatccccagagccccggcgacgccgagcctcgacgccgcgccgtccgtcgccgacgacatctcctcacaggcgatcacctatctggtggaagaagaagatcccatcggtgaaacaaaaaggaggaaaacctctgttacaaaatcttgaaccacgcaattaaatacacaggtgaaagaagaactgtcccctcttgatttgtttttaggagagacgtgatctcggtaaggaaaaccgagcgttgacatggacggcagcgatcccgatggcgacctccattactgtacggctcaacctctgcgtgatgggggtgtggtagagagcaccatagcgtccatgtgaagcatgtgttcatggcaacattgatgaactcactattcattgctccatttctttttgcattatatgacatgctaccaaaatgtgacagggagaagtgtacactagtagaatctgaaaattgggttttctgtcatgttctgttgtaagatcgaggcatatgactgcggttagttcagttatcacacccaagtttcagttatcgagtgacctgaaattaacatgtttgtctgcttaattgcatatcctatattgacaatgctcaacagccaacaatacatgtgccgaacaatggggtgctcacatcacaagaacacacaaaataattggagtgtttatgaccatcttacgtttatatatgtatactcatttggtagatggtcacatcatcagcactgtgtgtgtggcagatggatatgaaatggacggatgcttcagcagttcaacgcttcaacagcacaagagatcaatcatcaatggcgtccaagctaactaccagtactcacttcgttccttaatataagagattttgacattttgcttgcactgtttgaccactcgtcttattaaaaaaaattgtgcaaatataaaaaacaaaaggttgtgtttaaagtactttggataataaagtaagtcacaaataaaataaataataattttaaaattttttgaataaaacgaatggtcaaacagtataagcaaaatgttaaaatcacttatattaggggacggagggagtagtactcgatcactatcgtactcttgactagtactagtactataattgacacatgtgatggtccaatctgtacataggagactgcatgcatggtcttcgatcgcctaatattgaataatttagttgaaatctgagctctagggctcttgatctgagcagtaatttgctatagccaaggtcattatttaatttgttcggcaggaagtacatttgggctagtaacgtatatgtagctagtcaaacgaggtagaggctgggacgtgtgagattcttgtccattattaggacaaggaaactctaatgtgcgtgtccaaggaaaatttctagggaaataaaatcctttttacctttctctagaacacttgaattcctaagtcattctcaaggcaagatctgctttttttttttttaaaaaaaagagaggcatcctgctaaaataaatgataactagtatggtggcttgcgcagattgcgcagctagcatcattatattttctctcatataatagcatatatgttttcgcattatattattcaaatatattaaaatgacaacataattttaaattttacaataactttacaaaactactaatgtgtaatattcatattgtattttatatacatgttagttatcaattatttttaatatcaaattttagttatttgtaaattatatatattcctacatggactgtagactcgtcttttaatatttctttttttagttccgaattttctgtaaattgtatttctatatagactctaagctcttcttctaatattatttatttttatttctgaatttttattatttctaattgtatttctatatggactctaaactcacctttcaatattctttaatttttaatttcgaatttcagttacttctaaattgtattattatattgactttaaactcttcttcccatgtttttcttaatttcgaattttagttatttgtaaattgtatttttatacggactctaaactctacttttaattttattatgtttattccaaattttagttagttttaaattcctatatggactctatactctacttctaatattccttatttttaattctgaatttctattatttcctaattatatttctatatggactctatactctacttctattattccttatttttaattccgaatttcaattatttcctaattgtatttctatatggattctatactctacttctaatattccttatttttaattccgaatttcagttatttcctaattgtatttctatatggactccagtctcctcttctaatattccttattttttaattctgaatttcagctatttctaaattgtatttctatatggactctaccttttctttttctccgattaatgtgagaatttctaggccatgagagtgaacgtggaggctcatttttctaatcctttaataatataatagattacgtaatttcttttgaataagataaatgatcaatcggcaatcgcatcttaaaaagttaaacgtaccatatatcataaaatggaatgagtacttacgcactccctctatccaaaaaacgatgtcatatatgattgatcacttatattttgggatagagggattattaaatatgatagctgagaaatttccatcgcgacggtcacccacgcccggaattaaattaggt

SEQ ID NO: 56757 - DNA, 2767 bp, Oryza sativa
  unsure (1)..(2767): unsure at all n locations
tcagacggcgtgtgacgtcagcaattgcacggaacgggacaaagtgatcaatcatgcccacttatctcagccagtgagcggaaataaaaacgatgcaaatgatcgacacctctgaattgatggattgaataactaaataaataagctgctggaacagctaggaacgactttgctatagctaatactagctgcataatctcgatcacatgattcatgaagtacaccaaaaccgaagtcagcctcttgcaaagcttattagggaacgtacgtactagctaaatagacaaaaaaaaataaaaaaaataataaaaaaggcaggaaatatggtcaccatataaaaggattaaaataaagagaaactcgcagttaacccattcctttctttgcgacgtgcgtgcgttgagctagccaactcgatgaaatgccaattattcaaccaaaacgaaacgactcgatcaaacaagcacaacacgcaaagtacacacacagagagatatatatgcaatccatatccaatcaatccgttctatcgatcgagaaggggaaaaaagacaaaacaaacaagaatacaagccagagatgtcgcatggttttcagggagcagcagtataataacttcagcagcaacgcaaacgcaaacggaaacgacgcatgcatgcagcggaattcactccccaaattttcaaccgatcgaaacaaacccaaaaaaaaagaattaatccagacgggaagagatagagatcacgaggagatcgagaggagaaatcgataaacacgggggggatggattatgacgatgaatacgcacccgctcgcttcttcttcttctgacgacgaacacctgatcgaatactgcttttgttcgattttggagatcgatcttcttgagacgagagagagagggggatatatcgctagctagctcgctcttgtggtttcgattaatacggagaggaattgaagaggatggatgaggaggaggattaataatggttgtggttttgttaatcgtcgctgggtttgagaagctagctagctaagctagttgttggagggacccagcgaaaggggagaggatnncgagtcgnntgtgtactcgtgttgttgttgttgggagaaatggagggtaggtggtgaacaactcaaaacacacatgcacacacccgtccgcgcgccgtcgcccatggccctctctctatggcatgtgggccccacaaaagatgaggccattgaggatcctttttgtcgtttgtggaactaaaactttggccctgtttagatggcactaaaatgtaagtagtctatatttaatactctaaattagtgtctaaatacatatactaaagttaagtcactagatccaaacaccacctaaattatgggcctacttgtaagtagagggagataagcttagctcttttttacttttaatggagggattaattttacatgaattctgcgtaatctccttcatttctatctatctatctatctacctatcctatcttatctatcattgttattgtatttattgttcaggtagttttaaaagaaactgctatattctttgaaggttagaaattatacaacgtaaatcacagaaatagaaaaaaaatatctacttcctctatctaaaaaaatcctgtcatgagaataaatatagacatacattatatccggattcatctccatgactccaggaattggttttatgggacaaaagaagtacaacattttaaccgtgtaatcaatagttatacacaaaatgaaattgtggatatgcaagctaacagttgtatagtactaacaccacatcatctcagatctagctccagataaaattatgcaggaaaatccactaggtaagctaatacccataaaatttctacatgtgcaaaccaaacatccgctcaaattttcccctactattttttttggtattataaatatatttatcccttattagtactaatccatgtacaagctatcaacactacattaccaatatctcatagtgccgaagcttgtcaagtgcgaagcttgtccagcacttgacaatgggtagagataaaaatgccattgttgctctacttttttttttcaatactcctacgaggaggtagaaatggttttataagcttaaagttagagctttctatatactcctattttggattacatggtttggattaacctctcgtgtgaggaggtggacacatcaattgatcaatcattcaccaaaacgaaaggcgccgatcgattgcctcacctcaactgccgttagttcacaacgacacctatattttagcagcagcttagcaaaaaccttcgctccccaatcgtgtccgggcacgtgacggcacgccgttgccgtacaaagtctacgaacaattcgtaacgtgtgttcttcagacgaaaggactatgaatgttgtgtattgcaatttgcatatatcttatgaattatgtcgatcgtcggttgagaatgtgagacggagaaagaaaaacacaactgatgcaaccgtgagagaaacattggtcaggcctagctagaggaagagatcccatcttttcatttatgattatacttattagccaaaatttaaattttcaaccttaaacttagagttgattttggggggttttttttcatcgcagtttattttccagagtttgcttttcgtttgcaatgttgtttggcttattccctaaataagccaaacgatagccccgcaaatctgctgtaattcacaaaagatttgcgcatc

SEQ ID NO: 56758 - DNA, 3637 bp, Oryza sativa
taaaagctcccagattttgcatttctttcaaataaattatcatagcgctgcaatttttaaaatatatttgttaggatagtcgaatcataatcaaatgatttttttaggagcgctgcgaccacccccccccccccccaaaaaaaaaaagaagaagaagccaagtagcagacctgtgcaatctcttcccaagttgactgctcagatacaccgagtatctgcctagcttcttgctcagtcattgttttgctggctctacgaatgttattaattgtttcatgggccacaccagttttatttgcatctggcagaatataggaggaaaactaacataagtcatccttctttcaaaaaagaataataacaattctcctacagtcaaagatttggcaggaaaatattaagaaaggtcatatttgtcttgtggtggctattaataagtactaacgtatttccattttctgatattcagaagttagttgtgaacatgtttttagagttgtaaaactttagatacaagctaatcagatatatagttggcctgatctcataattatgcaaatcagagttcttagataacacagaggtgagttctgtatcattgtattgcagaggacatttatgttcaaattaggtaaataaaatccaggcaaacaagtaccattaaaactagtaaaatagagtttgtgcctttatggtacttctttaaaatctaccataagttaggcaaaaaaacaaagatatccatttcttcataaaatcataaaaccgaagaactgacttaactgcaggtaccaaattgttaaaacataagtggacccaacttgtaagtagctagcacagaatgatattagtaaacaatgaaagttcaaacttgttatgacagttttaagcccctagatgctagacatccatgtatcataaatatgtctcgcatgtgagaagaaatcaaacaacaaatctcatgagcaacaggcaacataaaaccaaattgatattgagggagatagcgttatatgtgtaagtaataccaaaaaagttatagtccaaatgcaagcatctataaaacagggtcatatcttacttggacaatgacaatatgaggaattttaattaataattatttgacaagacaatgtcaatataaggaattttaattactaagtatttgataacatcgtttatggttcattttatagaacttggtgcagtatataacaaaatgcaaaattaccgtccattttagtttttgagcgattgttgctccacgtaagcggtcttttcacaaaagtttgctgatatcaatccacatctcatgtttctatctactcagtcaaggaacaaagaggtagcctctatatacagactgcaatggatgaaaaaacttactatcaagtgctttccggtatgcttggagcatagctcttcctataatcccagagcccatgacaatcaagtttgcaataagcttccctgcctgtaaatcaaaaagcaaaactatgtaaataagtggcacaactcaaaatagcagtagttcatgcatttggattttttttggatatgtatgctttcaacactggtccttggaagggggaggacatttcgcaacatatccaatgccaaatcaaccatgaagcaaagccaatccattccaatcaaacctacgggcacgataccacgccacagcggtcgcagaaactagttaccacaaaataattgaagagcgaagtctctaattatcacaacgcgatgccgtaattcggcagcttgcacagaccaaatcatttgctgatgcggtttgacttcgtttgtactgccaaatctaacaaacgaaagcaaggtgcgatccaagtataaaaacaggcaaatccctgtgccggtttatattcgaaaattatttttcccctggagaaatctggcaaactgagcccccgggatcgcatgctgttcttccactcccctaccccgcgaaaccgcgatccattccctcatgcgtatcgaatcgagcgattacaccaaccacacgaggaaatttaacccgtgatcttacacaggcggcgtgtcgcccatcgaggagccccgaatcaagccaatcgaatccggcctcagcatccacccatccacgggtctctacttctcccaaaacaacacaaaaaaaaaacaaaaaaacaaaaaacaaaatcagagcagcatcgcgcgcgcgccgagcgggatgggggcgaggaggaaggggtgagggatgcgaggggaactcaccatggcggacaggcggcggcggcggcggcggccgtgggattgcgcagctgagggggaggggagcaatggagggagggagacgtggaggaggaggaggggtggacacgcgtggtgatgctttcgcttccccgggctgagcctcgcgtcgcgcttggatcgtccagttgggttgggccggctagcttgttctgggaggttctagagatgaaaggagcggaggctcggaccgggcagggctcaatagcctgtctctgggctcttcgttcggcctagtccattttttccttgctagtatgggcctacaagcccgtggttcagctgaggatggaaaaacaccattttgactctctcaagtactatatataaaatataaaaaatctgaaggcctcatttcttttcgcttatgcttatatttattagccaaaatttaatttttcaatcttaaatttagattgattttgaggattttttatcgtagttttatttttcagcctttgtttttagatcgttaaaaaacgtatataaaaattttattcacaaattatttttcatttgtaaatatgccgttttgttttttttctccaaatagccaaacaatggggctgtgattcgctcaaccacagaaaccatgtatgacatctttctcaacgatcaataccatttaatttgtctccctagacggtttggatgggaaaatatgcgatggaaactacatatgtagtggaaacctgtaaattaccgttagatcgaaaaatagatatctgagattcgtccacgttattatgagtaaaaattttactcgttgtccatttttcgatccaaagacagtttccactgcatttatggtttgcactacatattttctcggtttggacatcattttatgttatgtagcagctacatggcacgctaacatagtcttttaatcaatgtgacgtctacgtggtattatatccactaattcattgttaggttaaattatttcaactcctggttgactgccaataaaaattaaaattctaacggtaattctaagcatgttcaaataagttcccaatcaactaacatagttaagttttttttaaaataaataaataaagttattcctataatcaaattgataatccatggtgataatctgctcaacaatttaccatggtgataatattatatgaatattgactctaatcaaacacatacaaagctactatcaaattaccaaacgatcgattttggaaccaatccaattcagacctcagtcagatcaatgagtcagcctctcaacgcttagttacacacattgcattacgagggtgatacaaaaacaactttgctgtggtcaatcgaatctggatatcttgaaaattactgacatacatacgct

SEQ ID NO: 56759 - DNA, 11047 bp, Oryza sativa
gcacgcacgccacactctcgttcttggctttctagctgcatcaaccaaatctttcccagcttcttgatgatgagtcgatcgacttgattcttcttcttcttcttcctcctcctcctacgtcttctgatcgatcgatcgccattgctgtctggcaatttgctgcagctgtaagtgagtacgtcagtaacctaggtggcccatctcccagttcagcttcgatgccaccctgtcgtggtaaggcacgtactcctgcagcagaaatgttcatcagagtctgcaatgttcagaggtctgcaatgcaagaacctgaaagtctgaaacccaagctcgatatatcgagtgactgtcttgtcagtcatcgtgtacctctagcttgtccatcagctcctccgccgtcggcgccatgacgatgatccgccgcgcgctggtgttgatgaacccttcctccaccgccttgtcgatgaacgtcagcagcgagttgtagtacccgtcgacgttgagcagcccaacctgaagaacaagacattcagacatttttttcagttattttgcggttctgaactttctgaagaactctgagcatgcagtatgtaatgtaccggcttatgatggatgccaagctgtgcccatgtaatcacctcgagcagctcctccagagtcccgtaccctcctgcatcatcaacacattcccatgatgaactctgaatgaatattcggtgcgcacacacagcaagatgctggacagataattttttcagtgttcatacatccatctactactactcatcagtcaaagaatcacttgcagtggtagcttagctagctccaattattggttacactagatagaaagataggtagccccagctttctttttttttttcttttcaggcatgtatggtgcatgcactgttcagtggcagaagttaatttcttgctcccatcttgctgtaactctctctgtcagggacttgaatgttctttttcacctgatccagatgagataaacttgcagactatactactgtactatactacaccatgttagtagcacagtaacattttctgactgacagtttgtaaagtaaatctcaccaggtagggctatgaaggcatcagactgccttgccatctctgccttcctttggtgcatatcagcaactggcctcacctcccccactgtctcaccacttatctgccagaaacaatgaaccatgatttggtttttgcaatcagcaatcatcctgagcaatgcatgcatgataaaatgcaaagctgaacagtaaaaagagtttcttggcatgccatgatactatcatactgtgtgttgtagtggtgatggtggtggtgtatgtgcagtgcaggcaaacactagtaggagtagcttatacattcccaagagggcatgattgtgctccaaggggagcaagaaatggcacttgatgatttaactactactctttgcctccatgaagaatggtaaaagggccaggtaggaagaggaccacaagaaattgaagacaggtgagtatggatggccagctttaatttctttggggcatgattatggatggtataggtatagtgacatggtatacaggataagcacaaaaggtacagagtcattactactcccatactctatcacacattatgggtcaattatatacttattttttcttaagaggtttcaaatcttgcataccccaaaactcttgaaattatatactggctgatacagcctttgtcccaaatagtaactacttttagactatgtacttgaacaaacactattgttattctagtgtatgacaaccgacttagccctcatttacagcaagaccagtaggctttatccttctttttgaacaaaataattgtactagtaatatactagtactgtgaacttttttctcccaaagtaatattttttaacccaaaaagaaccttttttttttatcaaacttcacacacacaacaagaacattcctctgggcaagacaccataggcagtcaaagacagtgccctctacttctacacctctgcctataaacaacaccctgcttctgctctagcatcaagaatgcaaaaaagaaaaaggaaaaaaaaaaggtcctctttctctgtagaacaggatgatgccacagcaagactttttggggttaaggaaattaacatctgtaaagctgcatctcggtgagttgtttaatctcacgccaagatctggatttgtgcccctgaaactgaaagagcatgtagcccttgatcacaactgctcaggatttattctttttttgcccaagtgccaatgtcccctgggactccaacaacggctggttcatggggtccaaactcccaaaccccccatttgattatattttctactagtatcacttaaccaaaaaccttaaaaacttccaaaagatgagctcactgccatgattgggttcgtgacaacgcaagtactgctacgggtacaagctgaagtggatcaactcaaggttattaaaatctcgattctattaactgtcatacgattttacgactttgtaatcctagttaagatgtctgattttacgattctatacaagtagaatcttcaattttatgtttttttaatacatacgattctattattcgatcttagaacttttgattctattcagaatcacaaatttaacaataatgttgtgattataactgaaggtggaaaatagatagggcccaatcgtcagtgactcgttcggggcagtttgtgtgtatgtttctttgtgtgcatagtgacttacatgccgatgagaaccaacaatacattattcctacataatatactccctccgtcctaaaatataaaaagttttcctagtacaatgtatgtccagatttattgtactaggatgtgtcacatctatccaaaatcactcttatattatatactccctccgtcccataatatagcaacttagacatgatgtgacacttcatattataacgaatctggatagtaagcatgtccggattcattgtactatgaagtgtcacgtccgctactaggttgttatattatgggacggagggagtagcatataggagtacggtaactttgttgcaggtagacacaaaaatgagacgtacctctggcgtcatgagagtcttgggaatgaccctgcgcgtggacaacaagatgacaaaaagaagcgatcagcacaagaactcggaaacacaagctactagctagaagtactagcatgcagtaattaaaaactgctaaaactatcaaacaaggagagacacattctcctggggattcatgcagtaattagtactagtagtaacagtgtgcagctagcatggaggagtggagtacccgatgacgtggcggccgccgtcgaagaccgcctgagagacgagccccatgaggccgatgctgccgccgccgtacaccaggtctatgctcctcgccacctgcatgcataacacacacagattaaccaactaaccgcacggttaaatttcagttccagttataactcacgtacaactacgggagacatgcagccatagattaatcaaaagaaaacatgcttttaatgtattttagagccgtttacaaacgtcgattaaattcagtcgtacgtgagtcgaacaggtgggtcgtgtgcactcaaaaggggactagtatgaattaatgattgatcaactggggtagtaactaataagccggcaagatgcggtccaagttactatttttcttggattaattacccaacctgctgcagcagcagcatgtagcagctcatggcgaaatggtgattgatcgtctttaatgcgaggcgacatggatgacgcaacagcagcgatgctgagctgagctgatatgagctatggccgcgaattatggcgccgtgaatgcagtaggacccggctcggctatggaccatggaaaatttcggtcggccgccgcgcatgaacagatgggacggcgacggggaggcaggaggaggaataagaagacgatccatcagcttggtggaagaagtcggcgtgtgcagaaagttcagaaacgaaattcgctatagcttgcttgctcaatgagcagtggtagtagcagaggggattgtttggcaaaaaaagtctgcaacttttgcattatatttgcagaccgatgaactgatacggttatagtgacagactgacagtgaccatggacagaggagaagaagaagaagaagaagaagaagcatgtgtaggagtagcatgcatggacagagttagagtttaattaccagctcgttgccgagctcaatggcggcgtcatggtagctcctcttcttcccctggctgctgccgcagaagacgcagatcctcttgaacctggactgcctcatctctctctcctctactattctcttctcttcttgctactctctacgatctatctaatccttgcagtgaaacagctagctagtaattgcctgtatttatcaccctcctctcctctgcccttagctagcgtcgtcgtcactgtgctgctgctagtgcaagcaagcgcactacgctgctgctgctgcaacgacgggttccttgtgatcagctagcaatctccctctgagctagtagtgcgccacccatggctatatactacataaaagtgggagaggagagaggaggagattgtagtgatgagttttcactttccggcgaaatggacgggtgggtgtgtagtacgttgattactggggttgatgtgtgagtccgagtcaccttatcgggattgccggtgcaaattggcttcaaaacaggccgagccggcgaaggttgctgctagctactgtatatccatcgtggggttcatctccatttgcagggtcgttttaggagaaagctaagctagcgcctgcttatacaattatactagtgcatgcgacggggaaaacgcctattacaattatactataattagatttaaaagtttttcctaaaaaaacttacggcattttttaagatagtccatattttttttcttctctttactttttgttattacctttttatttgttacttcctctgtctgaaaacatagcaagtttgttttagcctttaatatgagttttaagaagaggtttaaaaatacttgggttacctcttcgaggtgggtgcggtacaggctcatactacttagaagttaggactataataaagccaagtgatagtagagatagtataggtagtttagtgacaaaatttgttatgtttgaaacaaaaattgaaatagaagttgttatattttaatacggaggaagtactgtatttttaattatatggtaaacgcactcgccactagatacatgataccacacacactgggaatatgttcctaacacacgctaaaaaagacggggaccaacaacacatttttgacatcactgaaatcctattgaaaacccatcttattcgtgcataatatttgtggaaattaggacttaaatattaatagttggagtaatgcacccacgacttcattattcgccggtgcatcgcttactatttttgttcttttcttactaatgcaactactttctattaaataaaccatataacatagtggaatgtttcatattgatacaacagaaaaaattataagactagccttcgaaaggtataatcaagaaaaagacagtcatgccacgcgtctatgatagaaaagcccactactgagagacaacagtaagacatcccaactgcactcaagacacttttgggaacaagagggggtgggcgagagaagaatggatccactctcctatgtacagaccgctaacatggccatcttgtggtgaacggaagcgcctccaaaacaggataaaccgtctgaagcagagattggtgagaaaggacctgtctaaagcgaggacgtagttttcacctgaagaaattaattccctagggagggaaggaagacgccaagacaacaaccccaagaaagttacggctccaaaatggcatcaccgttgtcggccctgaaacaggatgggctttagcctggagatcttccagctctcccatgccactatctccccattgctaccatcttccatcagtcaaagaccgtcgtgccatgctttcaccatcgctcctccacgcccatctcctgagaccactgcgccataccgtcatcaccaagagccaatttgttggagagacattgggtctagctagtctagagaataacatcggatcctgccttggagctaccagatccgacagctccttccaccctctccactgccacctgccactccaccaccccgccatccgctggccctctcactagatacggctatgaatggtctagatctgtacgaccacctccaacctcttggtcacctcaatgcccgaactgaatatgctttctcggggagaaaattcatgtcgccgctgtccttatagccacgtggcttgtaggtgtgcctctcaaacagtggctaggcattatagaggaacagagggttggtggctatggtcgtcgcttcgtcgtctcccgtgtcatctctaggattggatgtgagatagaggacgggtgaatgctactactaatttaatccttagaataggactttgtttcaagataaaagataagagatgctgatttgcttgacatagctagaactcaattaaggctttagttattcatagatagctccacacaaagcagcatggacgcaaaatagatgttctttctgtctgcttactaataaatacttagtacatcaacttgcgtagctgcaaacagttgcacaggccaaaaacacggctaacagtggacggcaatatggattattacatgatcaaaaccccacacaattacgtgcatgtggtgtgcgcatatagtggtttgcgtgtgtgtcttctgtgtaatcgataaaaaaaataaaaaataaataaaaatccagcacaagcatgacagaaagtgatatgaatatatatatatatatatatatatatatatatatatatgatctatcatttgtccaagcttaatgccatatctgatctgcaccaatcgtatctctactgcattttttttctcatttttggttgtgcagagcagaggagttaattgactccacagtttggttgctggcgaggctggtgcgaacatgccaaccagcagcagcagcagccacacgccacgccatccgccaagacagctgttgatgggcgcgggccggggcatgtacgcaatgtagccgtgtgcaggggaggcgcgcgacaccggcatctgcatgggcatgcatcgtcgcggcgcgcgcgcacacgaggtgttcggcccgcgtggggcgccgcgcgcccgcgcgcgcgaggcgcgctgcccgctacggccgccgcgagaggggcgcgcgcggcgcggagaggcacgggcaccgaccggcacggggtgatgggggtggcgcgcgtggcgttgcgctgcgtgtggggctccgtgccggcgggcgcgcgagagttcgtgcccgaccgaccgcacggcgcgcgctttgcattggctggtgttttcggtctcgacgcgcgcgtggtccggcagcggcatggcgcgcgggcctgcacgttgtcttgggaattaaaacaaaaaaaaccaacacatgtagtataaaacccagggtgtaccaccgtacattggtcctgaactaggttgttctatgtctctttgttattatagatcgttttgattatttttactagttaaattttttctaggttcgattaaatttgtagaaaaatatagcaattttgttttaattttcatattcatttttttatattttatcaaaatatataggttccaatgttatatttaataaaacgaatttggtattgtaaatattatttttttatataaataaagtaaaaaaagacttataatataaaatggagagagtgctaacttatttataatctactctacaaaattcagagatgtggtacatagggttagaattcggagaagtatgtttcctgacagttggttagttcgatgctcaattagtttagctctacatgttgcatgcttgcagtactgtacttactgtagtgtagtattgcgcgttgtcgttggccgtgtcggtttcatgatcgatcgatgcttgtttgctaagtcactagttggacaacttactaaccgaaagaggttaaaaaatacgattaacttgcatgcgtgttagcgttcggtgccggccacccaagcacgcaccgcacgcgcgcgtgcccgttaaccggcggcgcatgtacgtcgccgagcctgcgacgccggccctgccgtacgtgctcgtcgtcacccggtgaaaagcggtctccccctgcctctatcaatatcaatagaatttcgcaccgtctcgtgcgagtcgttcaaaaaagaaaacggtctcccccacgagcaattttacagttcttgaaaatgtatcattttttccattataaatttgatacctcttgatatgtaggtactttttctgtttcacaatgtaagtcattctaggtatttacattgtgcttacattgtgaaacggagagagtagtaggtactataaggtactaaattttatactaaaattttggtatctctttaaggactgtaaaattactcctcccccacatttagagaaagtttgtagcaaccatagcttattataaaatctttggttcagtttagagaagcttaagattataagaatccgttggttggtaatcaatttgaatatgaagaagttgggttatataactagtttcttttctgaattatataactagagattcttggaatcttaataagaatccggactgtttgggggaattggagcatttgaaagaagtagcagtagctagaagctctttcaatcagggcctctagtttctccgcgcattaatttctcagttgcattgaaaaaaattgtagtagtagaattcacaaaataatctagatgtcagaaactgacaaatccagattttcgctgactactcgtaaaatactcataaattaaactgctttgaattctctaagctcccaaacagaggacacctctttgttttttggggggacaaatgttgatccttaattatggttgcagcaacgcaatattttcaaagtaattctctacacgctgcatgcaagatctaatagcaaatcaaaacaactaaaaagaaatgaagacgatcgatcggagatcggattacaccagatagccggaaggagagaaaggcagggagcttttaacatgcacgcagcagcaaagcaagccgcagcaggtgatcgatatcatatcatcactaattaatcctgaatttctgatacccctaatccgatcctttacatgagcttaattaacagtggaatccacaaactctcatccaccacttacaaagttacaaaatttttatattccacgcaactgtggggaaaagctactagcatcgctttctccccacggtttccattgctagctaatgacgcatcagaatgaagtataggttagactattaattaaataattagcactccatattataatttgggacactgctgatgtgccttctgacagccggccggtcggatttgactgtcatttgaccagcctctagctcctaataacatatgctggccctgatgcatgcctggatgcatgcctacatggctacagagagcatgcaaaacaattgatgctttggttggttagtgatcggtatgtccatccgtaaacaagaagttacactctgacactgacactgtctgctcatttggccatggagctatagcacgccacaagttgccaaactcacccagcagttgagagaaccaaaaaaaaacctactttaggggtgatcaggggcgtaaagttttaacatatcacatcggatattatatagggtgtcgtataggtggtcggatattaataaaaaaattacagaacccatcagtaaactgtaggacgaatttattaagcctaattaatctatcattagcaaatgtttactgtagtacaacattgtcaaatcatggaacaatttaggctcaaaagattcgtctcgcaaattagttgtaatatgtacaattagttattttttagcctatatttaatacttcatgcaggtgttgaaacgttcgatgtggcagggtgtaaaatttttatgtgggatataaactgggccttagtcttttccaatcgatcagactaattaaggctaagactgtttcagggaagaggaaaagaaaagattaagagagtatgtaaaataagatagttattaacgcatgattaattgagtattaattattttaaatttaaaaatgaattagtatagttttctcaaacaatttttctatagacatcttttttaagtaagcgtgcacacaaaaaattaagatggtagaaaaaaaagtagccggaaatctctaaaatgaatccgaaaatcgaattccgaaaaaaaaatactcagaaatccatagaatgaagccggtgcatgtaactcaatataataccatgaatcgacacgccatatatggcccggaaaagaaacatggagatgatgggagaaacatggaccgtccaatgatcaaggagtagggtgaggatcaaaggggatgggtacccatccatggcccatgcacacaccccactcgacacctagcttggcaaccactcctaaaggaggaggaagaagatggtgcatgatgatgcatgagctagtcttattctatgcatgcgttcgatggctgaagatggatgatgcagcctcctcctgcgttgcccccctcgtgccctagggatgggagacatatgcgccttttcggtaatgctgcgagtccaacacccactcggccaccctcccctgatacctgtatgaagttagcttattacgatccctttccatcttaaaataaatcaatcactggctaagaacggtcgtagttgatcaccatttcatcaccatcagtgaaatgataaattaaacaagcatactattttcattaaaaaaatcgatttcgggctgcag

SEQ ID NO: 56760 - DNA, 2132 bp, Oryza sativa
ctttttaaagggattaggctttttcacgtaaaactattaggggtttttttggaaaacaaaaattttacagaactttaacatgaatcggttcgattttcatgaaaagcgttcagaattccttaattcatttcaagcgaggccttatgttttgaatgaggcataaaacgaggggcgggtatacatccccttaggcattaagtgacgaaataattttccatatatttttttagataataagaaaacatatggaaaattttccatgtatatatatgggcgtggttaagaagttcttgtattatctccatgtgaattgtgaaggctaattatattggggctttaggatttactacttctcaccagcatctctttttctttaaccttggacagacagtaaggaactcccctacggtatattaagtttccttaatataacaaagtttatttacaaagtaaacaccagcatctcttgagtgacgaaatcctaaaataacactgcaaaaatgagatattttgtggtacattaaaaaaaacaaagagctagctagctagccagatgatcaccagtacattgtactgcaatctttttgtttgaaccgtgcacattgtgcaatctacagttacaacactaagccgaaatcaagttggaacaaataataagtggacaccggaaatacttggcacatcaactttgtggagcatcatatcaaggccccctgattaattaagtgaccaattaagcatttggtgtaacctagcttgagtcacccaacacaaaacacactgggaccaaccattagctctcatgggtaggcatattggatccaattctcgattccgattgtttaattagtttgatccctttcatgtgcttttattattcattgccacgaagattgaagcttttaacacatctttgccatatatagtaaggttgtttatatatgcctgctagcttaattaattatttgccataagccatagtcagaatttaatttttagaacttgaagttgatttttttattttccagcttagacttttaaattgctaagaatagaaatataaacatattaattcttaggaaaatgattctatactcctaggattacgtactcctgttcttattctaaatttatactaggttgctttgcgtttatttttctcggattacaagccatagctaactcagtcaatgacagctcttgtacaacatgttgctagctgctcgttttcgatggtcgatttccaatggcatgaacatatataattaaggtcttctttaggcacaatgagtttaatttaacggattaagatcgcacttccaccgaccaattgagttgaattccttagaattccaacatcggcacctgcttggaatgatttggcccctagtgtgctgggcactataatatttgaaaatcataagccccaggaatctcccaacatacatgcatcacccttatctttctctccctgccaagcctttttttttctctctctttttgtcttgctttcttccaaatgattattatttctccttgtgatgatgatgagccgacagtgctcaattgagctgttccgttacatgcccggaaaaagagctgttggttatatggactgagttcctcttacttaagttatgtgattttagaatcattaacatgtggtgtccatagtaaagaaagactacatgttagtgattcaaagtcaggatgtaaatccgttgttcatgtgtattggatatgccttcaagtaaaaggtagaacaaggaacgggatatgtatgtttcagtttctaaaagaatacgagtgatgaggaataacaggttattaaaatagttgcacaattaattaatattattgtctactacctcctttcttaaacagatatcattctaaattgctgtagtcaaagctataaaccttaaatgattaattaataaaaaatatgaagatttgacatgagaaaatgatatggtatatttgatcatcaaaagcaatttcatataattatatttttaatagcttttagaaacatgtagttaaaaagtagtgataaaatatatatgtgtgttggtactgggttgatttttaaaatgacaagtaaaaaagaatgcaagaagtaatagataaac

SEQ ID NO: 56761 - DNA, 8047 bp, Oryza sativa
aaatattcatgatctgattacaaacgtgtaactgtgaaatgcatgttagacaaactacataaagagggaaacgctggaatcccaggatggacaatgactaaagcacatgaaggacaaaaaacaacagaacaagggtggtcatctaccattccaccaagccctgaagttgtggctttcggtcatacaacagatactaacagagatctcaggagatgctagcttggtagaagagatctttggggcttagactagagatcctgggggccacctgacaagatgctcttcagtaggagagtgggatggctagcctcatccttgtcctcttccatccgacaagtaggaggttttcatgcttcatggatcccctctgatcaacttggttttcagtgatgcccacacagtgacccttcaatgaccaaaaattcgtcgttacatggatgaagttcaattggggtggcatctctgttgatacgttggaatttcacattccatgacctgtaccatgggcaagtcattttctcaatgttataccagcacacgatagattgaaacagttaacgaatccgtacctccagtcagcaccgagtgacacttaattttggttacatggcctctctgcaactactaatgacattcatgttactttcttgattgctttgttgctccatccaccgacgagccacggatggctgatggtgatggctcaccttaatgccatctgcctatctgcctcattgatggatctaagaatgagagaacaaagcattcttcagaaagcatgacaggactcctaaactctgcttactgacagtgccatagtggacatatattcgactctgagtgagaataaaatgacaagacacaaagtgacacacctagcattatttcatcattcttttgattgcaagaacacataaatgaaattttgttgtctgtacacattataatagccaaacaagaatatggagcttatttatgacaagatatgacaggatcttagatattgagttgtgagtttagatatagacaatgaaccaactgagcttttgtatagtaatgttgatggtatttataaaacaagtcttcatcaccaagaaattgtagcaatcctaccaagcaacaatcatgaaactcagatgaaacaagaacaaatctatttgacatacacctagagtaagcaaaatagtattcttggatctccaaaacagtgagtgcacggcttcacggttgcacaaattccatgatttatggtttaaagaatgaccaagccacattaagtgctttgaacaaaacaagccatttcacacatatgttttgttgattgggcaagagcaaataagtacttgtctgtatccagggcccacctgctttggatattttaaatatcctcctaaacatgtactttaaatatattgatataagcatgcaaacagggatgaaaaacgcaacaaccaagttccaatagtggagaaaccaacaaaacttagcaaaattcaaaagatataacaactacatggttatcttttaaacaaaacactacaatgactgaatggtcagactccagttacctaagaaatattcaccattgcagattcagctaaaaagatcaccaaatgacatgcgctcagtccgggcactgccaaaagaggagaaacagaattttaaatatagtcttgagctcttaaaattctagattcaaatattcttataaagtgatttaatataaaagagttgatttaatcttactctttggcacaacatatggatcctgtgattccctgggccaatattgtcctcaattgtcgattatcgagacacaaggagtcaagggcatagtgcctataaaacctgtacaacaccaaacatcaaccaaaaggtaaagtatgaattagttattcaatgtaatgtacactataagtaaaagtgataacacagtcgcactcacatgctcaaggtattaaataccagttttaacagcaagtgcatttaatatgggtagatagacaagctcactatttttctgcagagctctgcctagcacacaatatatttgagtatctgggtaaataccaacagatagcataatcgggacaaacataaaggcttctttggcaaattgtcttttgcaaagtcgattgattgctgcactgaaatcttcaatagaagcttcaaatcctgcatctagaagcttaccaactaacaaaacagcattgataggcattccttttgcgcactgagctttgataagtgttgtgtacgcaaattttctcaacttaatgccattttctctgagggactccaaaagtatttctgcttgaataacttttcccttcaaacacagcacattaataagcaagttataagtaacaggtgtcggcacaaggccacggcataacatgatgtcatgtatgtggaaagccatctgaacgttttctgattcacagaaaccttgtataagggtattgtaagttatcgggtcagcattaatacctttgctatccatatctttgaaacattgatagcctcatcaaatctgagctgcttacaaagccctttaacaatgacactgtaagttactgcatttgccttgatcctctttgcaaccatttcatcaaaaagacttagcatggtattaacttctccagcttcagagagtgcatccatcaaggtagtgtatgtcactgctgttggtagaagtccacttagctgaatagccctaaaatagctctcggcaagttgcagatccccaattttacaatacccatatagaagagaattgcatgtgacaatggttgggtgcataccagctacagtgatctgatcatacaaacgaacagcatttacaatatcaccaagttttgcataaccatcaataacgacattatagaacactacatcagttggctgatattttctagctacattttccaaataccaccttgcttcaactaacaatcctttcttgcaaagtcctagaagaatagaaaaatggttcagtgatgttggcattaccctctgagaactgcacattgcattacatacttgaagagccttttcaatttcccctagcttgcaatacccatggataaggatggaatatgcgataacatccatatccaaaccaatattgtagatctcgccgagtaggttgtcaatttcgcagaacatgccttttttgaagagagcattgagaaggacactatatgtgacaatattcaactgcaaaccttggtctaggacatccttccttaccttcattccttcttcaacatcaccactttcgcagtgaccagcaataagtatagtatatgtaacaagatcaggttcaacaccttggcctctcatcatctggatgattttaggaatttcttttgttaaaccaagcaatcggtacccattgataaggctattgtaggtcacaatctcaagttccattccttcttttgtcactctctcgaaaagatccaatgcttcctccattgaacctactttacatagaccgtgtataagggtagaaaaggtatacctgtcagggactaatccatatttcagcatcaggcataaaaatgattttgcagactgaacaaacccccaattacacaatgcagacataagaatgttaaaggtcattcccaagggtttaaactttccctccttcctagcttcctgaaggaaagataaagcttctccaaccttatcttgcttacagaggccattaataataatactatgcgaatattcactgggagagacaccacaagactccatttcttcaaaaagctccaatgccacgtctgtcatccttaagccgtgcaataaactgtcataggtgaacaccgagatttgcatgtttaggctgctcattttactaagaacgtaaagggcatcatgaaccatctgagctctagcataactgttcgctagagcatcccatacacaaccgttggaatcacactctctgaatctgttccataagatgtcacagagagcagctgcagacccagatcctacagcaggaagcgcaataagattaaacgcgaacaatttttatgttactagtttgtcatacttgcagagaccttctagtaaaaaacgaattacagtaataatactacaccaaatacaactatgtatgcattgctttcgacccttttcttactgttttttatatggtaatgatcaattgataatgcctctggaaaaacaatatatcctgtgtcacacattcatatcgatcagaagttcaaaactaccgatgccattcctacgcctcctcacaccaatcaccatagttattcagataccacatgagtagagttgataatcagaatggggaaaattcatagcatgctcaccttgctcagtcaccagctgcgccaaggctgcccgcatcgcgcgccacctcctctcccgcagaagctcatggcagagcttgatccgcgcgacagcgcgggccttcctctcgacctcctcgtcatcggcagcccccccgccattgcagccaaccctaggcgctccccgtgcaatcccgccgatggagggaggggctcgggtgtccctgccaacagccgccgcgtcctcctcggactccgtcacctccgccgccgcggccgccgccgagggataatacgagagcggtctccacgcgggcacgggcgggcggggggaggagcggcggcgccggaggtgaggcaggaggaggaggaggagggggagcgggaggcgcggtcggaagggcatccgaggaaggggcagggtctcatggcgcggggagggtgtgcagagctccggctccttctcgagctagggccaccggcgctgcacggccgcggcggcgaagagcatctccggcggcggcggcggcggcggaggcggggtttgtgtgggcggcgcttcaagggaaggggattttaggagaggtgtgacggggaagtgggccaaatgtttgtggacttatggagtttttgggtgattctttggaggcccatattgtagggcactccagcccaaatattcgccgaaaggaatatagttagcagcacagaagtctatacgaagtcctccagtatggactcaaattttcctctctcactgcaacatcagaagctgcatttgcttgaattttgaaaatcaggtgaattttacttccttggctggtttgcacagtgattttctttttatgtggtgtctacgtggtaagccccacttatcagttagaaacgatagacccacatgtgagttacaactttagtcttcaaccccacctcccctctttctctctcgttctccttagtggcactgtctgccacacgatctccttgaagacgcttgaatctagcggtggagcgatggtgtctacttagactcatgcgatgaacctgtggacaactccgatcgcctctactgcacctcgatctcatccttaagtttgatagggaggaagatgagagccatattgtcgtgtgcctgaggaggaggagtccttgccggacacgctcacgactagatctagtctctcccactctactccctttctccggtctccttcgcgttcgctacctccgccatacaccctaagctctgttgccaccacgactctttctcaagttcggttaggatagctgtaagctaaacttgaggaaaacacaggagagatgaaggtggtgtatccgtgtatgatctcagcgccacctggaggttagctaggatgacaacagcgtgatgctattgggggagttcaatagaggcagtgagatctagaagctcaacgaagccgaagaagcgactccaacgggctaattgcatcaagagccaggcatggacatggtgcagctttggttggagcatcaagaccattgtcttgtcgctgaaggccacggttagcagaaagagagtagtagagggagaatagcgtgataaattaaggttcactagcatgtgggcactacaatttttcttagtgactttagcataggagaccatgtcagcataccacgtcagacaaaattaatgtacaatctagtcatagaggtaagttgactttagttttcaaagctaagggaggtgcagatcttggtactgtggtttgaggaagcgaattcagattgagcccctagggaaggcggtgatatagacattttctgggaggaaattagttgagtacgtactccgtactaattattataaaattaaaaattggatttatctgatatttgaaaacaacttctatatgaaaaattttccgtacaaaataaactatttaacagtgtaaaccgtttaatgatttaaaaagcatgcgattcttctggacattaacaaatgtgtctattgcccccgcgtcacccccacgctggcgaccggagaagggtgaactgaaaccctagcgccgccactccctctttccctcccctgcctcgcctccaccggagctagccgccagacaccgcgcggctaactaggatggtgacgggggggctcagtttcatcatcctcatgtgcggagaggaggggcagcggcatggagcagggccgcatcaacacgttggggacaagtggcagcgatggccacatcggcgcatcagggacaagcggcggtgacgacgcgacgaagtcaagcgacggatggcatgatggaagcacgtggagacgacggcgcccctaggggacgccaagctgctcagatctggggccatctcggcttgccctcgctagttgctacaagcagctagggcaacaggtcggcatggcgatgaaggccctcccacgcaatggcaacgcaatggggcgagggttgtgcagcgctggtggcacggttggtggcgtggcggcggcggcggcgggtgtggggttccatacccaccttggttcaaaagtgctaatgggcaactggagcgactggacacgtgtcgcgtgcagaaagggggcacagacggcgtgcgtgtggagactggagacgattttttcggttttttttctatttctatttgatttttttctggttttcttttggtttctctttctttttttttaaagatgtacgtttgcaaagtttgtattcgtatgtataccaaattttgtatttgcacgtatacaaagtttgtattcgtgattttaatatgtacatatacaaagtttgtatacacatacgtgaagtttgtatacgcatatacaaactttgcatacgtgtatacaaagtttatatatgtgtacgtacgggatgtaaggtttgtatacgcgtatacaaagtttgtatttgtacatacgtataaaaacataaaaaaatacttgtatataaattttgtaaatgtgtatataaactttatatacgtgtataaaaaattagtatacgtaggtataaaaacctaaaaaaatacacatatacaaactttatatatgtgtatacaaactttgtatacatatatacaaaattggtatacgtacgtataaaaacctaaaaatacacgtatacaaaatttgtatttgtacgtatataaagtttgcatacataagtattaaaaacagaaaaagatatggaaagaaaaaaaacagaaaaaaaacaaaacggaaggtacggaagaaaaacagaaaaaaccaaaaaaaaaagagaaaccgaaaaaaaaaacaaaaaagaaacggaaaacgcgggcgctcaagagaaaccgaaaaaaaaaacagaaaacgcgggcgctccaagcgagtgctgtccgccgcactagtagtagagaggagagactagatgggttagaactgatcgcgcggggcgcagggagcacgattgatcgcccattagggctccccaccttggttggtttcggcctgctctgtcgacgacggtcagtcgaggcgcgaggaggagtgcccgctgcggtgcttgatcgaggagaagtagcagcaaccagtggcatgcaaccttcaacagctggcgacgtgagcgagtaagcggctggtggcggtgacgctttcttctcggttgccggccgaccaatatcctttcggtggagctcctcccatcctatggctagattccgttctggctgtggggagcttt

SEQ ID NO: 56762 - DNA, 703 bp, Oryza sativa
atatatccacacattcaacttagctttcggacgttgcccactgtttgtcaagtgattggccctgcatacacatggccttgtttagctaggtatgagtaacgagaaatggaggccacacccagcagcatgcaccgacatgcatgcagagagaaaagggaagatccattgatcacaagcaaaggatgcaattgcagctagctggggcatgcagccatggggtacgtgcaaagcgagaaacaggaagcccttatactagcttagcttagggcacattctaagcagcttatggtcgaatggatatctctctctagcttaaaaaaaaaaccttttacatgagcatttacttaaattacatgactggatctgcagtggcaaggggtgcgtggattaacctgaggtcccatgtttaatatctaatacgctcacaatttcttcttaaaatatatttggagggacgtctctcactccaaatcttgtttttttacatgttttaaactatttattacctccctcttctctagtacatgacaatgttaactacgttcgtcttaccttaatttcaaattatttttaaatgattatggatgttagtaacttagtatggttatattagtttacggtacttcgcagttcgataatataaacatatatgtatatttgagtatttgtaatttttttaaaaaataaacgagcaataatcaca

SEQ ID NO: 56763 - DNA, 4348 bp, Oryza sativa
ctgcagccctttttttttcatcttactcacctatcttcccacttccccttattaatttattaaagagcgctaaaatctattcttcttaatattgctaaataaacaacttaaaaatgaaggacaatatagtatgactcttataataaagccttaaaacttatatttctagaaatgttgagtactctctccgtcttataatgtagagtactagctccctccatcccataatatagtaatatgtctcatcacattctagattgctatattataagacggatggagtaaataatccacgttaataattcaattggttggataagccggaaaagaaacgttaccttttgcaatattgctactgtagcaacgtagctctggaccatggtacatgagtgtacaagatcagacacgagatgatcttaattaatttctcctagcgtgcgtggctacagtgcgtaagaataattgaaatttgatcggccgacacatgcaatgcatacgtacgtacattacgtgccaagagaaatatatggatggatggatgcgaagatagccgaattggcgcgaataatccgagacgacacgacgacagtgtcacagtgcaagtgtgcactaccgacgactacagtatgcatatgccccccaatcgatcgatcgagttgacgaagtgcatgcatccgtggatgcaaaattagagcacatagaagtatatgacagcttaatttcttgttaattcgtgcatgtaagcatgtttgccggtgtactacatctagagaggtgcgagtatactcattcaatttcagaataagaacattttgtactcttcgtgtttatctcaaaataaggtttttttaatcggattttatgaaagtaggagataaatgtaatgggagtagattaagaaaaagtaataattacactgggatttgatagtggaggtatcctagttttttttattttgtattggtaaatgccagatagatgaaaagtaaatttaagagagggagtactctgtattaatttatgtgtgattacctacatatatacggaggatccataaatacgataaggtatgttcacaatgcctatgttcacatggttactgtagtttaccaaacggccatatatatacctatgtttttttaacacaaacaactttattaagcaagaatagatattaggggataaaccctagtacacgatgaaggatagtagctgaaagcaaaagagccatcacttaaaaaaagagggttaactgaactacagaaacagccttcctgatgtaaccgaacaacagaaaaaggagcaagccgacagggagctgcggcgaagctgtgacgactgctaccttgggcctcattagaagtgcactccgcttgacaaaccgttaatcctcatcggctgcctccacgggaatggcacaagactgaggttggttgatgtgccgtagattttggtgtgtgcgtcaccggactcaacaaagaatccccacgggattcgtcattgaatctagggaactctaacatcaaccctgtcaaccaaaattgcgcagggggtccgagctcaactcgaatgacaaactatgcgcggtttctgctgctaggaaacaaaagagagagccaaattatagaccaaccaaccttcaacattgggggcattgagatgacttctgtcttgctgtgaggacaagatggctaagaagaaggacttgcaacttggaaccacaggattctggccaaagcaaacacccaatcacaaatatcccaaagacttcggcctagaggagattgtcgtcgtcgagctagccaggactgcttccaacaagaccccaaccaacagaggcagatgctgcaccaggagcagcgcaagccagggcgcagcaaacagcgggagcacgatgaagggcgacgacaaccgcagcaacgccgagcacagcgcacacgccgccaccacagccagcatgagcccgctcgcatgcaaggcaccaccgacgaccgccgccgaaaccgcctctaccaccaccaaggcaactcagatctggaatcttcaccacccttcgggaccattgcgggaggatgtttccaccaccagagctgcgattcgccatcctagaagcacaaagccactagctccaaccaccaccgtcatcaagggcccctacaccggccgtcgccatgggaggcaacaccggcaaaccctaggacatgagactagctagaaacaggataaatctgactaaatactactaggggaagatggccatcggcaaaccactggaatcgaaggggaagaggggccagagggaagggattttgggaaggttactgtagagagaggaggggaatgagagaggggagagagatgactgccacaatatctatgttaacatggttaccgtacgtttgtttgcagttgttaacttgcagtgataagtgtaactacacctaatccaaattcgcgttgttacggaggagacagtaaggccctgttttcccaaacagaaacttttcaccctgtcacatcgaaagtttggacatatgcatggagtattaaatgtagaaaaaaaacaattacacagattgcgtgtaaattacgagatgaatcttttaagcctaattacatcatgatttgacaatgtggtgctacagtaaacatttgttaataacatattaattaggtttaataaattcgtctcgccgtttacagatagaatctataatttgttttgttattagacaacgtttaatacttcaaatgtgtatctgtatatccgatgtgataactaaactcagaaatttcctccatctaaacattgttagtgagttgcatattacggaggagacagtaaaaaaaaaaacaaagtgggtgtactccagtgaaaagcacctgtttgtgcggatgtgacataacttggtcgcggcaggacagcacggtaaaaaaaaaaaaacgtgaaagcagctgccgcagtggcgctgccactgcacgcgttgcactgatgctgctcccacttcccttgcctctcctctcacttcaccttcacggcgttcacttcacgcgcgacgcgcctctgttaaactcctcgcctacgcgacggtccaccaccagctacacaattactgctccaccggccgggcctctcacgctgactggtggggtccacttctcctcgctcgccgagaggatccagagtcttctagaacatccctgcagcaacagacactccgtcgtcgtctgaatacatgtccagtagtattttctttttaaaaaaatcaagtgagctgtggtatacccgtactcccttcgtcccataaaaaatcaacttctaactatgtatcttgaatataaagtatattatactacctccatattttaatgtatgacgctgttgacttttttttttaacgtttgaccactcatcttattaaaaaaatcatgtaattttcatttattttattatggcttgattcgctatcaaatgttctttaagcatgacataaatattttcatatttgcactaaaattttaaataaaacgaatggtcaaacgttgatcgaaaagtcaatggtgtcataccttaaaatacggagggagttatatatagtagtacaatattttttaggaacagagagagcactactatttgaaaacacagatttatgcctgttcagattgtggagaaaataaaccttgccaaaattttggcaagatggcaatattgctaaaattttggcatgatttcttatgtatcaaatttgacaataaattaaacgtatatttttttaactttatcaaaaatatggtatggttgaaaatgacatcaatctgaacaacccctatgtaaacggtgttgcggcacaataaacggagcaatgtgagtaaacacttcggcacatggtactttcttcgtttttaaatacatgggcccggtttagatcccacttcaaaattttttaccccgtcacatcgatcgaacgtttgaacacctgcataaattattaaatataggctaaaaaataattaattgcacagattacaactaatttgtgagacgaatcttttaaccctactccatgatttgacaatgtggtgctacagtaaacatttgttaatgatggattaattaggcttaataaattcatctcgtggtttactgatgaattatgtaattagtttttttaagtgctcgaacacctcatgcgacaccctaaataatacttgatgtgacacaccaaaactttacatccttggatctaaacacccccatgacaatggccttgtttggatcctagggggtattaaatagccctccgaaatctattaaacgtagattactaacaaactgattccataa

SEQ ID NO: 56764 - DNA, 11962 bp, Oryza sativa
  unsure (1)..(11962): unsure at all n locations
tacaagagtctgaaaactaatatatctgatttcaatgaggttatatagaaagacttggtactttcattacgaaccttgccacgagtgtcatgcacgtccctagtgtctcttaagtccaaaaaatgtaccagctcactaattattaaactggaccattcgatcactgtgtgaaataagtccagatagtctatttaacctacctgtaaacacataatttattgttcttttttttatcaaagtggattaatttgttacgcacagaaaataaaaacgtgcttcggaaaaatgctatttcacgcacacatgctagcaaacataagcgcgcaatcatgcaccttatattctctatccgtcaagtgtatcatttcctacttttcgatcgctcctcttgatttcttccaactcgagcgttcgattccccacatacatcctcccaaccttggcacaccctagcaagacacggtaaacctgtcgctcctctcctagcaagataccgatgaactcacgatcctcttttccttccttccacgatcctcttctccctcctctctggtggcgggggtgtgatgctccctgtagccgtcttcctcctctatggcaagacgtcggcgagctatgatccccttcttccttcggtgtgccgctcctcctatccgttgtcctcttccatggcaagatgttgatgggcttgggatccccttctttttccttcgactatatctatttttaattgaaaactttgaaataaaaataattataacttaacagtttcaggggttttgggtatgatgttttgagatattagttaaaagtttcatatattgaatcgagaatcttaagattttagttgaaagtttctaatttcaaatccagagtttaacaagttgagatacgcaaccaacaaaacccaactcaatactatttaatattcaagctatatatatatttatgtgcaagtacaattcggatactccatttaagacatggtacatctcgttttcactttttttttaaaaatgaattgtttcacgtgtagcactccgtatttatttacaacgaaaataaattgaattgttgagatttctgtcaagtgggtaaaggagccgcaggtccgcagcaaaccagtagcaatcccccagctaaccccccgccgtcaggaaaataatttcgctcctgctgcacgatagtgacgacgctgtacgtacggcgaccactgcctcgtggccccccccaacacgcaagcacacggtgtacatccatgtgggccccagggtccatagaccgagcccacgtagaccacccaccctagttttaccgcacattttttcccagctcattcatcagattattttctttattttttaaaaatatatttaaaaaccctttctatattatagtattctcacatttgaaataaacaaatagaactggatgtgacatacttcacccgtttcataatgtaagactttctagcattgcccacattcatatatatgttaatgaatttagtcacacatatatataaatgtgggcaatgctagaaaatcttataacctgaaacagtggtagtatattagtataagtagtagtttttatttattttaagatggtaatccatccgtactacgatataagaaattttacttagatggaattatgatgctacgaatatccttagtattagaatgtgtccaattaaaccaaaacttcttatatcttgtggaacggaaggagcactagattaattgttttaaattgtttattaattttatttcttaaaaaatcaagtgatttttatagttattgagataatctgcgatgataataatcttatcaaacgttaggcagcgctcgctagctttcgccaactcctcctcctcatcacgtcgctacacaggctagtgtagctcgcagcgtgtacgagctgagctgagctagccccctgccactctctctctctcgctgacgctccctggcctttaaagctgtcgccttttgcctccccctgctactgctgctcctcctcctcctcctctctctctctctctctctctcccgtgctgtgattgctgcctcggggtgggcggtgcgagctacatacagcacaccggcggcggcggcggcggcggcgaggctccgggagaggtccagctaggcgtggtgggtggtggtttcttgatttcttgtgtttgggctgtgtcggcggcgggtgatggcggcggcggctccgtgcgccggagcgcggggcggctaggggcggctgtttctctgaggcgtctctcccccggcggcggcggtggaggtatgttgtgagcttctcttctgctgctgttcgtcgcttttggggttttccggggatggttctccgctgttcatatcctccttgccattacggtttttctaacaattttttttcatgattttttgagcctttggttcatccaaagcttcaaaccccgattcttggtagattattaattttactcgatttaaaaaccgtgctcttcgcctccaatttcgcgactcccgcggcggcggcgtctcatcgccggcatttcgcgtgctttgctctgcagaatcggcgcgtcctttgcgtgcttttccacgccttgttgttcaagggagaggagaggagaggaagaggcaagcttgcgcaatcgcacaaccgcctgtcgatttctctctttcttttctctctttctttctctttctttttttcatttccccctttcacatgtcaggttatttttttttctcctcgtctcctgacgatttcgcttttgctcgaaatctcccaggtttgttgttgttgtgttgaaggcggagaagaggggaggctttggtggtggtggaggaggaggatggcggcggcggtggcgatgcggagcggcagcggcagcgacggcggcggcggcgggtacgacaaggccgggatggactccggcaagtacgtgcggtacacgccggagcaggtggaggcgctggagagggtgtacgccgagtgccccaagcccagctcctcccgccgccagcagctgctccgcgactgtcccatcctcgccaacatcgagcccaagcagatcaaggtctggttccagaacagaaggtgagcctaatcatgcacacatatactatcatactagtttgccctttttttttgtgtgtctggatgtgaaatgttatgatcttatggataaattggttgagaatggagcaatagcaatggtagtgttcaattgtttgcctttgttggtattgtgaggatacaggaagaaagttacttgttgtggggttcttgaatgtgtttgctttgcaggtgccgagataagcagcggaaggaggcatcaaggcttcaggccgtgaaccgaaaattgacggcgatgaataagcttctcatggaggagaatgagcgtcttcagaagcaggtctcccagctggtccatgagaacgcgtacatgaagcagcaacttcagaatgtatgtcttcgtgttgttgagctcacatcgtgcttcgggtggtaaaggcgctgccctttctttgttttctcgcctgctcatatcatctctgttcattgtttgcagccgtcattgggcaatgatacaagctgtgaatcaaatgtgaccactcctcagaaccctctgagagatgcaagtaacccgtctgggttagtgaaatttcctttgaatgttttggttttgggcaattggaagcggctgccctctagggattggtttgccattttcttgataaactagttatatgatttttgtccagactccttacaattgcggaggagaccctgacagagttcctctccaaggctacagggactgctgttgattgggtgccaatgcctgggatgaaggttgattgccaacttctcagattcactctgcctgcatcaaatgacgtgtgcattcgaatgttctaatttgtgttcccttttctttgataagcctggtccggattcgtttggtattgtggccgtttcacatggttgccgtggtgttgctgcccgtgcctgtggtttggtgaatctagaaccaacaaaggtaatagcattcatcagtacttcatttatttatttatttttaattcttaattctacaacaatgcctgctgtttgcttccaagaaaaagaattcctaaaccagcttcatctgcaagtaactatgctgttttcatgctgacatactttcgatcaaagaaaagtcctttaaagtacccgtcacaagcacaactagctgtgctgtgcatacatgaactcttttttacttgaggggcagactcctttactagaatgaagagttgccaagttttcggtctcacgccatccacaaaaagagaagttctcgctctctctggcttaacagctaaggtgttccacatccaaagattcattgcaaaatcttctcttcatgcattttgttccatgttggacataattcttcatacgtatttggttgatgtgaatattttctagaaagctgaaagactttattgttttcagaaaattgttgggagattcttatagtgtgctatgcagatcgtggagatcttaaaagaccgcccatcttggttccgtgattgtcgaagtcttgaagtcttcacaatgtttccagctggaaatggtggcacgatcgaacttgtttacatgcaggtgagcgttacatcctaacttttttcttgaattaagtatcccatcattaatttttgccacatgcattccctttttatttatcattcttggctttttcgctcagatgtatgctcctactactttggttcctgcacgagatttttggacacttagatacacaactacaatggaggatggcagccttgtggtgcgttgagcttgagcatcttcattttattttagtttgcctacattgtaaattagcacaggtgtcctaagtccatgtatcttgcaggtctgtgagagatcattgagtggttctggaggtggtccaagtacagcctccgcacagcaatttgtaagagctgagatgcttcctagcggctatctagtgcgcccatgcgagggtggtggctccatcgtgcatattgtggaccatctggatcttgaggtgtgatcttcaagttctgcattctttctagttagatgtgctctgcatttgagtcattatttcttttattaatttacttagattctattttacaggcttggagtgttccagaagtgcttcggccactctacgagtcatctagggtagttgctcagaaaatgactactgcagtaagttcctataacatttcctgatctgcttttatcttgacaattcaatgatattctctcttgttacatacatatatatgaagaaatgcccactgtttccttatgattggtcatttcctcaagacctacaattgcatggtgcaatcccaatgttaagtacccactgtttgtagttagattagacggttcatacattgttcagtccccatagtaagtattacaacgcctacacctgagaagtgttgacatatcactaaattctttgtttcctgaaagtctaatagttttggagagttaaggttggggtagtgcttgagcctgtaatgtcaatttcatcatttttttttctagaggctacttagccttattcaaataagtatactgaagtgctttaagttttctttcatatatattctaatcatagcccatctttgcatctttggactactgaaatgatattaattttcttcgtcatataatgattactcttactataaaggcactacggcacatcagacaaattgctcaagagacaagcggggaggttgtatacgctttggggaggcaacctgctgttttgcggacatttagtcagaggttgagtaggtatgtccaggatataaacttctttcgcttctactgtttatattggatgttttttattctaacacattactatgcccatttagaggcttcaatgatgctataagtggtttcaatgatgatggttggtctgtcatgggtggggatggcattgaagatgtgatcattgcttgcaatgcaaagaaggttaggaatactagcacttcggccaatgcttttgtaactccaggaggtgttatatgtgctaaggcatccatgctactgcaggtgagtgttaaatataaatttgtttctatcgatgcaggctgcttagttttcagtgcctaagatgtgaattcacttacgttttgttttttattcttaactgtaacatttcaagagcttacttttttttttaatttgcatcctagagtgtcccacctgcagttttggttcgatttttgagggaacatcgttctgaatgggcggattataacttcgatgcatattcagcttcatctctgaagacaagctcatgttcacttcctgggttgcggcctatgagattttctgggagccagatcattatgccacttgctcacacggtggagaatgaggaggtatgctgacagatctttaacatttcataacttgctaggtgctgttccgtgactattttcattattaggttttttttatttatatatagtatctttgaatatgttcttatttatctagtttattgtcatttttccaattgatgatagaggatttctatgtagccttccattgttattattatgtccctttagtagttggtctttgtgctactttccttgtctagtagtgtgggggatccatttgtctgttgttcacaaagtgagctttataaaagtctatatcatttggacaaaaacaactgacaatttgcatttatacaagataagatttatcacttttcatgctactttgttgatgagttttatcaacatacagattttagaagttgtccgtcttgaaggacaagcacttacacatgatgatggtcttatgtctagagatattcacctgcttcaggtaataattctcttctttcggcgctatctggttttcaaaagagcactattaccaatcgcagtaaaaaagagcaaattattctaataattaagtcccgttgcaaggaattcctaatgtacctcccatcttgcctgatctttcagctttgcactggaatagatgagaaatcaatgggatcctgcttccagcttgtctctgcaccaatcgatgagcttttccctgatgatgctccgttaatatcttcaggctttcgtgttataccgctggacatgaaaacagtgagtttttctcatgttagcctttctttttaagtgcattagttctgtgttgtatggataattcttgaaatttttctgttctttttaactcccatgtagtgcataccatttttggtagcttatgggttaaaagccttctaacttctgtaggatggagatccattagacctgaacatcttgtttctaccttgttacttctatctggtttgattttcagcagctaggattttaaccatcaatgtcttccacaggatggtacacctgctggtagaacattagatttggcatctagccttgaagttggttcaactgcacagcccacaggggatgcatctatggatgactgtaatctacgatcagtgctgacaattgcctttcagttcccttatgaaatgcatctccaagacagcgttgcaactatggcccggcaatatgtccgcagtattgtttcctctgttcagagagtatcaatggctatttctccttctcggtctggcttgaatgctgggcagaagataatttcaggcttccctgaagccccaacgctagctcgttggatttgccaaagctaccagtaagtacatgtttatttcctatatatcttatgaatgccttttggtattaatagataggagctgcattattgctctatacggctataccactacctgtccaaaattaaaaatataggactattaccaaatattaacttgtattcaagctgataaggatttgtggtgtttgcaggttccatttgggggtggagttacttaggcaggcagatgatgctggggaagcactattgaaaatgctatgggattacgaagacgctattttgtgctgttctttcaaggtactataatttttcccttgttcttttcataatttccaacttgtacattttatgtcgttacatttaagtgagaataagctttgcctttgtatggctcatatatttggcactatatattctttcaggaaaagcctgtgtttacttttgccaacgagatgggactaaacatgctagaaacatctctcgtcgctctccaagatctctcactggacaagatatttgatgaagccggtaggaaggccctatacaacgagatcccgaaattgatggaacaggtagagagccacttgcaaaatccccattttcttttccccatgtaataacagcaatgtcctaaccgctaaacacaaaccaagtagagatgcaagaactcaccgtagccacagagtaatctttcgatttcgattcaatctgttcttgttcagggttacgtgtacctgcctggtggagtgtgcttgtccgggatggggcgccatgtttctttcgagcaagctgtagcatggaaggtgctcggagaagacaacaatgtgcactgcctcgccttctgcttcgtcaactggtccttcgtgtgacccaaaatccaatccaccatgctcgcagtcatcgtcgttgtcgtcagatctccattttttgcaatctctgtagaagagaggacaccaaaccaaccacaaacctgtcagctgttagctaatgattctactagcttttctagatctttgaaggcaaaatgctgccggtgcctgtaaagagtgtgtgcgtgcgtgtgtaaatttgggcgcgttttgcactaatttgatctggggtaaggaggcgctggctgctgctgtgctgtagtttggtaaaagttgagtacactaaccttggatggtctcgaactgtatgatgaaattcctagcagtaaaatttcaacttggatccgtgaagatgagcatgtttcttctcccgatggctctcgtatctcgttgccgcaatgggggaggtgatgtttgggttggatgtttcgtcgcggggaaggattggatcaccggcgagtcgccgtcggcggccggtggtggtggtggtagactggttgccctgccctaggcgagagcggctcggatccgcctctcgcagcggcggaggcgggcgccggtccgcggctctgtggctgagcagagcagcgccgtggcggcgcggccagcttttggcggcggcggcggcggcgcaaccgccgccatggatggtgtggggtggagagagaggcagcgaaggcccacacgcttttcggcccacggatcggtagccgtgggcccgcaaccgatgtgctcagcccaagtagctgctaggagtaacaaaacctttcaagcacaggaatccatctcccaacaacaatttcatgaggccaggaaaagacgccttagcaggatttacaaattacaatttgagataatccaagaaataccattgacaagtactcaattcaaagaaatgtcatcgacgagtatgagttccatgaaataccatcgtacaagcgacattgtcctaaaaatataatcgccgttagggttcttgaaaacaggttggtttttgaaaaaaaatagaagtggctatacaacattagatagttcttttatagaaaactttcaaatataattgcattgttcttcttgttctttatactagtaacccgcctacccagttaaacctaatccatctacctagccagaccctaatttggagggtgatcacgaacgcatttcgtgaaattcaaatctaaagcagtaaattcgattgaaagtcgatcgaaactggtccaaaattccccagttttcgacatctcgctgaacccggagcctcaggctacgtctacgagaaacgtgttcgtagagaccctttacaacatttaatttcctgttgactgttaatcttaaagctccttcaaacctgagaattttctctagctaagatcctgtttagatttcaacttttttcttcaaacttttaacttttttgtcacatcgaacttacctacacacaaactttcaaattttccatcacatagtttcaatttcttcaaacttctaattttgacgtggaactaaacacaatctaaattccaaagaatccctatgttacaaaagaaagtttgtgatgcacatacatgcctatctcctcctcggatcaggcatctctaccttcaaactacgtgtgcctttgtcactgaaatatgggaccaataaaccatggtcgcacatgtcagtgataaaggtacgatgttttgaaggcagaggatctcaatcccactgtcggtgatatgggcccgggggtatcaggtttagagggaggaggctgccccccgatgccacgtggccctcccccgaggggagtcaggcccgaggtggggtggcggcaactccttccctaaagaatagtcagaagaggttgcccccaatgccacgtggccctcccctgaggggagtcaggcccgaggtagggcggaggccactccttcccaaagactggatggaggaggctgccctccaatgccacgtggccctcctccgaggggggtcgggcccgaggtagggcggcggccactccctggccgagactagagggagaaggccgccccaggcgccacgtggctccccctgaggggggatcgggcccgaggtcgtgcggcggccgccccctcccgtgactaggggtcgggctcccccgaccccttctctaggtcaccacgtacggtgggttaggtatccgcctccaggtgcccacctacccgcacttatggcgtcccgagcggtcgcgccacgccgcatttaatgcggtgtgcagtgcactcaaccggtctatgaccagtcgaatgactgatgggacccaagatgtcaggcgcaccatcgcgtgtgtcacgcgacgtgcagcccgacatatcccatcaaataatgatgatgaaaggttctcatcctcttatcccagccggagtcggtcctcccgctctggtcaaagtaaggctcccgtttcccggtgtaataggagcccagaagtcttcacccattaaatggtgactgacaggggcaccccccgtgtcaggcggcaagatttgataggccccatcatcaagacgacgtgtgcttggcttcccaagtcaagagacaagacatgcatttaatgcaaagattataatacttctccaccggagctaggttaggttgttgggcccatgtggtaaccccttgaggtataaaaggagattcaggcctagtggtggaggggggggggacttccgagcaaactggcgcttgggtctcgcaaccccaagcactggtgttctacattcaatcaatcatgcacaggagtagggtattacgcttcatcgcggcctgaacctgtataaatctcttttgtctcatcgtcttggaggggcctaacaccctcaagatcacacagctccgctcatcaagccatcgaatctcacccgctgcccccggccgaactcacaaaggggggcctcacggttccctggtggaggagttcattctccgacatctgacgcgccaggtagggggcgcgttcgtgatctttgaggttctttcgagcgccggcgtagtgagtgtcgcgccgccgctacgggggaaagcgtagcatcctcaggagtgttgcgccaccccaggcagggggcaaggcccctcacatccccaccaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56765 - DNA, 1616 bp, Oryza sativa
aaagaaggatctagaactattctggataccaaaaattgcctctatttttggtactaaagtttaaactagtgtgaatcacgctagctactaattgagttcgttagtaatttattatgtttctgttggttagcaatcttccattctgttctcagattcttctctttttctttttttccatttgtggcgtgcaggaagagccgattatgctcgtatgctcacatatatctcatcgcgttttaagatttagagtcccctttactatcgtgataactcctgtattttatctattttttgtaatatagtagtaaggtttgtcctcgtttctttgatttagtaaaaaatataacataattcacgtagtgtgacatatataaaccatgtgttatgtacacacacccaaaaaaaaagtgctccctccgtttctaaatatttgacaccgttgattttttagcacatgtttaaccgttcgtcttattaaaaacttttatgaaatatgtaaaactatatgtatatatataagtacatttaaccatgaatcaaatgataggaaaagaattaatagtacttaattttttttaaataagacgaatgggcaaacatattttaaaaagttaacggctttaaatattttgaaacagagggagtaataatgattctaagtccaattagcgtacgaagtgtaacatacgtatacacctaggatgtgtttagttcagcgcaaagtttgaattttagttgaaattgaagataatatgactgaaaagttgtgtgtgtatgacagattgatgtgatggaaaatgactaaagtttggatctaaacacagcctagactaacacgtactggtagttaactatagcagctgccgctatcagcagcaggaaagtcatggtaggccacggtgacgcgcgaggtggccgtgttgctgcgcacacttgcgtgcgtggttgcacttgtttaatccgcgtggttggtcgatcggctcgtccgccgcgtcatcccacgaccccgtttaaggtttccgcgtgatgcatgcacgtcggctttagctgtcaaggataacagtggtacgttgttgtctctaaaatcgcttcaattacttagttctacttttttaaaaaatgtttcttgtgttacaacggtgatgacattttaagaattattaaattatttttttttaaaaaccaaaactctgttttggaaaagaaaaggtcataacagataaaaagatacagcatcatcagttcaacactggtgtatggacatcctctgttcccctccagttatccatagtcgaccttgaccaaattataatctaagctctctctcttttgttggcagaagcacatgttcatagtaaagagtacaacaagagagcacgaagagaacagaggctgcagagcagaccaggccggctagacgagcgtccttcgagtaggcgacaactacatgctcaggaggcacaggcgataactggtggtggcccgcgcggagcgccgaagctgtcgagggaccacggggcacaagaggtcgcctcttccccttaggcagcgacaaccgtgcgttggtgtctcgaacgtacaggtcaagggaggatgccaaagatgcgaatgatgtt

SEQ ID NO: 56766 - DNA, 3333 bp, Oryza sativa
gcggggaggaggggaggatgcggatggaggggtggctgtacctgatccgatccaaccgcctcggcctgcagtactcgcggaagaggtacttcgtgctcgaggacgccgcgctccgctgcttcaaggccccgccgccgccctcctcctcctcctcctcctccaagcgcgaggtgactctctctctctctctctctcgtactctgttcttaatccgtgcatttttggtgcccccgtgagatcctactggtgttcgtcccccgttccgcgaaattttagtttcggtttttaatttcgatagcgatttcatcccccccggtgtgtgctggtaggaggtagtagtagattagatacgctccggatgctggtcgttgtctctcccgagggggagttattgtttccgttttttaacggccgggttggttgagatgaatcatgaatgcttcatgctcgcgcgcggcgcggccagtaattgcaatcgcgtggttgattcgtcacgacgcagcgctagttgcttctgcgaattcagagtaagtgacaggatggttagagtggtacgacgattccgccttagctgcctcgaaatgttgccgcgttaggtttgcttaatatccctttcacggaaaaaaagaagaatggttgctgggacagtgaggatcacctaagcagtatggaggaatggaagtggagccaaccgtagcattgaaccaaaagcaagagatggttatagtaatggcatggtgtgagaatatggcatatgtgatagcgtgcagttgggtgaagtgaactctagagtggcttccatttctgtctaatgggagcttatgaagctgtcatatttcagtaacatggtgtacaattcaagtgtgttaagctctgctttctcagctccactcgttatgccattgctgcattgctttggggttcttaccatggattccaaggaaaaccagcaagtcattttgatgtgactgcatcatgcttacagaaggaaaaaaggagggcatcttttctacttcttcttctttttgggctgtggggtgttaagtgtgcaaacttgtatatatatggggagggcgtaatgatcatacataagttgtaccaagcctctttttttttttgatacggtaccaagcctttgtttgcaacatgaaaacctctacgaattgatccaatacctttaattagtggaacaagcctttttagaaaagaaacagtgcaaagtttggctgctccactcctatcaattccgtgttcttatgaaacatggtaccatgctttttgctaacatttcccttttgggtacaggatcctgttagaagtgcaataattgattcttgtatacgtgtcacagacaatgggagagaaagtgttcatagaagtgtaagcccatatttttattactgtttttaccatctttaccaaaaagttacacagacaacatttgattatcttcctcaccattttattgacaggttttttacatattcacactctacaatgcctctaatcattatgatcaacttaaggtaaccactagtgttgactcacctaatctgaccttggagctattttttttttttgtacttagtgaaaataagattagttctcatcaaccaatgcttttcagttgggtgctcgaagttcagaggaagccgctaggtggatcaggtgtttgatggagtctgccttaaaggttggagtttttcttatttattttatttcacacaatcattatgttcaaaaaagcactaacgtgatatctgtcatgtgagcagtccccaagaaaagatgagcatattgttgcttgttcacatagaagatggcaagcttttaggtaagctgctatgcagatcaatctttattttgtcaattactcagcaatggactggagattaatgcactgtttatttattgagaaatgctcatacagttagactcccccttttcttttctttcctttttcagtttataaagtttttcctctttttgtatcttttgtcactgaaaacaatatgcaaattgtgaaggctactgtcaaatgtttggcacacatttgataaagtttccaaattatctaccattgtgctagccctcttttttgaaaggcataacctcttgttagtgctggaaacaatcagtagttatggctgtatgaaatgccatgagatcatttagtttagattgaataattgaactaaataattctactgtttttaaatgggatgcagcacatgctcgtgctttcaagtgctctagatttgcttcaataaatggagatatataagagatcaatgatgcctatatgtaattttatagatcaccttttctttttttgtaaacatataattaatcatatgattgatgctttgttctgagtttgactgctagcatctacagtcctatgctacatcctctgttgtacatatttggatagaagtttcattttcttcatcacttggattgacgtttaattataataagaaagtacccaactgtccttgttctattggctaatcggagactatatctttgcaggctaagccgccgcagtaaccgcatgcactcaataggtaactatcgtcttataatgtactccctctctaaaataaacaaaattctagaaatgttataatcaagtttttctaataatggctattaataatgtatataaatttttcagcttgatcattttaaatggtatctttagattcttttcatgaaaaatcattttcacataaaataatcaacacatgaatattgaaagtgagagtaaaagtttcttcttggaggctgtaaaatggcaaaattgagtaaatattcttaaattaagggagcaagacgaaattatagtactacttttagtgattcaattaactatctttatttcttattttaccgttctgtgcaaaactctaccagattggactgtattttcttctgtccataacgatcctatggcatctgatgttattgcgccttctccatggacaatatttggctgcaaaaatggtaagcataaaaaaaatctcctttctttacatcactggattttgcgctgaatccgacttgcatttaggattgcgtttgtttactgaggcaaaggatggtggttcagaggggaaggtaattcttgttctcagaaataatgtgttgtgtggactgtggatggattatgaaattcaccatgattttgcttttttttttctcagtattgggatgatcatccagctataatggctgttggtgttgttgatgcgaattctgaggctgtattccagactgtaatgtcccttggtcaatcaagatcagagtaagatatatcatccctctttg

SEQ ID NO: 56767 - DNA, 1660 bp, Oryza sativa
tcctgcagcccgatgatgatgatgatgcatgagatgacttcgatttggtttggttaatttcttcatcagctggccggccggtagcacgagcggcctcggcgagagagagagaagataggggttgtgtttggacaacccaccgatccggtgctggatccaacggaaaccgggccattttttacaccgatcacgatgagatctggggggagtgcacgcacgcagatgagtgcatcataaatcaccgaaaaatctctctctgagatgggagtttggttgacctcgacattggcctgccttcctgtgagctggctcccgtgcaacatttggcctttttttttcttctttgttgcaattgatctagacttcggaccagcacacgggcatgtgttgtagattgtttcgccaacctacaggttgcacggattatgattatagatactataaatattaaaattttaatattatactatatgtttactaactttgaaatcatagcttcttatagtgaaagaagagctcatatcagttacaatttggtaaccgttaatcttaatttttagaactaagttaataaaaatcattaattgaaagtccgagatagatacgatttcgtatttattgattaaggattcgagagttatcaaattagagccatgtcattttcagttacgttatttgacactcaacacgatctacggccacgataatataatcatttagaacatatgaattttatatgattttttataaggttttagtgtctagtttctagctccgaagaaggtctaagatgtcttatcatccggactactccctccgttttaaaatgtttgacaccgttgactttttggtacatgtttagccattcgtcttattcaaaaaatttaagtaattatttattctttttatgtcatttgattcattgttaaatatactctcatgtaaacatatagttttacatatttcacaattttttttaaataagacgaacggtcaaacatatgctaaaaagtcaacggtgtcaaacattttgaaacggatggagtatataataaataaatgcatgtttacttttattatggtgcttatttatactaaatattttaaagtacatatgtagaagacaaaactacatatgttgttctagtttatttatactaaatatttttaaagttatggatggtcaaattataaaagtttgaccttaaccttctttaaaacatcaattattatagaatcggagggagtactatacgggatcaaaccgcggttttgcaaaacaatgcacaaagttgccgcactcccgcatcgcaaatgaccaggaacactaatgactgctacaaattactgtaaaatcgtttgttactccgtactaagcatgtataagagcacaccgtatactaccagtagagattgatcgagatcacagtaaaataactccaactcaaatctactttcccggcacagtttacggccatactcagtgtcctgtgtccgtatacaagtatacaacagataggtgcagtgacaaattctgaggctctctttagttcccacgcaaaaatttttcaccctgtcacatcgaatatttaaacacatgtatggagtattaaatatagataaaaaaatctaattacacatattgcgtgtaaattgtgag

SEQ ID NO: 56768 - DNA, 6160 bp, Oryza sativa
aatttgcttcttgtcccaacagttgttgttggttggatccaaattcccggtaatctgtttctttcttgcgctagagatggcaccaaatgatactagtatttttgttttgttttgtttgtgagggcacaaaaatggtgattagtaggacattggtggtaaggggttttgatgaactttgggagacgattcggccggttttggtttcatcagatggtccagcttccatgagcaaaaatggactgttgcttgttgtttcggaggaggtttgatctgtaataattggagaaattcccttcttcagttgagagctgctgattccgatggcgtgttcttttttctgtcatggattactgtgggtatgttttctaagacgaactttaatactctctgttttaaattattataattttaattttattctaagtcaaatattttaccattaatttgcatacatatataatttaacctcttaagatttatggtttagatttacataccatatataattaacatgccgttaaaccgcataaatttatgcccaagaataaatacataaatttctaaaattattagtgaaagttagcaaaattttgatttagaacaaaccgtgaacgacaagtaattgagtaagtaacattccttttcagaatttctaggtttttaagtattttttaactttataatatatttaattatttcatttgtgccctagaataatcgacaaacactctatttcgtcccccaacgcatcattcataaaaactttataacattcttcatccgacacattaaaaaacaaatgcatactacaaattctaaaccatcctaggtttgtgggagtacctaactagaaacatcatttagattgcataagttcaaaacaaccacgcacgaaccaaatttcagtggagattatctagcagtctgttcgggtagcttctgtaaaaaaaaaaaaacaaaaagaaaatcaagcggacacaatataatgtgtttagttcatgcaaaaattgaaaatttgattgaaattgaaatgatgcgatgaaaatattgaaagtttgtgtgtagaaaagttttaatgtgataaaaaaattgaaagtttgaagaaagaaaaaagttaagaactaaaccaggcaatctgaattataaattcagaaacattctgtaaaaaaaaaaaaccacaaccaaaccactcggtctcatctcatcagtcgtcactgatccgcagactccgcgcccgtgcagcaccccgagcccgagccccaccgacaacagagtagaatccgacccacccactgacacgtggtccccacccaccccacctgtccccacccgtcatcatcactctcgccgcgctgtccgcttctcgcgccgccgcacccgatcccgacctgacgtgtgggcccgtctccactgcactaccagcagcagccgcagcagcgaagcgaagcgagcgacccctctctcctctaagccaagcaaaaacacaaggagaactcgccataattccaatccactgtgccctagctcgcccacctcttcctcccccgcgagagagagaggagagagaattcgatctcttctttctccctttttttctgttcggtttttgcggtgtgggagggggcgtggatttgatgtagattattagggactaccaccaccaccgtttctgttgcagttgcggaattggaggattgtgtgtttggtttcttgatctgaggaggaagaagacatgagaggtagtatcgtttgtgtttctttgtgatgatttcgattcagtttggtttgtgttttgtttttttgatttagttttggattggcaaggtttggtgggtgagcggtgatcgcatttgggggttggagatgaaggaggtgggggaggtggaggaggtgaggtgcttggacccgcagctatggcacgcgtgcgcgggcgggatggtgcagatgccggcgccgcgttcccgggtgtactacttcgcgcagggccacgccgagcacgccgacggcggaggcggggcggcggcggcggccgcggagctggggccgcgcgcgctcccgccgctcgtgctctgccgcgtcgaaggggtccagttcctggccgatcgggactccgacgaggtgtacgccaagatccgcctcgcgccggtcgcccccggggaggccgagttccgggagcccgacgagctctgcccgctcggcgccgccggcgacgcggcggagccgtcgccggagaagccgacctcgttcgccaagacgctcacgcagtccgacgccaacaacggcggcggcttctcggtgccccgctactgcgccgagaccatcttccccaagctggactacagggccgacccgccggtgcagacggtgctcgccaaggacgtccacggcgtggtctggaagttccgccacatctaccgcggcacgccgcgccggcatttgctcaccaccgggtggagcacgttcgtgaaccagaagaagctcgtcgcgggggactcgatcgtgttcctgcgcaccaggcacggggagctctgcgtcgggatacggcgggcgaagcggatggcgtgcggggggatggagtgcatgtcggggtggaacgcgccgggctatggcggcggcggcttctcggcgttcttaaaggaggaggagagtaagctgatgaagggccatggtggtggtgggtacatgaagggcaaggggaaggtgaggatggccgatgtcgtggaggccgctagcctcgcgtcgagcgggcagccgttcgaggtggcgtactacccgagggctagcaccccggattttgtcgtgaaggctgcgtcggtgcaggccgcaatgaggatccagtggtgctccgggatgaggttcaagatggcttttgagacagaggattcatcaaggattagctggtttatggggacaatatcttctgttcaggttgctgatcccaacagatggccgaattcgccgtggagacttcttcaggtttgcttgatccagtgttatttatagttgttacatttcacagaattggcgctggatgcatgccctgcattgtgttgactaatatctattgcttctcagtgttgctagaacttgctgttcatatattatcagttatgtttgaaattagctagagtggcaaactgctgttgaatgtcaatctcatcaattagtgatggtggaacctgagtgggttactagcctgatgttcacggttttcagtgaatgtgttcttgtcttcttggtcttaaactgaggtttctctactcaagttatcaacatattgattaggaatttgtacaatggtgggttcgggttccaggttcctactttatttaatgaaatcatgcaatgagtaaagccggtgggaatcccagggtattaggacttaggaggatgcaataggtaggaacagcagagtgttcttttctgataggtagtaacaaactcgttatgaaggaaaagggtttttggtccttgggagcttgcttggtgcttaaaagttggattgtctctttgctagttctacaagtggctgtattcttttttgacactcggcagttaacccttttaattccgagtgcagcatttaaattctcccatgcaactgccaaattgatatcagatgccacacctttgcatccgaccttcacctcagtccaaatgaagaattgaaaaggcatgatatattagctggacacaataaacaacagaaattgggctgttgggcccagttaaacgagcaacggtatgtttagttgcattaacctaggatgtattaaacaaatttctaagcatataatgaactgcatatttttagaaagtaattattttacctacatgaaactacactgtttgatagacccattctgaatcctgttcccttcaaattgatagtatacgctgcatcagtctcttccagtggtcaataattgagatcagggtcttcattgtcagaagtttcatttgcaatcaatcatgtatcacagggcccatatatcatctttcatgcttgacataatcatttaagagcatccattagccacacaattgaaatgtgctaaaaaatgtccttagctttgcatctttcaaaaatttcacgaggaaaaattttatcacccgacacatcgaaccactgaatgttgtatccgccatatgctcagcctacatcccaccttgtatccacgtcattgtgcccttttgctctcagccgtattgcgcccactaaacatattgtatctgctaggactgagagaggcagacccatgtaaatttgtgtatattggggggttgtagggggcaaagaaaaacctgccagaaattaattatttatggtgttttactatttttctgcccattcgcttttcattggcaaactttctcaccccagccctgcccaagagccacttgttctggcatcatggttatccgtcgccaacaccactcatctacctctgacacgaagttatagtttgaaagcgagattaaccttaaacaatatgtgtttcctgccaagtgccaaatactgcatacactttttaaaacaaatgcaataaattgggtggtaacatcatatttaatatgctattagaaggaaagctattagttgttaccggtactagtataattgtatgctagtagcagtagaacttcaagtgagggagtgagctatattgctgtccacatgtctcaataagtatctccttcactgccataaatttgtctttttcaccagtttcccctcatatgatagctggctgatattgttaatcagcacataccagacatcaacttttgaagaggagattaaaactaatggtgctggcctagctgaatatgctagttctattggcagatgtgccatatgattattagctccttcctttcctgtcaatatacattggatgtcagcttggcatgtacaataaggcaatgaagggatacatgggggatgctttgctagtattattattaagtgagatgttggaaattcatgctgcttacgcagtcatagcagatctagatagagttggcttgtgaaagtgaaacatcaacggtagttgccagttttgcctattttagttgtgctgacctcagtgtgcttttcttcattgctgcactatatccttttctaattctcatggttgcaatttgcaaaattcttacaggtgacatgggatgaaccggacctgttgcagaatgtgaaatgtgtcagcccatggcttgtggagcttgtgtcaagtattccaccaatccatttaggaccattttcgtcacctcgaaagaagttgcgggttcccccacatcctgacttcccatttgagggtcatcttctgaacccaattttccatgggaacccacttggtcctagcaacagcccactatgctgttacccggacaccgctcctgcaggcatacagggagccaggcatgctcaatttggtttaccactaacagaccaccagcttaacaagctgcaccttggtctgttacatagcggcagttttaacagacttgatgctattactccaccttcccggatatcaaagggctttgtggtcagtagtgcaccagcccatgacaatatctcttgtttgttgtcaatcagtacaccacaggtcgcagagaaatctgatgacagaaagacgacaccccatataatgctgtttggaaaggctatatttactgagcagcagataacttcaagcggatcaacagagacactctcccctggagttactggaaatagctcacctaatggcaatgcgcacaagacaggaaatgcatctgatggttctggttcatcaatttgcattggtttctcatctcaaggtcacgaggcttctgaccttggtttagaagctggtcactgcaaggtatttatggaatcggaggacgttggtcgcaccattgatttgtctgtctttgggtcatacgaagaactgtatggtcggctggctgacatgttcggaatcgagaaagaagaaatcataaaccatcttcatttccgtgacgcagctggtgtagtcaagcatccgggtgaggtaccattcaggtgaggacctcattatcatatcgttagtttttttttcccttacaatcctctaacaagtttattgcgattgccatgagatatatctaatccattctatttacgttatagtga

SEQ ID NO: 56769 - DNA, 4605 bp, Oryza sativa
tttggtctataggaaataaggactggctttccttctttgggggaaataattatgcttctgttttaagtacctcgtcataatgaagaactatgagcattattttctgataattcttatgttactgactaatatgatagtactgagtggcagtagtgcaggatttggaaaacaaataaatcctcccaagaatttcctaaatttggccaattcggatggcaattttatactgttattgttagatccactgctcgagtcaaatgtattaaaataactcaaactgaaactttagttacaacagaccaactgaaaatattaccggattagagctccaatttggcaaattctgtttattttcttttgggattgtaaattatttaagcagactccagccatgtagactggttgatgcatataaggaaactggattatttcatgctttcctaataataaaatccacaatggtcatgaagtaatattagtagctaatccatagcatcgcaggtttcttatagtagctatattagttgtctctagtgatacattgtctcaaaatctccgtctggtaattagttttctgtgatttttacagatcaaggcaaacaatacattgatgcaaatggtaggtgctgactggataaaatctgataagcgtgaagatgacctttctggccgccctggaggactagtacaggtatattttcttaaagccagtaattttccttcaacggcaaaaggaaccgagaattttaccaagagttatattgcagaaatgtgcagcacaagggggcaacaaattcttttttatcgttaacatacaggtgggattttcattagctatacataaatattggggcctcatgtgatttacaacaacatgcctttttacttatgaccctgatggatataggttcctggttcatccacatacagcttagccttgtattatatgatggataccccattggaaaaggttcctctacttgaaagatttgtaaatggagatgacgcattcagaaattcaaggttcaaactcatcccgtacatctcaaaggtacctattctgcactaccagccttcattcttgtcaagctttacttagtaaatgctgatggtttatcttcggtatatgtgccgcttcaggggtcttggatagtaaagcaaagtgtgggaaagaaagcctgtttggttggtcaagcactagagatcaattatttccgtggaagcaattatttggaggtaaaccctcagcatgacatgtatctccattagtttctcatttcattccgtcatcagaattcagatgcttggtgtggcaatgccatacttactggcttcaataagcagtttatccaaagcattatgtctcacttacaaatagcgcagaataacaatggattgaattttggctactgttgccacttacttgcgcttacggttgacttcatttaccacaatctacgactagcgttacaaagattgtctgaaataaatcgtggcgtaatgaatctgccattctgtttggtacatccagctctgaacatctttacatgcatttttcagcttggagttgatataggctcgtcaacagttgcacggggtgtggtgagccttgtgcttggctacttgaacaacctggtgattgaaatggccttcctggtacaggtaattgtggcatatctaatcaagtaattacacaacgagcttgatgtttcttttacttctcaagattcagaacagtgctgtttcttttttcctttaatgagataaaagattcagaatggatcagtaaatagtgctatgagatgagagtttcagaattgctcttttccttcttttttttttgagatgagagatcagtaaataacacagctgaacaacctcatgaaagaactccttgattccttcctactatcatgaaacaaaaccctgtttgtgtcgtgcagggcaacacgcaagaagagctcccggagttcctcctgggcacctgccgactgaactacctcgacgcgtccaaggcagtgtccatagacgagtgctgaaggcgtcatcagccaccattgaccccgccaacattctttctgaggccaattacagtagtacagcgaaccaaggaaaaaaagaggctcaagtcattcgtttcccctgccggccccggtccaaagatactccttgtattgctccacacaaaagccgaagaattctggctcattctgcctgcctgccagcactgtacattctcctcttgccgacaggtattgcgatgtaatgatgatagcaatctacgcccattctttggcatgccatcatcgagaaaaagagaaagggaagtgtatcctaacggtgacccccgtggcgttcattctgacctgggactcgtctcagcttactgtgagtagtgagattgcatcattagatccaactccaaagcaacccattaccggacacttgactactcctgttccataatatttctcctgagttcgagtgagtggtggcagccatgattataccagagggactcgtcaacaactgaaagcgaccaaagtcacagggattgatatactatgctcctaccattggtaaggaaggaacacccaggcagacgcactcacaacccaaaccctttctttttgcctagtcacttgagctagaagggagggatggaacatgagcaagtggagccggcatttccctttgttcttgagaaaagacaggacatgcaaactatgcttaaggcagggacggatagagatgatggtgtgtgtcgccgtcgcaaagcggcgagacatcgtgtggtcgagatcgctgtgcgtcgtccgtcgtctgcgtgcttggctagctaacctaaaactaaaaggcttccgtctgcccgtgcaccccgtcgccgctgtagcagccgacgtgacaggtgaaccgatctctcctgcattttttgctcacacaaattctgtaccactagtagtagtttgccgcgtcatcgcttcgaaatggagagagattagtgtggggagaagtatatttaagtggacacttgcagggttagacagaattcccatttccattgactcgaacggatcccgatgacgccgccatcgccggcggcggctgcggcggccgggctgggcggggtcggtcgcgcgatgcacgggcccgtgcctggaggccgggctcacgtgcaaaacgcaaacgcaagcgaggccttcgaagccaaaagaccctgtgaaaaaacaaaccaaccaacaaataccaggaaggtgccaagttgccgtgtctctggatcggtcgcaacgtcgccgccggtgaacacgatgaaacgaaggtttaccaaaccgttttaggtcgggacgattatcatgagaatattattgcacatgataaccacggtaaccgtacacggaaacagccgcacgctaacgaacggtcgccggccgtaggatctgccgggatcctatgcggcggcgatggagtcgtccggcgagcgaacggatgagttgtccgggatgcgtcagcggctggtggtggaccggtgtttttttaggggtaggactgtgtaggattaaggacggatgggacgggtttcgtcgcgttctttttttgattgaagcgagaaggaagaggggaccggttgtggtgcgagccggtggtacagcgagaggcaacagtttgggtactgtttgggcgtgtggggagcgtcactgcatcagcatctacttgcggccacccaccacaccggaggattttcttttatctttttttcttttggagtattatttcagaagctttcttttgataaagtttggtttgataaaaacaacatattgtgtagtaccagtagacagtagtacctaatttgtaggaagtataaatccgaaagatattttgcaatgcatccgctagaaggacgatgttgtcgcgtatgttttggagggttatagattgtgatgggttggcggcacttttttttttttttgctgtcacaaacttatcaaaagtgtttgtttttcaataaaagcggtatctaaaaaatatattgcagagtgccttttaaaaaatttaccgctaaaatctcaccttatggagttggatgtagtaaattactacgatatacaatgcactacatgatgggtagctataatgtctaaaaaggtgaaatgactactttcagttcattatagaagaagagagttgacacagtttatgagagaaattagccatcaaaactttacaattgtatagttaattaaaggcaaccaacaaaaacctactgaaaagactaggacaactgtctaatgcaactcatcaccacacaccaatgacctacaactactaagatctatcacatatcattattgtcaagctcatcgcaacaagcagtcccgacttcccatgacgacatgtagcctggacaatcaacatcgttgataaaaagatgtttatggccactcaaattcagggaagtatctaacaacatcttaatagaggacacgacataaaaacattatcaatgtttgttgggaacactggaactaggttttcatctaaaggataatatgagaagaaccaaaatgatgcctttaaagagggaacggtgtccacatgcatcga

SEQ ID NO: 56770 - DNA, 2498 bp, Oryza sativa
aataaataccaaaaggcaggagagaggcgtctaaacttagcagctaaattatgcaaattagtagtagcagtttattccttccatagagaggctgtgtttagatataaacttccaacttttccatcacatcaacctgtcatacacacataatttttcagtcacatcgtaccaatttcaacccaaacttctaactttggaaataactaaacacaaccagatataactcaaggttagaaaagcacagtcatgacagaaacagaaaggggaaaatggaaaatgaagctccttttcgtcaacttctctgagaagcccccaagttaattactccctacgtacctaaaaaaaagataaaccctggatttccgtgtccaactttgactgtccgtcttatataaaatttttttataattcgtattttcattgttgttagatgataaaacatgattaatattttaagcgttacttgtctttttaattttttttataattttttaaaataagacggacggtcaaacgttgggtatggaaaccagagtttgtctttttttttttcggagggagtacagccttacaggaaagttacaccccacagattgtacggtgatcagtgttcctgtgtgcttgcttagagtagcataagcagtgttaccactagtactactgctgctgcacgacgtgaagggcatccacggtatactccaaaagtagtccataggcaacataatatttgatttagccacctagcaacattgtgaaactagtctttaggaaagaaataacaaaagctacccataagtatatggtctgcccatagagaataaaatatattatttatctttatctcttctcttctactatttgctatccatatacattgtaaagattatatatggatcccatctctattgactaatttttgttgttgcctttacacagagagagacagagaaaggcctctctgcttgtggaggaattttgcagtaatccgatcctgaggcgagatgcggtgtcagcagccatgaaagtattactcctactgtgtttagatacaaagtttatccaaacttcagtcttttttcatcacatcaacttatcagacataattttttagtcacatcattgtcaatttcaactaaaatctaaactttccgctggaataaacacagccttcagctgagagcaagttaaatagtatagccaactactggctctaaatcatctatagtcaatttaatagtcaatttatacaatagttacttataaacatatactacataattaatatctagtcacacctatcatacaaatatgcactttagagtccgtactatagttggctacaaatctatagcccgctgttcttctttcttctcttttatctcttgaaatgtgtctatagcttgcttataagctgctattgtacctgctctgaaatgacagtttccagaggtgatgttccctaggttggttcagagattacgctaccctatgccatcgtcatccacgcagatgcagcagtacagtgtgggagtatacaggtattgtgcagaccgaaggagctgctgctttggaggaggattaattggtccaagcttgagaggattaattggcccattggaggactcgaagctgttccagtcaaaattacaaatccccagatccacgtcttaaggcattgttagaaattttgtctcgttttttttttcaatttatggtgtattctgacatctgaccacgagagacatcggttgctgctgagagtttcagctcttcaggccgagtttagtccaaattttttctttaaacttccatttttttatcacattaaaacttttctacacataaactttcaacttttccgttacatcgtttcaatttcaaccaaacttttaattttgacgtaaggttgaaatttaaattttagtacttaaattaattttaatattttttactcatagtttattgtttaacattagtttttaactcgtttagaacatttgtataaaagtttgtatctacaaattattatattttttgtcgctaataagcgtaaaggtttacattcagttctagttaaaacgatcagcctgcagtttgtgttttcggtggacgcaactatagatcatttatgatcatattttgtataaagaagtttttagaattaattttaattagtcgttaacatgtacattagacaagctattattacagatatcataaatattaacattatgttaaacatgttagttaccatttaaattgtagatgataataacaaaagaagtgtctacgtcagtcacagcttgctaattaataatttcgatttttaaattatattaataaaaaatagcccaagctaggtaagatgtcatatttataaattaaaaattttcaattaaattagagaccgtgttgttttcatttgcatgatatatttaacatgtacgattcaccgaattaattgttaggtttttctagttaacgcgtgtgctccttaa

SEQ ID NO: 56771 - DNA, 1922 bp, Oryza sativa
tagttattaatcaaaagttgcacatattttttttgggggaaaagttgtacatattaattaatataactgaatacacgcatgtcgttttatattttgaacatgggataactttgatttaggcttgatatccaaactagaagtgtcggcgaagtattaattaagagaagtatccagaattaatttattattttgaaaaactgaaaatcacctatatgtgaatagtacatatatagaaaggttgattagtcctgcagggataggtgtaatttataaaaatatagacataatgtccatactaaagtgtatgatgtagaaggatatcagttaaatattttattctatttccatattatgttagttggatagaagtataatagtttgataattgtgggcaatgagatggaatttgtattccataaattcttaaagtataagtcctgaacactatgaaatagaagaatgaaagtaaatagtttattaataatatattatctgacaagaagcataatagtttgatagttgttgctaggaggtagaacctgtccaaaagcaccacctaattatataatagattgaacataagatttgtgttcagtagattaaatgctttaagatttatttcaaaattatgctggtgattaaatgttttaagaagtctaagagcacatattgatggtcctaaagttttacataattatgtgttctgtgttgtagctgttatacttttactattccttatacaaatttataatacaattactataaaagatctataacttgtccataaaggaatttggcatgcatgtaaacgtgacacttaccttagtaaaagttagtaaaaggacagatgcatggtattcatgatttatactaaccaaaagtattagtgatagaaagtggcaccatttgaactgcagaggaaccatgaacatattatattcaaaccatcttattattttgagattataaaaggtttgacacattataatgttgttaagtttaaaaattaagaaggttattgtacctcagttgatagttctaggtttttttagccctccgatcagatagttggtagttctagttttttttttagccctccgattagatgtgagagttgtgtaaaccgaagagttttttttattgacaaagttgtgcaacatagaaatcatataataatttaatgataaaatgtaagtagatataatttggatcgtcttcttatttctacatgagagaatctcaatagttttttatcccctgcgttttttctgctaccttccggatggttcttttttaaaaaatatttgtttgactaagctaatttgactagcactgttaaccttttttcatctggaactatcctgatagctaattggtgtattatcctaatgatctaacggtccacctttcttcccactattatcctagggctattgttattcaggtgacgtggctcatccttgttggagagaggttgttgctttcacatatgtagatacataataaaattagagatcttgaggacaaatgatttaataataagttaattatatgcatgcacgttttatattatgaaacatctaaaaaaataattgtgttttatattacggaatgaagggagtaaatgatttaaatgttaaaaacaattgaggtgattggactttatgagagatgatcagagaattaatattgactacatttattgagaacaactttatgagtgtaggattatgcccgttaataagctttatctcacttatagcagctttaaataatatatgtaatatgctggtgtactagcatcggcaggtttaagagatcacgtatccggatcaaccatgagctttggatacactcgacatgtccgggagcgctagagagcaaggaaaatacatgtcaagacatatagattcaggcctctc

SEQ ID NO: 56772 - DNA, 4374 bp, Oryza sativa
ttgatagtcatatttcatcttggcacaatgaccaagtataagtaattctacttatcatccatttaaacatgttactagttattcctcgtaaacaagcgattcattaatatttacatttctcaatgtccatgtagtcaatcttgtgtggaagaatggagagtcacgcattaaatctgagaaagtcattaagaagatagatggttggattgaaatatgcctatcaaaagtaattttttttaaatttggaaatatacctatcaaaagtagatgtagggagtataaatttgtaccccgcttttttctctctcttctcttttcttctcaatatgtggttatagctggcttatagcctgctattgtacctactctaatggaatctggagttaatgtgatgtatagactctgcagccggctcatcagtccttagggtgatgcagaatccaagcagatacgcctccattacagcaagtttaatagtatagccaaatgttagctccaagtcatctatagctaatctaatagcccattcatacaacagttacctataaaaatatactacaccattaatacctggttccacctctcatacacacaaaatatcttagattttgtattgcaggtggttataaatctgtagcccgctttcttctttctcttcccttttcttctcgatgcatggttatagctagcttatagcctgctattatacttcctctcagtcctcgatacgtgagaacaccacctatcccttcttgagtcggtgaggggttctctcatgtgacattctgattgtgagatccgatccatcaccggctgtattcacacagcctcaagcaacacatacatataaacaacaaagaaactttatattcaagtacaagttcgcaccaaacttaattcatattaacacacaacaatatcgcatacttacagaaactatctagaagttataaaaataaagtaatttagaaaatccacaaaaactgtttgaaaccgactcacacttggagcttattagtctgaccgccgagctatccggttagaccacaccaacacctttgatctgaatgacagcatctgctcggtctcataagcctaacaaaaccgataacactattcaccacctgtgtaggatcgaatcacaagaactaagccaatcagaggggggtgaatggttggtatacccaaaaaccgaaaacttttagcggaaataaaagttaccctcgaaatcgacggaagtcggtctgaccgagattgatctgccggtctgaccgagtggatgccgccggtctgaccggtgttgaatctccggtctgatcgccgaagtcgcctgccgcacctgtcgccgccgccggtctgaccgcctcgctcccgccggtctgaccgccgcaatgccgccggtctgaccaccggtgagttgccggttagaccgctgaaacccggtgaaacacaaataaaagaattcttaaagtggatgtcgactttattacttctctctatgtttacaaagtgcaacaacagcactccttacaaaaatttcgactaaactctaaaccctaaaccaaaactcaactctattgctctctaaagcgatacagaagcctcacgctccctttctatttataccacaaaaacccctactcaaagtaggtgtagaactcctatacacaataggactccatccttcagtttccatacgttttacaatttccaaacgtgcagcaaacaaccggccgcaccagaaatccaaaacggattcgctcccaagctgacgtccacgcgtgaccgtctccgactcgctgccagctgggcccttgcttctcctgggccgacttggcatgccgccaacagccaccgaaacccaccgagccgctctcctgctgctcggccaaccagtcatgcacacatacatgcttcaccatgcatgtatcgatcacacatacatgtacagcaccgtacatgcatgcatacctgcacgctacagtacctcgtgtactgtagcaccatatactactccaactttacaattcccttcgcgaacaccggcacttgcacgcacacctcgtgaagcccgttgcaaagatctctcccacacgatttccatccaccgtatgccatcttgtatccaactttgttacccggtatccttgaccgtctggacctcaactcctccctgagtctagtcccgattcccaccgttgaccgaagttgacctccaagaatccagactctagtcaccttctcacatggtatcccgaccgcaatagacctctgcttctccctgagcatagtcccggtcctcaccattgatcaaggctgacctcaagtcacctgcacacaattagacaaaacaaccgtttctgagcacagatatcacaacctgacccacattagtcacacgcactcacaccaacattcacacaaactctcaaaccaattatttgattaaatcatttgtatagccaattgttcatcacaaatattaatcatgacaatgatttcacaacctggaaacaccttgatttcacatctggacccaaaacaacttgaatcatgtgtcgaagagctaaagatgcataaccattttctcaaaaaaaaaacaagaaaaacgtatagccataatcttttacggcaaaattttgcaattcttttcgttttgatccctagcggatcctttgaattaacaaaagtgtatgtatgcgccatggtacagattagtactggcgctgcacgtgttgcatgacgcgatcgagagaggaggcagccagcaagcctccctcagatcattattaatccatggactcctccatgaccaaaaattggcccgcactcgtacgtatcgttcttactgcggtacattcgtgacacaacccacggaggctagctgcagctggctgctggcatatcatagtaactctctccgtcccagaatataaacaattttagctataaatctagataattatgtgtccagatttatagctaagggcccctttgaatcaaaggatttatgtaggaatttcataggattcaaatcctataaaaaattttcctttttggccctttgattcaaaggattgaagctttctaaattctataaaatttctatggaatgacacattgcatatggattttggaggaaatttagcaagagctccaacctcttggaaaaattcctttgagtcattctctctcgttcgattcctgcggttttcctgcgctccaatgaaacgactttttctgtgtttttcatgtgttttgcaatcctctgttttaccctttaatttactgtcagaatcctgtgtttttcctattcctccgtttttggccctaaaatttgttacattttgggagggacgctagtacgcatctacagatatatccaccacgcgacaaccggccggcgcatgcatgcacaccccaccccaaccccaacccggttggcttcctgcctacctgcaggcgtacgtacagacacagaccagctggggtcaaggtagtacgatacatatgcacaagtacgcgtacagtcgcgcacacgcgctcgtgcacgcacacgtacgtgccgccacgatggtaccgtgcctgcctctgccggcggccgttttcgccgggcatcatcatgcgcatcttggaaaccccggccggctgcctctgccgatgacgcctctgcagtgaaggatgcaagcgtacgtacaagtctcatggcggagctagctagcgtcgtcgtcttcccgtttatgtttatacttatcaaccaaaatttaaattttcaacattatatttagagttgattttgaggttcttgtcatcaaaatttattttttaatatttttttaataaaaaatacatatataaaagttttatttataccgtacgaataaacgaaacaatggctcctgtcgccgtcaagacaatagcagtagctgcccgacctgctcgggacgtagctccgtcgctagctagccagctcgattatcaggccaataattaacgaggcaacgaacaggcccaatgaggaaggaggccagacaaggcgaggctagtacctttgaacggagttggatggaagggagaaattttggcgagtagtgaatttgccgtcatcctaccataaactaagagtctgtttgaaggagctttagattctgagaagcaactgtttggtaaccagcttctgaaaatctggaaaagctctgaaacccagcttctctagcttctgccttcttagttcatttttcagaatatgtaactacagattctcaaaagctgtggactgtttggggcagcttctagcagaagcagcttttgggaaaagttgcagctgggacaagcttccccaaacaggacctaagattgcttgctcctttgcat

SEQ ID NO: 56773 - DNA, 9688 bp, Oryza sativa
  unsure (1)..(9688): unsure at all n locations
tattgtgtttatcatgtcactagtggcatggcaatgcaaaaggaagaaatatggggaacaaagcgaaaatggagttggagacgcaaaagtgttttcagtctggaactttgagggaggagaagcatgcaggcagatttttgaaacaacaaaatatttcaacgaaactcactgcattggaactgggggaaatggatctgtctacagagctcagttaccaacaggtgagatatttgcagtaaagaaaattcatatgatggaatatgacgagctaatatttaagcgagaaatagatgctttgacgagaattcggcatcgaaatattgtgaagctctttgggtactgttctgcagtccacggcaaatttcttgtctacgaatacatggatagaggaagcttgtcaagatatttggagaaccataacattgcgattgaattggattggatgcgaaggataagtattgtcaaagatgttgctaatgctttgtcttacatacatcatgattgctttgcacccatagtccatcgagatataacaagcaacaacattttgctcgatcaggaattcagagcttgcatatctgattttggtatagccaaagttctagatgtggaggcatcgaactgcacgaagcttgctgggaccaaaggttaccttgccccaggtaaatttgtactaaatcagttgctctgtccttttgtatattagtttgtaactctgacaaatattcgagctaactgttaaagtattcgtcttactagtatatctttgattcatagtagtatattagatacaattaggcaaatttgcatctcattttgtaaaaatagcatcgaatgccttctatactatttacatatgcaaatttgttgaaacaaagtcttaaatttttacatggcagagcttgcatacacaacaagggtgacagagaaatgcgatgtttatagcttcggagtgcttgtctttgagctgttcatggggcatcatcctggtgatttccttttgtccttctccatggccaaggaaagtacaacattgaaggatttgttggacgcccggatcccacttcctaaagctgagacagcaagtgaaatatttagagtgatcatggctgctgtccagtgcttggaccccaacccatcacgtcgtccaacaatgcaacatgtaactcggatgttttctacagctgaaggacctagcaatcctgaccatctacatgttgacataatcatccctgcgtactaccagtgaatgttgtcagaaaattgctgtttctcatgttgctcagggttttttccccacaagaatgtggcaattcacaccataggtaggtcagtctattgcacctgttaatgtcaacttgtcaagtattataaagcatcacttgtatgatgatttgtgttctctctacttcgttggtgttaattgcgtggttgtcaaacatacctgcattttgtacacgaccctaatacgtgttgctggtgatgttcttgtgcttactatgctaccttgtttgatcaatctgctttgttgtaaattgtaatacgaatctctaagatttatgatggatggtatacatggctaccattttctctgactacatggcaatgaggcttcttgttctcctattctagcaaatactgtataattgtatgtttagtatcaaagttttcagatgcatcttttgtctctgctctccttgtgttggtatgtttcagtgatgataagtagtagctgcttaaaacggtttggttttatcatttttgaaattgttcatgagataagctgagaattgcttactgtttgcctgacattcaaaacggagcctgataaattgcagaattttcaggtcatctcagttctcagagcttcagtagacttgagagaatgtgtaatatcgctttttccgcctccgtgcctcatgcggcatgtcactcttctcccatgatcacctcccattccaaccgttgtcgtcaccaccgctgtgtttggccatcactcccaccctctccacttatagtgttagaataggtgtcgaatatccttgtcttatgaagccataggactgggatatccaacatacagaagaatttctttctacaaagcaaaattaatggacaatctgaccgaacaactcatcaatgttgaaactgatgcaactcatatcatccatctcaatgaagttgatgttgcaaactgcaaaggtcatccatgctctctagaactccaaaaatccgtgagcactggcacctccatgacgcccaatgaaggagtgcttcttctggttattaggcgacgatgtcacatcttctactggagagtcgtccatcacaccggatggatgaatcggtgaactgagagatgatcaaaccacaccaattacacctctcatcaccataaactccagacaaatatcataccatgagctatacaaattctttaggaccagtaactgatttggcaagacgggtcatctgagggttcgctgcggttcatttcttataaatgtatcgattagttgtgttgataaggatcatgatgaaattgcaagtacaaatggattgagacctgatcagttctgatcctttggcatgggaaattcttccttttactctctcttttgaatgagtcgtagtgcgctcatcaagaaggggaaagatggatgggaaatgcttgtcaagctcggttctttaaagaatagcatcctcatcttcctagtaaaaagcacattgggattctctacttgtggtggtggtgagccgtgtgatgggaaaccatcccgcacagttcggagagtaccgaaggtgaatgagaggttcaccaccacccatatactggatcaaataaaaacactgggcttccatcaagccactactacatcaattgcattaggaatcgaggatcttttaacaataccctctaagggatgacaatgcaacggttatcattggtcaaaaaagaaatccaaaaggaactcgcgtttttggcacgatcgccgaggaagcagctctgatcggtgccattagagcaagtttaatagtatagacagctgtaagctgtaatctataaatagtttatacatgtcatctatagatagttttagaggtgcttcaaccccgccgccatgagcgccgtcgccccagtgtgccacacccgccgctgtgcatcgcgcagccacggagccattccaaccgtcatgcaccgcctcaattaccgcgtgccgccccagccgagagagggagggagttgcttctgccgccgtcgttgtgagagaagggtgaggaagggagctgcagccgtgcgccgccactaccgacgtgcgcagccgctaccgccgtgcgacgatttctcttccaccgtcgcgagagaagggcgaggaaggggttgggaatgcgtcgctcgcccaatgcgggagggaatcgaagggggtagagtggtggcattttcctataacttcagtgaaaaggaatgggtagtgctgtaattattttcggagtggagccgtggagctacattttcgccgctccacctcaatacaatattttggagcgatccaccccgttccgatccagtttttggcgaatctgaaccgtttggnnnnnnnnnnnnnnnnnnnnnnntgaatctaggagctggagttgtaccaaacagacccgtaatttctataatactccctccgtgccataatataagggattttgatattttgcttgcactgtttgaccactcgtcttattcaaaaaatttgtgcaaatataaaaaatgaaaagttgtgcttaaagtactttggataataaagtaagtcaaaaaaaataattctaaattttttgaataagacgaatgatcaaacagtccaagcaaaatgtcaaaatcccttatattaagagatgaagggagtagatagatctagggccctgtttctttcagcttgagattattataatccagattattgggagtaagctgaaagaaacagacaacttattgaagtagcatattataatctggagcccagcttattataatctgataagctcatttaggtgagctttttccagattattgggtgaaaaattacccaccatgccaccccactccctctttagacttgcaaaccaataatctgctctaataatctaggaaagaaacaactaaccgcttattctactatagattataacaatctagcttataataatctgactcaataatctagattataataatcccaagctgaaagaaacatggccctaatctcttgactataaaaataatttactataaagtgggtctaacctcctctctccttcctaccttttctctctcccctcctatcctgtgcgcaggctagcacggtttcaccaatcacgaagagctgagcatggaatgaggctcaccaggtgtggaggaatgtgttgtagttggcgcttattttgtggcctgcattccttctctctcttctctctttgaaagcaccaaacaatctaacatggtatttttgcatctaataaaacaattctattgtacctgctcctagagtaatcgggaaggtccaccgccgatgcaagaagaacaacgagtaatcgggaatgtatgggctcccaatctattgctaattatactagccgacaacccatgcgttgcacgggctattgctattaattttataagcattatgtttttctttgtattctgattttaattcacgctaaagccttactgttgttttttttggagtttttttattaatttagtttagaaattatgaattactaagtatcaagagagagtcttaattatatttttttcaccatttaataatttttaattcgacaacaaatcaatagcgagaatagtgagttgtgtttgatattggcatggagtcacaatccaataaaaaattcgacgataaaaatttcttattgatggctttgggcacatatttgcacgtgttatcaacatattgttcatataaattttttaatatgtgccgaccaatatgtgattccacataaaaatataattagcaatataatttgtaaatctttaagcttgtaaaagttgaaggaataatacaattaatgttaatatctacgatagtagctatgtaatattttaatgtttatgttaagtaaaagagtaaactacagacccggtctctaaacttgaatcgttgtgtcatctaggtccccgaaccctaaaaatgcatattcaaaccctggaacttgccaaagtgtgacattccggtccaacatagccatcaccgttccggcatcttacatggtgctgacgtggtatgtcacatagacgctgatgtggtattatcaatacctctactttggctgacaaatgggacccacattaaaaaaaaactctctttttttctctttttgccctttcctctttttttttttttttcactttgtcttctccaattttctatcttgttccgtcgtacaagcggcgatggcgtgcgaagcagcggcgctccgtcagaacttccgactgagcacagctgcctaggagcatcagggcgtcgacttggtggtcgcggtgttctcggcttgggcgggaacgtcactgcccacgcgatggcgcgccttctgtcgacgcggctgccgcgccgttgccttcttgcctgtggacgctgcgctgttcgtgtcaccgaggtgacagctcgaccagagggcatggttacggtcgatgcagtgggaagaacagaggaaaaagaagagaaacggagaaatgagaggatgggaaaaaaaaggaaagaagggcccacttgccagttggtgtaggatttgtgatgctgccacatcatcatccggtgtggcatgccaggtaagatcctggagatggcatggcagtttgggatcggattgacacaatttaataagttttgagatctggatatgtatttttatagtttgagacctaaatgacataatcgtacaagtttagggaccggctatatactttacaagtaaaacataccgttggaaatatcatggattttgtaggtttagatttgtaatatctaataattactaaatttaaatatgaagtcgtatccatcttagacttttcaatatttattttattattagcttaggccgtgtttagttgttttggtaaaaaaaaaatttcgtatacggacacctatttgactattaaacgtagactaataacaaaataaattattgattccgcctgtaaactacgagacgaatctattaagcctaattaatccgtcattagtaaatgcttactgtagcaccacattgtcaaatcatgcataattaggctcaaaagatccgtctcacaatttacatgcaaactgtttaattggttttttttccacatttaatgctccatgcatgtgtccaaatatttgatgggacggaaaagttggaagtttaaagggaactaaacacagcctcacaactaattttttgctgaagtatacgaacacacatttgaagtattaaacatagactaataacaaaacaaattatagattccgcctgtaaactgtgagacgaatttattaagcctaattaatccgtcatagcaaatatttactgtaccaccacattgtcaaatcatgacgtaattagactcaaaagattcgtctcgcaatttacatgcaaactgtgtaattggttattttcgtccacatttaatactccatggatgtgtccaaacatatgatgtgacagaatttttgaaaatttgaagggaactaaacacacacagccttaattgaaaaacttaagacaacccacgaataatgattaatttggattattcttttcatgtaagccatagtaagaaaacacattcaacatataactaaattaattgatgttcatgacacgtgtcgataaatagccgtgcaacgtaccggtgacggctagtcaagataattaatcactaattagtggcaagggtgtgtgtgctgtcggtctcgctggttgagcaagctagaccgaccgctcggtctcccagctatttacacaaataagattaaatccccgatatttctgagaaaaagaaaaataaataatatattttcaatttttttctccaacaactagtcaaccagtaagggaggaaggctacttgacttgagaatctgaacaaggctccattcttccatatctacttgccccctgggtacgttgatttagaaaggtgatgacttccatatttgcttaattgacttgagaatctcatgtttcgagtctcgactccaaccttgtttggattagaccagagaactaatcatgtaagtgttccatccatgttgctttcacttatcttacgatcgttgaatttttttttccaagtccaatgtgcaactaaatgtggtacggtagtaagcactgtaccatatagacttacaagctgatcatggacagtagcagtcaacactgtccagtataagaacaacacagaccaaccttagcttgagcaaagtcctctactctacccaagccatggatcccttatctcccctaaatttggtcctgccattagctatactactgtcctcactccttgcccctcctgccattgccatgccatccatcgaagagcaagctggagcgctgatcgcctggaaggccaccctgcaaacccaggaacccctgcagtcctgggatcgcaaggcatggccatgccacagctggcgtggcattgggtgcggtgctcgacaagggaaatttgtgatcaccaagatttctctgcgtggaatgaggctgagaggctcacttgaggtcctcaacttctctgcactgacgatgctgacaagcgtcgatctctcacacaataagcttacggggaggatcccttggagtggtgcgtccctcaaagagctcagatccctgctcctgcagaacgatcaatatcaatatgttaacagagctcaagtccttggatctttcagataataacctctctggatatattcctgagcagattggaaatttggtgaagttgaggtccatgaaacttaattccaatagattattaggtaccattccaaataatttagggaacctgactaaaatcactaccttatacctctatataatacactttctgggtgcattcctcaagaagttgggaacttagcgatcttagaagacttgaggcttggcataaacaaactttcaagttccatttcaaacagtattgggaacttggctaagctctctgtgttgattctttggggcaatcaactttccgggcacattccaaacaacttagggaatttgactaaactctcgctcttggatctttgtcacaaccaactttctgagcacattcctcaagaactaggttacctggtgaacttaaagggcctaaggctttgtgacaacatgctctcaagttccattccaaacaacttagagaatttgactaaactcactgtcttatcactttataaaaaccaactttctggacacattcctcaagaactaggttaccttgtgaacttaaagaacttatcgctttattcaaacaacttcacaagtttgatcccgagtagcttagggaatttgtctaaactctcccacttgtttctttggcacaatcaactttcagggcatatttctcaagaactatgtaagttggtgaatttagagaaattagatctttcctttaacatgctcacaggttccattccaaactgcttagggaatttgactaaacttattgacttagcactttttgaaaaccaattttctaggcatatttctcaagaactaggtaagcttgtgaatttagagaatttagaactttccaaaaacatgctcacaggttccattccaaccagcttagggaatttgactaaactcattgagttgtcacttttttgaaaaccaactttctggacacattcctcaagaactaggttacctggtgaacttaaagaacttatcgctttatttaaacaacctcataggtttgatcccgagtagcttagggaatctgtctaaactctcccacttgtttctttggcacaatcaactttctgggcatatttctcaagaactaggtaagcttgtgaatttagagaatttaaatctttccaaaaacatgctcattggttccattccaaacagcttagggaatttgactaaactctccaacttgttgctttggagcaataaactttctagacacattcctaaagaactaggtaacctggtgaacctaaataacttatcacttgctgataacaatctcacaggttccatcccgaacagcttagggaatttgaataaactctattccataaatcttgtatctaaccaactttttggatttattcctcaagaacttggcaacttagtgaatctagagtttttggaaatcagtcttaataatctctctggtgagttaccatcaggactatgcgcagcaagtcggctacaaaatttcactgctgatcacaacagccttgttggaccattgccaacaagcttactaaactgcaaaaccctagttagagttcgtcttgagcgaaatcaacttgaaggagatatctccgagttgggccttcatccaaaccttgtctatattgacatgagctcaaataaactgattggacaattatctcctcggtggggtgagtgcaccagccttacctatctactctaacagtgatagataaatttgggg

SEQ ID NO: 56774 - DNA, 1145 bp, Oryza sativa
gagttttgaagccacagagaatttcaatggaactcattgcattggtatgggaggaaacggatctgtctacagagctcaattgccaacaggcgagatatttgcagtaaagaaaattcatatgacggaagatgacgagctaatatttaagcgggaagtagatgctttgatgagtattcggcatcgaaatattgtgaaactctttgggtactgttctgcagttcacgtcaaatttcttgtctatgaatacatggatagaggaagcttgtcaagatatttggagaaccataacactgcaattgagttggattggatgcgaaggataaatattgtaaaggatgttgataatgctttgtcttacatacatcatgattgctttgcacccatagtccatcgagatataacaagcaacaacattttgcttgatctggaattcagagcttgcatatctgattttggtatcgccaaaattctagatgtagaggcatcgaactgcacaaagcttgctgggacaaaaggttatcttgctccaggtaaaattttataatgtatcagttactttatcctcttgtattttttgttaacattttgacaagtatttgagctaacagcttaggcattcatctcattagtattttctgataatagttattatagtcaacctcgcaaagatgcatcttagattgtacaaaatagaatagaattccttctatacaaatttattgaaacaaggtcttaatattgatgtggcagagctagcatatacaacaagggtgacggagaagtgcgatgtttacagctttggagtgctcgtctttgagctgttcatggggtgtcatcctccccttccgaccgttgccgccgccgccgccgccgggatgccacctcgccgccgccgccgagtccggccgccgctcccaccctcccctcccctcctctcttccaccaccgcaacaccaccgccaaccccgcccgtgggcacccccaaatccgaggccgccgaccgccgccctcctcccgcccgccgccgcctccccctcgtctccgccgccgccgtcgaggaggaggacggagagtggcaccccctgccgctctccgccgccgacctgtccctcccgctcaccctccccacggggcagaccttcctg

SEQ ID NO: 56775 - DNA, 6391 bp, Oryza sativa
taaaattttcttacaaaactcttatactaacaaatgtctcaaccgtttgatttaactagatggaagttgcaacaaatctagatttactcacggcttaccacattagagtttgtaagaattttgtaagaaaattttagtatgcatagacttttccatgaaaaattgttgataaaattaattaattcacatccatgtcagttccctcactatcattttacacattcttactatttgaatgggaacctgttttgcacattctaccctgatcatatttacttccaatttttgttgaaccataagctctgcataacaaggtttgccctttttcattttttttagttgggtgagggtgggactttcatcatttgaatgggaaatagtattcaatgtattcacaattgacttcactctctagacataaaaacaattaaagttgatgggaagtcttgtgaaggaggttttttcacatgagttttatatgacctacaaacaattgtattttgtttttaagcccttcctatatggatttaatgcaggttgctacacaatatctgatgccggagctagctggcaagagcttaaccccaaaacttagtgttgctgttgccgatgcatttgttgctaaatttgggaactatgctggttgggcacagaatgttctctttattggccagctgtctgctcaaaaactcatggttgctgaaactacaaacacttccacgaaacctactaaaaggaagcgtagtggaaacaatgtcaaaacatgacaagaaatatcacatgtagagacaatgccaaggttgactttacacgcggttttgtttcagtaaccataacatgtttgacattcactaactaaagttgtgttatttattgcggggatatcaaattatttaaccagtttgcactacattctgctctacgttacatcgagtaaaatatttgatttgacgatggatcattaacatatatggtcctgggatttctataatctcagtggcacaaagttctgataaatgtttccacatttcagaattgttcttagaacacaatggcaactctcgtggtagtaggatccaattcaaggtatattgaatattgattacattaaaaatgcttgttagcaacttctgggttatagccttagcaacttctgggttatggcctagtgacataggaatgtcgagtcatttattctgacttttttgaaacattgatagcttttttcctgagactttgttgacttggcctgcttgtcaaagatattgttcaaaatcttcaattttaattttgtcttgttatatgcatgaatgcccactgattttgacatagcaaagtttaaagttgttggcaacaaattagtgatctcatctgtataattgccaataaatagatattgttatgttgcacgagacatgcttggtagatgttgtatccctataatggtgctgtcgtgtagctaaggctgttggcatgagaataaatcacactggccctgtgtggtgtggattggaattgttttcatttttttttatgaacttatagaagttgcctcttttgtgggcttgatgttaagagtctcaagggcacatctgttgatgttaagagtctcaagggcttaatgatcaatttgggaaggagggagtagtattttgcattgcgcttactgtcttcatttatataaaacggcttgcatggcctgtttacaaagcgattataaaccaaagattggttattgatgcaaatgaaaataagtttctgaaacaatttaggtaacactactcaagagttgagagcaatgttaattcaaatgaaggattttgaaaagcagtgataggatctgaataatttttcaatttcactggattcttttataataatcattttcttcctagcatctacaacacaacagttcttttttcttaacttctttttaacatcatgtagcttggtgttccatacctttatgatgctttggtggttagtaccttacaacgaggcgttcaaatgccgagtaggtacggactgctgtgggcacatccacgatagaggagcacattcagaaaactggtattttgttgagaagctgataaaaaagaaaaagttcaagttgttctttagcgctcatatctgtttcatttttttgtggtttgcaggctgtgatttcgtattctatcctgtaccagctacctaccatggttttgagaagtgcccaaatttaattcttgccgacagactttctggtctctaggttgttttgcattggaagattattatggtaaatgagtctcctgaacattgcaggatatcttaccattgttagaactcatccctacgctattaatttgtgcgctgtttatttgaattaaccatctgcttatatctaagggaaatagcaggaatcccctatgagttcatcccttttctaccagcaccatttctctcttgtttttaaagttattttaactagtaatatgcacgtgcttttctaccagcaccatttctctcttgtttttaaagttattttaactagtaatatgcacgtgctaacgctacgactatattgatgtcaaaagataatacatgttttgacaactaagcatagaataatgtaaaatcaacaaactttagaaaactttaatatgtggcgaggaaggtaagtacgtgttttttttctcattttgatttggagtgtttaatttatccaaattctctatagtgtttatactgagtgatcaatttatccaagttctctatagtgtttagtgtttaatttaagttccaaacgaccatgaaaccttatattacttaggtggtgtttggatccagggacttaactttagtccctgtatttagacactaatttagagtattaaaaatatagattatttacaaaactaattacataaatgaaagctaatttgtgagataaattttttaagcctaattaacccataattagagaatgtttactgtagcatcacataggctaatcatggattaattagacttaatagattcgtctcgtgaattagtccaaaattatggatgggttttattaataatctatgtttaatatttataattaatatccaaacatctgatgtgatagggacttaaaagttttagtcccatctgaacagggtcttaggccgtgttcttcccccttctttctcaactcacttctctcgtttttcgtgcgcacgcttcccaagctattaaacgattagttttttcaaaaatttactatacgaaagttgtttaaaaaaagtcatattaatccattttcgaaaaaggctaatacttaattaatcaagcgctaacgaatcattctgttttgcaggttggagggattagttccctaacacagccttatatgacacaaatacacgctatggtttatgtctgaagacctcaaacttgtacagagagttatacatacatttgcatatatatacaattcgaaagtgaatgctaaagcagattgcttgttttcagtaggggtcaagtaataccagcgtaacaaatagataaatgtttcctcacaaaatagtacacaagtgatactattttacagtacatcgagaaatcagggaatacttttatagtaaaataatccacgatcctcattggcaagacagggaatgaagaggttcccattatctgacatataatctaagtataacaaatacagctaatcaaggccttaggcagtgtgcatcaaaaacaacaagaacaaagatgaatgattgatgctagagctcacaatggcaaaagtagttgagttgttgatagccatcagaaaggacaatacatatagcttaatctcatcacatcagtcagaaacaaaccatgaattactcaaagcccttgtgcaatattcccatcatcacagcgtaacaacatggagcatcctcttattttggaaggtcagttaccttcctgtccttgaaggtttaaggttttcagaggccattgaatgcagcttgaggtgcccgttaagacattagggcagactccccttgttgatacatcggctgatgacctgtagactgcggttatgcacccatccacaaaaaagttaattagtatatgcggggcatactatcagctatatacaaatgacaatcaaatagtgtgtctgtgttcccaaatcagataagatgtacccatttcatcagtgaaggtcaataagtatgacataatctgagagcatattttgagagtttatgaactcccgcatagaatattcatgtctttgatgcacaaaaaataattaagccttctaagaaaagaagtaacgaaatatcataaataatatttaggcaagtacgtatattttaattcatagtgaaattacagcctattattaaaatatagcaacgattgatatgcactacctaatatcgacgaggaagcgcatgtccaagattgcatggttttagtcagcggggggaggatttgagcagaggcatttcaaaaggagaagatcagtgtaaatcctagcaaaatctccataacatatcaatagattcaaatagaaagccaaatctcttatcacatttcaccagattcaaaggaaaaaccaaatactcgcaagaaccagcttctccaaatcctagccaaatcccctaatgcattatcagtagttctttacacattacacattacacaaatggtagtatgccctccatagaaaaaataaaaaatcaaaacttttaagattcatagtctccactctccacacattatttttttagccgggccggcctaagataggcggaccaaatttacttaagaaaggggtatgtacatatttacaaggttccaacttcgacaagaggctgtcgaagtaaaaggatgttgtcacaagggcaacttcccgaaagaaaaaacaattacatcatgctgttgttactctcctaaaactttgaaaaccccggcttctttccagaccacaacctcctctttaatcaaagcaaagaggctacccgctgtccggctctgactctggaaaacacgtgcgtttctctccttccaaaccatccaacagacaagcaaaactagcgtgtcaaaagcgcccctgcagctagtctgaactccttgccacgccaagagccaccattcccctagttccaaccctgcttcagccggcagttggatgccaattccagcccaacccttgatcatcctccatactctggtggtgtatgggcaggaaacaaagagatgctcacagtcctcgtcgctgctggtgcatagtgagaatgtttgatggtgtggccatccgcgcttgctcaggttgtcggccgttaggcaacggcctttttctgccaaccacataaagaacttaacctttgtcggtgttctcgtgtgccaaactagattgccacaacgcgcctctgtgtttgccataaaaaacatgtcataggcagaggaaggggtaaatcttccattcgaggcccacttccatattgtctcatcctcttcccctcctcgcagctgcaccttctggatcgcatcccaaatttgaaagtactccccaatggctcggttggatggagctcctttgatgtcgcgcacccacctatggttctgtagtcctctcgccactgtcaaacccttgcgctccacatgactgaagattaacggaaatctcgcctttatgctcccaattggcagccaatccgcaagccaaaactttgtgttttcccccatctcccaacacttgccgtgtggctgagaagaacaggtcctgtaactccttcggctgcttagtctcaatggttgtccaaggtctgtcgcgatgctctcctctctttgccaaccatttaagccgtaacgccatgccgaagaagttttgcatacaaagaaatcgctggtggccgcagcctgcctcccatcccgcacatggcgccagctgagattgccttgtttaccagggcctgcaggacgtccatcaccaatacagtattgtagtgcttctatcccattagactgactcagttaatggagagatgtggacagggttcagttgtaaattcaggaagccacttagagaccataccttgtcatatatcttggcatcattcagtgagcctgtaaaatttacagaagatagaatgagctctttcttagccttaaaaaagacatcaactttcagcaatgaaaagagacagacaagggtaagcaaaagtagcttaatgaattatagacggcactgaaatacagaggtcaaacctgagataaaaaaaaatgggggtaaatattagagcagggcatcactctgaaaattattaggtagaatccttttatagatgctatttgactcacgactcatcaccacaaaaccaaggactgaccgataattattgtcaagggctgcaggaat

SEQ ID NO: 56776 - DNA, 12029 bp, Oryza sativa
gggcgtggtggaaaccggcggcggcgcgatgggcgggtgaaacgggagaggaggaacgcgggcaggcatgggtgcggagtcgagccgttgaattcgacgattctggaccgtcggatttgatgaatgaggtttgcatgagtgtagttggtgaattatagggtagaagatgttatgttaccctggggactctgaagattaattgctagtatgtgttgattggcaatcgtctctgtacccttaaaactgatcgtaaacattcaggccgaatttgaccatagatgggatgaaattataaaacgcgcaagtgggccaaatttacatgcactcggccaattgtgcgcacacctgggccaaattcaggcagggaacttacaaatcgggcgctctaccagataaaatgttttactgttaaaaaaatatttcaccttgttaaaatattaaaacacattcaaatcacgactgagacatttcattcacactgatgaaacatcgaatttcatttggtgaaacataacaaatccgtttgcattaaagggcaagttatgaaacacctctcgaattccagatccgtctacccctgccacaaggcacaagctagtaacacaaacttctacgcaacgatttagctttgctcctctaagctttcgtgggccccacatgtcatggactaacccgccgattccccacgtctccttaccttcccccttctgccgacgaagcgtcgccgcggcgccatggccggaggaggaggaggaggagccgcgctggcggcggcggcgtgggagatcgccgtcgtcttcgtcctccggcccctcctcgccttcgccttcgtcctctccatcatcgccctcagtacggccgccctctcctcctctcgcttcggcttttggctcgaggggtttccctgattctttcgttcgctgctcgcggcggcggcgggtcgcaggctggtacgtggcgtggaggacggtgctggtgcacgtcccgctggtgcaggagatcgccgggctccgccggaagaagcccgtcaagcccaagcccaaggagcgcggccgcttcgccaggttctaccggtccctgggcgagaggtgaaacctccattgccacaaatctcctcctcctccatctggatgtccagaattacctgattatttcatccggttaagaattaattcttacgtgtgcttgtgcacttaattgtagatattaagctactgaacggccagcagattgtctgatttggttagttgtatgttgattgttgatgttcgtggttctattttatttattttggttttagagaatgcgcatttgaattaagggcaatgaacgaagctcaaagtacgcagatgtatatcaaagccaaaaatattaaattggagaaaagaaacaataaagacttttactcagtacaaaatttcatgaccaagacattgtttcgaacttaaagctccatttgtgctcctgcaaagcttccagactgcagactcctctgttatcgctgcagcgagttggcatggtgaccttgatttacccagactgcaggctcctctgttatccctgcagcgagttggcatggtgaccttgatttacccattgttctttatgaggaatgggataatatctatgctttggttgtagttgaatcgtgatgggactaattaagcttaagctatctgctttccacttccgtcaattgtgtgtgtaagttagcagaatgctctgctcaagcagtgctccttagggtggcctgaagtctaaacttgtgttgctaatacagaagcacaaaatttctatgtacttttgtttattacccaaacttcacaagtgaataggaagcactatgttatatttgtgcatccaaaataaatttgctttacaccttgggaatcactaggggggagcaggggagcagaatacaatgtttcctggttatttgtgtcctcatgtatcgcattcaatggcactgtgattccggaattcctgcatctaacattccgtgctgagcccaatgtggatggtgaagtctgtctacccccaatgcaatgaatcaccagaaagttggactgtctaatataaatgtgttgtgtcatgtttccactattttatttgcagaaattagagttatgcaagcgtctctgagtcctcgttatttttcttgtcattctaatgagtgttacaatcctttgaaaaaaatcaaagtttttagcacctgaaagtgcaaatacatgtgttctctaagcaggtgttatggacttccttaggcaccattctagacaggttaaggattgggaaaccagtatcattttgaaactttgttatcatttgaaagttagatcctatgtcctgattaaaatgacattattactgtgttctttctggtatattcaaaagttttgtttatttaaattaattcggacaagatagctaaaatggagtttttctgggtgcttttagaaacccttagtttgttctgtgtatgacactcgattttcatatgtacccaaataagtttacatcttattgtgcgatatctgtatattatacatggaattcagctcaagtttctcatgcaacgagaataattactagtgcatcagaacttttctgcatatcacatagacatagtaacaccagttatcaaatttaaggtttgttcactttattaccattttcaaccctaccaaattttggtagggcaacataccaaacaaattcttgccattgctaccataccacattttggaaaatttggaagcttccactcttaaaaacactacccatatttggtaaatctttaaactaaacgcttcggacactaccaaaatttagtaacattaaaatatgccaaaatttggtactaccaaatgttggtaaggtcgaaaatggtaataacaaagtgaacaagctcttaacctggctgtttattactggttgacaggaacaataaatcagaagggacatcttaagtcaagatcttcagcccttctttgcaagaagtatgtggactgtagcatttgaatctagcattcggatgtttcagtattgcagagaaatagcaggaatttttgggagataatgggtgctggcatctgatggaaactgcccccttgcaactgtgtgtgcatcaagcttctgcaacaaaaagaccctaatgtacattgcacgttgtaaagctgctgatcatgtaattctagtttgtacatacatacacctgtacaagaataaagagaaccacttgtcctttggaatatgagtgtaccatttgttctacaaagttttctttgttaagttgagatctaatcatgggctcataatggcattcataaaaaagatcaagattgctttatatgatgccaatccgatgggattgtgcccctcattctttctgctttgcctatcaatgatcattctgtcaatcattgggtgattccccttggggaggagtgagtatctacactcacctggcaagaaataaaccatacatccatcttttgaaaatccatgaccaaaccatttgctcaaagagactccctttttcgccttttctttcgctcggttttcttctatcttttcttagaaacaactgatctattcatccatccttaaaacagtgcaggaaggcgcgattacgcaacaggagggttgacataaacaaaggtgaatttcctcctcccctctcctttctcctcctttttccacccaaaagctcaaaagagtgatgcaaaatgctcccaacttaagaaaaattgaggatggaatgatggctgattagaccccagggtgccatgcctcctccagcgacacaaagtgaagctgccacttttgtagcacaatcttctccaatctcccccctgatcatcaccttatcacccaaccgaaaaaataaaaagggtgcgaagacgatgacgaccatggtggtccggagaccgtaccggtcaccgtcactgaaaacccgtcttcacgctgttttcaggggcccctcttaagggtagaagggtagaggggttcatgctgggtgtggacgccatgattagggctttggagaattattgtacaatgctagcttaagcttgcagattccaaactaatcagtggtgatggtggtggattcggccgctctagatttcggtaagatctcctggctcgtgtccaaagcaagatcaaaagcaaagagaaaagctagtttaatttagttgatctccattaaactaataatttagttgagctttggtgtgaacaatgagagtgacctatcatgcaaaagcatcagaaaagggcacagttcaaatgtgtggagccaatcttttcttcaggtggccaattgaagaaaaaagaaagaaaggaaagaaaaaaggaacactcttgagatcacatataacacatcatttgggttggctgctacatatgcataaaaaaggaattgtgtatgattaggaagtattcagtaagaattaattcctaaaagcattttgttggcctatcctgtcctagattttgcacatgtaaaaccataaccatcatggtagtcctcttcaactctgtggattagaagctagaaaaattctctctgcgaaacgaaaatgcccgtgaacagtcaccgacaagcggggccacgatgaactgtgccgatcagggggatatattattcatgcgagttcatctatgaagatttgcaatgggaatcactcacacgcgtatcgccactcgcctcatctttcttgagtaatctgatgcaagaaaaaagtaggacacaacagggagagatgcttcggcagtacgactagaatcctgctcagtattgctgagcaaggttcatcttagatatcatattctcatggaagaaattggatacatactctaatgtcatacatatttttccgcataagtgattataccatattttgcagtgtgcacaatgttaccaatgttcttttttccaaagaaaccaattttcaggatctgcaaaaaggtgtaaattaccatctgtgtttatgtggaagctaataaaaggctaaggcctccatcagaattgatgccaatgaaaatcctgtaaaatttggaattcccccttttcatctacaattagctagaaaataagagccataaatgtatcatcaacattatatttatctatcactgttttttcctcgacaagaagatgagatgaggtttgatgaagatgaccagctaccaatttcggctgaaaactgaaaaccaaaatggccaaggcagtggcttcagaagtcgtaaagaaaatatgtttttttgccaagtaaaagggaatatgacctatatgcatcaggaactccacatagaattgtttgggccccattttgttaaagctcagaatatgtaggtcttgtttgagcctttccagacaaacaatccaagcaaggcatgctatattgtctgctcttaaatgttgacaaataattgatgcaattggaaatgaacactgaatgaagaaaaggaaaaaagaagaatagttgacaaccctatcctataaaccttttcattgccgtcaaccatatggctaatttgctattattacagcattgagataactgattatctattatccataggatttggaacttaatagagggaagtggtccggggggcatgacttgaggtttaaggtatagattaagagatcaagattcataatcatattggtgagaaactaagaatggggactttaacccccttatttttctatagttaagacaagccaacaccttacaataggatactttgattaagatggcatataaaatgagaagtggtcacatggcgtaacttgaaatcaaatcaagagtcatgagaagagcagagaaaaagcaaacctagaactagagcacagaaataaaatactctcagtgttaaagttttccttgctggtacaggtttttttttaatggtctttcgagaggtattgataggtacatatacctcctaattaacgctaaaaatacatatgcaacttcaacgaccatagaaaacctctgatacaaaagatattttctttctttaatttccacttggaagaacatagacagaagataatcgagtcttgagccagctgaaaagtgttctgaaagtgagctgaaggcaaggctttttaattagccaacgagatctgcatggagaagcaggaccaacataccttcctccgagtccaagagcatcacattctccaacaacccacgaacaccaacccataaatatatataaattctgcaattagcatggctacaaattttcactgaactagtgcagcacaaacaaaaaaacatcataaaataagtagtagtaagtacaaaagcaaataaatcaattcctctgaatttctcactaacaacatgctctatttcctacaaagaaaaagaaaaaaaaagcttacctcatgttttcagtggcgaatttttacaatcttttttggagtgaatatcataaaatcctgggtattatgctctatgttgcacaaaaccacaagtagtttggcatgcagcgcgtaaccctagaaattatggtaatatagtttcacgaattttgttacataatgttttcagtggaaactttttacaattcttttaattacactctgaaattaaaagaaaaatcgaatcccaaagcaaaaggcgctatatatataaaaaggaggaggattaattccagcaagatgcagccgaggaaaaaacaaaagggagaattaaagcttgggccaagtgagagaatctgaaaagaagatctctgcattaccaacatagacatatagtgggggttcgagatatggatttgatgcaaacatatatgcaggatgatgcatcatcatccccattccccccccccctcccctaggaattaaccaaaccccatgaaattagagtttttcttttcttttctgagcaaccaaagcaatgccattggagcaaattaaccaaaggaaccctagctacaagctaagctactcgatggattcgattcgaggtcatctgcagcatgatgaatttctctgatatctacagatggctcgaggaaaggaagagggcagcagcaaggtcagtcacatggtgaatcattcattccaatgcagagagccttggaacaaggaggagatgattagccctcttctcggtaacaggagggaggctgggagctaggaaacccaccgtcgatggcacgacgggttcagcatattattgccatcgatgatggtggcatatgcaatgcatgggcaagaatggattgtgaagtgaagccatggatgcaagtgagtggaatggagctgcgcaccgtgcaggggtggagctagaacgaaacggggaggggtgtcatttgcttaatttactctactttagattgagtttaagctgatgcgggcgggtgcctaagtttatattgagtttgcttaataaaaagttgtcttgaccgctaatatactttgcctccgcccctggcaccgtgtacagtactcacttgacttcgatcacatattagcccgacatactgccgtcacatttaaatgtgtagcactattgactttattcggtctctgatgtgcattattttactattagaatataaggataatatctaacggaattataatatcacaaagaacttataaagaaaaaccaatctatatgatttatatgttttcaaactaaatattttgaggagagctatcgatggtcaaagttttgaaagtttaatttgatcaaataaagataatagtgtcatatatattgaaaatacagagatagcatatgtttagtagacttttattattagaacactttttattgtatgccaagtggcagagaacattattgtgatcttaaaaatatactatgttttagtggtacaaaagttgtacaattatacgatattgggtaaataaaatgttattgtaagagaaattaatggtcaaagtttgatttgattcgatatttcacggtgaaacaaaaccgtgctatataaaatagtaggagggcatagatacattgtaatcatttgcatatattgcttatgaaatggggtcctgtaagcacatgagtcaatcaatggcctttctagcctaccaccactactaccaccatcaccatcacttcacaagattaagaaatcttggtccagtttcccccaaaacaaaagcaagctcacctagcttcaatgtagcaatactagtaccacatatattcacaagggcaaggagatctctcaattacagcttcctactcctagtggcaccaagtgtccacccaagatggaaagctcatgataaaaggagaagaaaaaaaaataatatttcttcttgccatatcttgcattgtcacatatgaggtaataattagcacagcataataaagatataataacaactttatgcagatgtccatgccccatcacaaggggaaaaaagacattttattcgaaatgaaaaaggagaggaatcgaatgtatagtactagttcggcgacgtctaaataaagaacattatatccaactaaatacgatcaccttactctactaatattcaggaatggaaggatttacttttgtagagaaaggtactagtttatagtactaattagtagctaatagtaattattaagtttttgaaactaatactagtagcaattaagtagccttggtgatttttttttcttactttcatggcaatgagggggcccaaaccccactgtgatgaccgttttggaggaaagattcgggtcaagtcatcagtcaaattttcagattcggattagtctcacctgtaatctttgctcacatcggatcttctgcagttagctagtcacccctacacaagtggaggatctgatcgcatcacaaatcagaccctaataagtgcattagaacacaaatttgaggaccaaagtatatctctatagagaactaaaaaaaaggtagctactgcaaacattaacggtgaatcctaggggataaaaaggttactatgggaacaaggtttgcacatggagtattttggttaaatgttattggccatgaaaatgtattgaatcatgactacctctgtattggatattatgatagagagagcaagaaggcataaatcgtgattgtgtatagtcgacaattatgctccaccattgcccaagcccaccaataaaaacaaaactaacttccaaagtatatatatttcttgtattctccactctaatttgacaccttcaacccttatggtgctcgtcggttttcctcatcaatcgctagctcgtttcccctccatccttttcacttctctctagtgattccatccgatatccataccacaccactcatcctccgactctcatcgccatcctttagttggttgcatcctcgctttctagggtggggttgtcatggccacatagaccacaaccttacaaaagcccaattgccaaaagaaaaattgggaactatatcttttttggatattggtgtagagcattaatatgcacaatcacaagaataagtagagctaggctgtgtttagttcctaccaaaattggaagtttggttgaaattagaatgatgtgatggaaaagttgaaagtttgtgtgtgcaggaaagttttgatgttatggaaaagttgaaattttgaagaaaaactttgtaactaaacacggtgccaatgtatttgtgatgggtaaaacccacaaaacaaagggaattccctaccttcctaatttgtctattgatttctctacttggatccaatacccctaaaacattgtgctcatcatgtcaaaaaaaaaagtgtgctcatagtttagagtttttgtttgatgataactaatttcagtcaagagtagaatgacacacgatggtaaaaaaaaacaaaaaaaaaggagattgagtagaatgacatgagaacatgcatacaaatgatttgtgcatacatataagttgtctcctttctcacccttcggtatatccatatcagaataaatactcttaacaagtactacctccgtttcaggttataaaactttctaacactgctcatattcatatagatgttaatgaatctagatacacgtaaatgtgtagattcattaacatatgtatgaatgtgaacaatactagaaagtcttataatatgaaacggacgaagtatcttgcatacaatcttttcaaaaagaaaaaaaaaagaaaagaagaaaaagggatagcttgcttgcatggatcagctgaccggccagtgaacactagtgccaaatgcagtagatctccatcaactgtctctctctagctagggcatccacaactccacatcatcactgtgtcaaaaaaaaaaacacagtctactgacaagtatctttcagaaaagcgagcgagctaattataaggaagggaaataaaaaggtgacccatgaacatatatatccggtcgatcaatcactcgatctcgtagggaattaagtccacggtccaccctacctctcatgagatgatgatgatgatgattgttattattgatgatagctcgcactatcaactttgggtgtaattgacatgttgtctgctcggtggtagcacgatttggaatttcaaatcgatctctcttgagtttcaggtattttaatttggtactagttactagtggatcaaatcaagaaaaagagtaaatatgctagctttccctcaaaatctctcaaaatttcatgtttttttccatacatcgtgacatctttgacaacagaagataaaagaaattaaggcttgtttggtttactgtcatgttaaaatgttgacaatgccaaaatatagataaattttagtagtgccatttttttagcaacttatatgtgttattgggcatattttgatagcaaaccgaacactagctaaaattctattcaaagtaccaacaatttggtaggacatatatatattttggaatcaaaaccaaaatggtccttattgtttaaagtttatttgaacaaatttctggttaccatatatatccacagttatttttgccagtccctgaaaaattcaccccaaatcaatgaaaattctctaggctttgactggcagtaggtgtggcagaaagagcagtacatagctaaagcctaaaggcatgtagcccccctggagaagtgccctggccctatataacacacagcacaaaggagccccctttccctcccatcttcttccttccatacatccatccatccatccaagtctcttcctcaccagctaccagcagccatggccacatgagagagatctctagagagagagagagaggccattgttgcttgcagtagagttgcaaagaaggctagcctagctatacctactactagctagtagagccttgttgggcttgggagtaagaacaaggtcgccatccaaccccaactccatatatccatcccgcacggttgcacagttgcactcgttcgttcgttgctcgcgccattattgctctccctccatattgctagctagctaccaccataagctgtagctatagctatagctagctaacctctctcgagatctcggagatatcatctctggccatgaagccgtcgccgtcgacggtggcggcgttctacgggacgctggcgagggggctggacgagctggagcggtcgctggcggcgtcgtcggcggcggcggagttcgtgtcggcggcgtcgctgcgggcggcgctggcgctgatccgcgcggcgcacgcggggctcgcccggctcgtcggctcgctccacctccccggcggcgccgcctggctcgacgagtacatggacgagacctcccgcctctgcgacgcctgccgcgccctccgcctcggcgccgcctccctcgagggctactccgactccgcctcccgcctcgcctccgccctccgctcctcccacctctccttcgaggtcagtcactcacacgccgccgccgccgcctccgccgccgtcgtcgtgacgatcgatctgtgggtgcaggtaacgagggcgatgtcggcgtgcaggagggacgccatggcg

SEQ ID NO: 56777 - DNA, 1702 bp, Oryza sativa
aagttttgagatttgattgcacgcattctactattattactactagtatatatatgtaagaaaaggagatggtaactgtgaagtgttcataaatcctaatgtctggagctatgtagatgtaggtctgttttgcttttgcaaaaattgaccaaccctctcactggtcactgcacattcctaatccttttcaggaccaccaaaagacaccccaaaaatctttgcacaagtcaattcccagacaggttatgagccagcactactgtagtacaatcctagcaaagtgcaattttccactcctttctttaagcatttgcaaggaaaaagatgcagcaagcttttgagcaggtagagggagatctctccaagtctgggtacagtttgattctaggacactagaacaggagatgaatagaacaaatggagggataaagtagggtagggacccccccccccccctcttccctcccctatcacacacagagagcagagtacggcagaatcagaactgaaagtgtgtgtaggagcagcagctgagccttttggcagacaatccacacttgttgactctggggctgggagcaacagcagtacaggtaggaactgagccaccctgccctgcagccaagatcacaggcaaggctgccatggaaagatctccacagcccagccagccagccatgaccacaacaccccatccatcatctatcacaagccccataacctgactgactgacagtcacacactcttctctatctctttcactaaaacaagttgaccccagagagcaggcaaggtactcctcagtaaccagaagtagacaagaaatgcaggaactttctgtgccttattgaccacatgtgtgagtgtgtgcccaaaggtgagcaaagaactcacttttgttcaggcaagcaggggcagagtttgatgctgcagagcaagcaggagggcatggttgcagggttggttggtctctcaccagtgctagcttccagctttcatggccccgctcatctcatcagttcaggcagccaagggagtactccacctccactacttgtacgctcctctggtgtgacagtaaccatggagatactgtaaaagttcagaactgtaaacagaagctgtggagacggatgactgcagttacatacaagaatgttagtagtactttgtaatacaaacatgatgagatattgagatagatgggtgctgagaatgcagtcagagaatagtgtaaagatagatggcgatgcaagaatgagatgtgagtatgtgtgagatcaagaatgagatgtaaagaccagtagttgcgggcagggcttagagaccataattacacgagacaaggtgtgcatacaccacagtcaacaagagaggggaaggtgaggtgaggggggatgcagcaagcaaagcaagcaggcaggcaggcatccaatgcccccacacacttggtttctctcttgccctgatccatgcaaccagcagacagccctgcgtgtgccatgatattggctaatttggtgctttgctcgtgtgaggtcatggcaggatgcaacacatcttgtatccgtgtgtaggagctgcaaaaaaaaaaaagaaatagtagcatcaatccgtaaacagcgaggccgaggggaatgcaaaaagtttcagataaacctaaacctatgtcaagggtttcagtttgaacaaagtgatgca
